United States Patent 11,001,841 (CCCTC-BINDING FACTOR (CTCF) RNA INTERACTOME) - sequence listing, part 56

SEQ ID NO: 131941 - DNA, 2890 bp, Homo sapiens
ggggctggcacttggcaggtgcccaattctatctgcgcttggggacacaggccccaagaggtgaagagtagacagtgaggacagtaaggcgaggcaaagccaggacagggagtctggaccagaaacacgccaggtcctgggggcttgtgatccacctgtgcggtgtctttaaacgtctttcaccatcccccagtgaggccacgggtcccccagcctgctgctgtcacagtgtcccacacagcaggccatgcacacaggctggagtgccgtgtggtaaacgtggatttaaaaggaggggaaacggaactctgatgagggtgtggtgggcgcaggcgaagcccacccagaggcagctgttccttccggaagacacatctgacgggaggcggggtggggtctcttggttccaggtacacccccgtgggccgctccttcttcaccgcgtccgaaggctgctctaaccctcttggcgggggccgagaagtgtggtttggcttccatcagtccgtccggccttctctctggaaaatgatgctgaatattgatggtaagcagcgccctggggtcttcactgcagggcagggttgggcatgggctggggggtcaggaccccggtcggggggtggcatgtggccagctccacgcatggcctctgtcagagccagcgccgctgcgtgacacctggctggtctcacctgcagtgttgggtgggttacggcagtggctctcaggccagcgtgaagccacgagatggtcgcaccctcagaggctgtggtcaggggctgaggcgggcctgaggatccggggcttccttgctgctggcctcctgtaggcctgggtttgactgtagcctgggtgtggcctgtccctctcttgggaggcttagtcgctgctctgtgcaggacatccgctgccctctctgtgaaaaagacgagagtgaaggccagcgaaaaggatctgtcttctcatttgggagctgattattatgaaaagctctagaaagcaatgagaatttgatcttgctcagttatacatttattgaaaaagaactacataaaaggaaatggtgaatttcagaaatatctacaccagacggtaaccagaaaatcctacaacactggcttcattctcggagggtgactttagtctttaactaatcagccagctcctttctgtcaccctgaccagagggaggccagcagctagggcctgggcttgtcactgctggcctgcccgtgtctgggcctgaggctagcctcagtagggagtgagaaccccggccgggtgtccccaccatggctggcctggcctatgaggcccctccaggactatgggcccgtccagcagccccacagtcatgcttaggcctttgcctcttttctcgcctacagtgtcagcaacagcgttttacaaggcacagccagtaatcgagtttgtttgtgaagttttggattttaaaagtattgaagaacaacaaaaacctctgacagattcccaaagggtaaagtttaccaaagaaattaaaggtaatgaactgtcccagcacacctggctgagggctgggaggccccttcccggtccgcctccgggaccgcattttgcagttctggttcttgtgcgcatttggggaggtgggggtggcagaatgtagccatcagatgaggtagcatggagatgagttagatccatttcccagagcgggagtgggggtttcctaaataaatacaaccccatggggtgaggatgaggttggggagtcagtcacgtctgagtcatgatctcaggactagaagcagcagcgtggctgtgatcagcatttcctaacgctggaacctaggatgcgttttcttttgtcttcatttaatccttacacagcccggcaggtgtctgtacccagtcagcctgctttctactccaagaaactcagattggggggggtctaggacttacccggggtccttctgcccatcagcaacagaatggggggcccacccctggctccacaagccctgcccgctgaacccgtccttttggaaggccatttgcagggccatccaccgtaccccgtgttatcacgatgacccatggggggcgcagaacagcacgagggtggacaccccatgctctaagctgagcctcccctccaccacgtggtactcttgtaggtgagacggacccggctggggtggcctgggggtgacctgtgggtcaccctccctaggggagccctgcagccccccataacttgggtccccagccacattcctatgaaaactgattctcgcaagtggcgcctgcactcaggtcgggacagccccgatgccgatgcctgtgttctgtgtccccaggtctaaaggtggagataacgcactgtgggcagatgaagaggaagtaccgcgtctgcaatgtgacccggcggcccgccagtcaccaaacgtaacacgcccttcctttcagactctcttggctggggcccccactgtcactccgacgggcacactctggagccatgattctgtgcccattctccagaaaggaccatttcatgctgtttttcaatcccaaaattgtcccttacatggctcagtagattccagacttcacctaagaaaataaactcagatcatgaaattccccctgggtgctagaagggccggcccaggctctctctccctcttccttcctgagcctcacagaggagagaagggtcttttgtgttcattgtcccatccttagtgctggaggtggcgggtctgtggccctgacccacgcccccttccctgggccagtccgcgtgtcccatcattacggcaagagcacggtttggtacgcaggccggagtggggggtgagagtgcaccgctgtcctgggttgtactggtgtttctttg

SEQ ID NO: 131942 - DNA, 1050 bp, Homo sapiens
tggtgagctgatatcgtgccactgcactccaacctgggcaacagagtgagactcagtctcaaaaaaataaaaaataatctttacacatactttaagaagcaaacacatcagaaaccaggagtttaacaactatgagaatgaaaggctgattccctctgggaacaacatacacagtttgctttttaaaccctgagttcctgagaaagaagccagctccgtatgcaaagggtctcaagttgctgtcagggatgtctgttttagtgggagagcaagtggcctgcaagcagctctctctacagacgttcagtcttcttccttttgcttttgagacagggtctggctctgtcgcccaggctggaaagcaatggtgcaatcacgcttgctgtagccttcaatttccaggctcaagcgatcctcccacgtcagcctccagagtggctggtttttcattttgatgataatcttgaaatgaataagctcctttcagcctttctggatggtcagcagggcccagcaatctcagtgcccagtgatgctccttcaccttatcacgctctgacaaagggagaacgtgctgtgactgagcagagaccgagttacgatatagggctctgcataaagcgatctcatggttctaagaggggcagtggtctgtgcgttgtcactgccagcccagggtgatagacgttggttttcccaagaggagcaagtcctagaccaaatgcacatcagtcaagcacgatcaccccttgcaaactagtgtgctgtggagctgaaatgtagtcattttaaagttctgtgcttaatttgcatttgtttttacttatagttttataagaaagaaaagcataaggagtttgtgcacagttttgtctgtatatgtttatatttacacacaaggcgggcatcagggtagtttttctgaaaaggggctgagggcgtctatatggtatttgatatttaaatttgagacctgtcattgtggaaattaactgtgcacaaactctggggtaaaactagatatgggtgtgaggcctggctccacccttc

SEQ ID NO: 131943 - DNA, 1050 bp, Homo sapiens
tggatcacttgaggttgggagtttgagaccagcccggccaacatgatgaaaccttgtatctactaaaaaaaaaaaaatacaaaaaattagccaagtgtggtggcgggcacctgtaatcctagctacttgggaggctgaggcaggagaatcacttgaacccaggaggcgtagattgcagtgagccaagatcgtgccactgcactccagcccgggcaacaagagcgaaactccgtctcaaaaaaaaaagaaaaaattagccgggcgtggtggcgttaatcccagctacttgtgaggttaagggaggagaattgcttgaacccaggaggcagaggttgcagtgagctgagatcacgccattgcactccagcctgggccacaagagcaagactccatctcaaaaaaaaaaaaaaaaatagcgtcagaaaaatgtccttgtatgccattttctccattttattgacattttgcccgacttttgtctttgtttcagggaaatcgtggaacacatggtccagcactttaaaacacagatctttggggatcggaagcccgtgtttgacggcaggaagaatctatacacagccatgccccttccgattgggagggacaaggtaagctcgccgggatgcccttggtggagtaacatacggtgaagtaaagctcacacatgttgtaaagtctgtcatgcctgttctcatacacgaaactatttcactgaggaggagagagcagttcactgccacatgcttcgtcctgagatccataaaaactaccttctctgtgttgtggctttcagtgatgggggtttaacttgtctaggtccagacacggatatcgagaacttgctgaaaccaccaaactttaagtacaaagtacacatgctaaacacaagccacaaaccaccgccagacaagagcttagagtaagcaccagtattataaagacctacagaggccaaggcaggaagatggcttgagctgaggagttcaaggctgaagtgagctatctcagtgcgccacgaattccatcctgggtgacagaatgagactc

SEQ ID NO: 131944 - DNA, 1052 bp, Homo sapiens
aaggagctaggaatacaggcacacgccaccacgaccggctaatttttgtatttttagtagagacggggttttgccatgttggtcaggctggtctccaactcctgacctcgggtgatctgcccacctcggcctcccaaagtgttgggattacaggcatgagccaccgcgcccagccaattatagaatttttaatttgctacgcttccaagccttgccaagatgataactttgtgtgtaactttgtcagaatgtataggcttagtttggctgttcttttcacattgtgctgaaggcatcaacttttggagaatgtttagtgagtccttaatgctgtggagaggttcttggaaactgcgtttttaagcaaaacaaagtacatcaggttcttgaataatgttgttttgttatgatgttgattaggaaaaaaatggatttgttaaacatcatgtcacttaaacttgctgtttccaagaactgccaacagtgttaagtgaactgcatgctcctcgcttgctctcgcagtaggtggggcctccatgctcctgcctgcaagttcttcctgcgctggaaatgggtggaggcatctccctgggtcccctccttaggcatcagaacctacttggtttcttcagacaaattaaaatgtcatcgatgccctggaaggatatacttcagtggtatttcttggcatatttaattatggaaaaaatcttaccttacttatagtagacctttctaagttgcaaatattttactgtgagcatgattgatttataattacgaaaaagcaacttagtctgcataatttgttgatagcactggtcatgttgagtatatttggagcctcgaaggcatggaatattgagcagagtgcggaaaataaagcggtttttgacaccgtgcttcattttgcaggtactaactgacttgtccatttgctaagcttcatcccaccgggcaattttcctgcacagcagctgttacagtcccattctcacctggcccctgggccagttcggaagcctctgagcaggtttgtagctttctcctcc

SEQ ID NO: 131945 - DNA, 1045 bp, Homo sapiens
ctgtgacatctaagacttgacagttgtctaaataggattgtgactttgagaagagctgaacttcactgtggtttatagagccatttaactcctcctgccccctctcccccttccctcagtggtccccatgaaggtatggccacttctcccaatactggtgcccatctgccatggcaggatatcaccctctacccgtggggcagttgacatggccgaggccatcgcggcatggctgggtatttgtgcagagtcccccttgggtctttgataaaccttggggaataatttaagtaagtgcataggaaaaaaagatgtaaacgcttccaaactcctaaaccctgtgcaatttgaagaagcagaattattttttaacttctagtttccatgtcaaaagtttccacaatgccagttgggcttattctctgtgtgttgtacagtgaatgctctcctgtaatggtccagtctcataaaatgtggttttgtttcacgaatcgttactgtgaatcttcaaaacataacatttgagttttaaaaatagttaatattgtgaaataattgaaaagacataaaagtagagtgactcatttaatacccctccatttatccattaggaagctttagcagtcatcagggttctccacatttgcttcaaatatgccccttttctttgtggacgttttccaaagtgaattgcagacctgtcattttacctcgatatttaaatatgcgtgtctaaagcaatggagacgttttgaacataccccagtgccgttatgacagttaacagtctgtgatcaatttctctcatattctcagaagtgtgtttccagttgggtgctttggatcctgaattttaaccaaagttcacacacacatttgggtctctgccttccgcctctaaagctagcccaccctctctcttctccctgcatttgacttgttatatttacgtcttcttttttttcttttttttttttttgagacggagtctcgctctgtcacccaggctgaagtgcagtggtaccatcttggctcactgcaacct

SEQ ID NO: 131946 - DNA, 1010 bp, Homo sapiens
gatattgaggggccgggctcaggaattgaggctgctgcagtttctcctgaatctatgagaattcagatgggcacttttcagtaattaaaaccatatgtcctcctcctcctttctttttgaagagctctcattctgttgaccttgcactgctgctggattgttcctcgggctttgcatgttccctgcatttgttttgtaactgagcatggtgcatggcagacctctctatgcagtatgctggggcagtgagcaggtggcacagtagccacaccctggcaacagtgagtgagagctggtgggcaggcttggaaactagctcctttttgttctgctcatgtgtttttatgggggatttgtcttatgcctttattaatattgtttttcttttttccctttctctgataaattcctttaacttttcctcaccttccgttcgacaatagccatggagggtaagcacatcgtgtctttgtgtgtctgtccagctctctctatcacacccggctctctgcatgtaactttggactggaaagcaggaagcccaagtgggagggcacttcggcctgctttgtcacctctcatgactgacagatgccaaaagcagtgtttatatatgcaaaagaatgagacatgtacatctttgcagtaaatgaattattcttgtgcttttctatctcatacccagacttttggaacaaccaagaattaatctgttccagattacttaggcaaaagcacccaagggttcagaaatgggaacttatatttagactgagcactggcatcaggttcatgattaaactatatgtactacaagttggtcttttttaaaaagtgtatatatatatatatatatatatatatatatatatatataccattttatgctggtgtaattctaaccagttggaatttttaaatactgctgaagatttcccaaaggccctcatgttattccaccatcagtactcaagttatcttagtaacatttgttgatgtctcttctgtgc

SEQ ID NO: 131947 - DNA, 1072 bp, Homo sapiens
ctgttgcttttgcatccaaggatggcctgccctcattattttagtaaatgtgaaattccaaagaaacagtttcttgttttctagtatatatttgcactagctctctaatgcagccataacaaatgtcctttcttgagattttagctgagagtccatttccttgccttatcagcttctacagggcacctacatgccttggctcatggtccccttactccatgttctgaaaccagaagtttttattttctttttttttttgagacggagtctctctctgtcacccaggctggagtgcaatggcccgatctcggctcactgcaagctccgcctcccgggttcattctcctgccttagcctcccaattagctgggactacaggctactcctgaccttgtgatccgcctgcctcggcctcccaaagtgctaggattacaggctagagccaccgtgcctggcccagagccagcagtactaactctctctgacccttcttcagtggtcccattgtccctccctcctcttatgcttccctcttgcacttttaaggacccttgtaattacactggactcactcagatatcccagataccctcccatcccaaggtccttgacttataaccacatctgcaaagtctcttttgccacgtaaggaaacatattcacatgttcaagggattagaacatgggtatctttggggggccataattctgcctaccacaatattctctgtaattttagtttcctttgtgtgtgaagcagaactgtgcagatgttatagttgaacattaccttgcctccttactcattcacaggtttctggctaccctggttcacatggaatcacagccatggctggcagcatctatccaggtcaggcatctcttttggaccaaacagattcatggaatcatagacctcaggagatagcaatgtggcagcccaatgtggaggtaaatcgggtgtcttgggcttcagtttgttaacttataaagcatggcaaagctgggcatggtggcttacacttgtaatcctagcacttttgggaggctgaagtaggaggattgcttgagc

SEQ ID NO: 131948 - DNA, 1255 bp, Homo sapiens
gagggcacctgtctgttcattcagcaaggttgcactgaatgttcatctactctgcctggtactattctagggactgggaatatgaagacaaataaagtactcttttttctcatggaaggagctcacagggccctttgtcagtttggattactaccatttccataagtgaagaagccaaaaccctgacccagcacaagggtcagagcaatgggaagtacgtaggtggcctaaagaaagaaaccccacctctatgattgctgagagaccctgacctctggcagacaagcagatgggccccaggggaacagcccgagtctgtgcctggctggtatggaaagtgaactggccctgagtgggaattgaataccagcattgttttgagaaaacatgcagcacctgcttaatgagacaagctgttagcagagagacagttctctttgtgtcccagcaggcctggtctgcggcactgtcaagatttgaaactctagtacgtgtttgttagtggctgtctgtcaccagtgcagtggaagcccctgagagtggggacttgtctctaagggcttagaacggtgtgtaaaaatgagtaaatagagaattaagtaaaacattgatttttttcattgaactaatgtatgattaacctttcccaagcccaaattctcctctcttgtaaatgagaccaactatgagacatttcctgatgttacttcatttttagcctaaagtgatccttctacatggttactattatgtagaaaactgccttagaccattttaaacctccttgttgtgaaaattcctaaatgttttctggcaataatacatcccttttcaccagaaatcttgatagagcattttgcatttagtagcagtttttattattattttcattcaaataaactgtgagaactaactatatgtcttacttgaagattcattaatttcatattgtccatatgaaattttggtataaattaatgcctagagacctaataaatgcacaaaacctttgttgaaggatgtgttgatatttggaaatacggttttggctgtgctttatctcactaaaaaattaactgacaacacccaccatacaacactagcctaatgaggtgtggaaaccaatactgattctgttctctttctcttgattgagagaaggaaccatgtaaagaaacccatcttattttccctctgccttgaaatttttctctatgtccaactgaatgtcttctctctgccttagtcatcattg

SEQ ID NO: 131949 - DNA, 1049 bp, Homo sapiens
actggcctgattggttttcaactcctggcctcaaaggatccgcccaccccagcctcccaaagtgctgggattacaggcatgagctaccatgccctgcccaagatatactcttaagttttcttctaagaatcttagtttttaacttttacatttagacctgtacctgtaattcattttgagttaatttttgtgcatgtgggaggaagaggtcagacttcagtttttcacatgtagctatccagttgccacagcatcatttgttgaaaagactgttctttccctattgaaatgtcttagcatctttttatcattcttttcaagtaagctctattaggaaaatgtctttttcgattcataaagtacaggtttgtcaaaatcaaaaggttcattcatatgatgctctcttgattttacagcccagcagaccgggttatcccagtccgaggtccagcgaaggattttatcccagcccacagcacatggtacaaaccaatcattaccaggtatgccagtcattacagatataaactgtgttattttattatttagcgcttttggggtagagcggtacattgtgcatatttttatttatgtacttatgagtatgatttggccgatagaaagctgagaaagtggttaccctaatcattgaatgatgttgtcttgacaccccacgcagaaggcgtttgtttttcactccatcttcgagtgggcaggaccagggcctgctgccattcttaggcacgttttcatccacttgctgtggtaaagggcaaggtgaagccagtgggcacacacactgcagagggagtactgaactggacagtttttatggaaggcaagaacaaaattcaaaattaacagaacccagatgaaataccatatggacaagtgtgaaaagtgttagatttatagatagatatcctgtgcaaattagaaaaaattatccttcaaagaaaaggacttgacacaaagtaaacaattcatttgtttttgagaaaaagttattaacttttactggggtataccttacaatgcacaggtctttg

SEQ ID NO: 131950 - DNA, 1020 bp, Homo sapiens
atatttatagtttgggaaaatatgcttcagtttgacctccttgatactctgcacattctagtttgttactgtggattcttcagcagctgtaaagagaaaagttcagtactgtctccttgtgccctcctactccatctatggactagtcttcccattgtaaaaacagatattttttatgagttatttatattcttggttcctctgagcagcaaattatggtttctcagaaacgttttgacaggctattttgggtatgagaatgaagtagtgagattgaaggaacttgcttcccagttgtcattatgttctttgaggaacaactcggatgtttaattaaatatcaaagtgtctataatatgcaagtgatacttagcttacaagagaaattagattcatgtctgacaactgtagggagtttacaagctaaattccacaacatggcaatatgtgattaagggctgaaatgaaacattcaggcagtaaattcagtgggtcagagaataggggaagtgtgtgtaggtagaaatatcagggcagatggagcctgagagagtcttcttgtggcaagggactccacagggtccttttagagatgcttggggaaaacagtaagtagccttaagatcagagtggcccatttcacaaaacaatctgtgtgaaataacattgcctgatgagaacccatttaaaactgagttcccgttgccttgaagaatatgtcccacttagccttctcttagcttgcctttattttaattatttgaaggagtagaagaaaagacacttgttttccccaattttttttcttgatttttatggactttttacctgtttaaaactaaaacttttacaaactctgactgagggtgtggtgtttattttaagggtgaggcaatagagagcagggcactgtaaaaccactaaccagggatgtgcttctctctcaggccagctaggccttctttgctcctggtctctgactggtctcctgctcccagtgaccattcgcaggtcctttcc

SEQ ID NO: 131951 - DNA, 1030 bp, Homo sapiens
ctctgataccagttctatcaccccacctccctggcatctctttctacctcattgacttgccatctctccacctttaccatgaatattaaccaaatttctgttttcagcctcttattttctcccattttctctcattactcttcccaggatgtctgacccattcacatggctttgctgcttacctctgtctgtctatagttctggtcctgcccttttctcaagtcccaaacctacattttaaattgctggctgggcatcatgtttatccagaaagcaagctgttacattctcttctatgccagcccttcctcctcacttcctccaggttggaatagtgcctttatcttcggcaccatcttggagtcatgcttcactccttgtgcctgccccccaccctccatcccacgctcttttcccatctgtctggcatgaccagcttagtcaatcttcctgaaatgtcactggaaaaataactcccctggtcaaaacaactttcagtggggttttgtcaccttttatgtttgggtaaaggcttccacagtaacatttaggcctcatttcattatggcctgagattgtcttctcatccctttcacacacagtagctaaactaaccctcctgtcagcccagaatgcctccttcttcatttggggagatcttacccatctttctcggcttctttcacgcactgggtcttctgtgacttcacagctgactagccttcaccctctgagtctccaaagctctttgttcttcttgtcaggcttaccctatgctgctatagatggctgcaacccgtgttcaattcagttcgataaacactgttgagcacctacagtagctgagcctggtgctagtcactggggcaaagatgactaaaacacttttcctgccctcgaggagctcacagtctagtatgtctcatcccctactagactgaagctccttgaggacagggatggtcatactcacctcggtgttgcccaaacctccaggccagtagcctagctagctagatacaggaagagt

SEQ ID NO: 131952 - DNA, 1027 bp, Homo sapiens
taagacttatcctaggattttctttattggacctcaggtcagctgctctaattataaatagatgagaccaaagtggggcggattaaaattcagcattttttgaactactgcattaagccacgaagtaccactgtagctagtgggtgattttctaatagaggatttctagagaaaaaataaacctctgagaaaaattacagcatttttcttgataataatttaacatttcattatttacatcatgttaaatcgttaggttattttatactagagttaatataatgctgctttggtagataatttgcccattacctcccagctggtactcgagtgcctagaagaacaatgttcctggaacctgggagttacattcttcatactgagctcactgttgtgttttcattcccacttgacaggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcaggtaggagttggcgggagagagggcctgggggtgggggcagattatgctgcttctcctccttgcagtaatagcattttaaggtcattatatcagtatgtctaaggccgaactatttttcgttcaaatgcaattacttttaaaattgatttgcatttctttgtaccttgctagagtcttaagtaaattatatctttaaaattttaataaagctccaattatggtcaaatctctctcccctagcttctgacttagcatggcttacaagacccgtaataacttagtcccggctttcctcactaatctcatctaacacaaccctccatctctgtctccctcacactttgtgatccagcaatacctacttataattctcctaacacagctcactgcgttttcacatgctgtc

SEQ ID NO: 131953 - DNA, 1144 bp, Homo sapiens
ttcttttgattcatttgacagtaaatagcctgacatctactgtgcatcagcttctgggcacagcttctgtaagggtccacagttctaattgcccagctccttccatcactcttcctttttgttcccctttgctgtctcttctttcctcacagggggatattttgcttatttccttctttcttttctctctctccctttgccatctcattcgttcctttcatatgaatgacattaaacagtaaacacttggcccctccaacccggaagtatctaaaattctaccttgtctctttattctggagtccagcctccttcctgacctatctcaagacttggaagtttgatcctttgtcttctgtagcttctgcttttttgataatctcatttgttcctcctcacctgctgcaaggtcatcattctcctgctctatggttattgcagttccttctagctggtgtagaagtgtggctctcatttattctttgctacttatttaaactactttatccaaatttttaaattactcactatttttaacatgaatggcacttccctccactctactctccatttttcttggtgttattccttctacccagaataccttatcctgataccttcttcttccagttgaaatcctacctaaccctcaaggtccaccttaaatgtccttgaaggcttcttcctttctttacctttcctacactttctctctttgtcataccactcatgttgatcctgtgaatagacttgtggacatgttatctctgctacattagaaactactttggaggagatgccctgttaagattatgtaccttttttctcctataaataaaaataacttgatccagtatgtgttcttatttttttcttctgtttacttactgttgattcttaattatcatttaatgcccccatagataactaggtaaaggaaagaactttcaaatagaacaggatatggcatgacatgattagaaaaagctctgaagtccagttgatgtgtgttcaaatcccaaggccttgattattatctgtgtgatccacagagcaagtaacttatcctttcagagaaatttcatgtttcaaaacttctaagatgcctatttttttacatgttaacatttctggaactggagtg

SEQ ID NO: 131954 - DNA, 1044 bp, Homo sapiens
cagagcgagactctgtctcaaaaaaaaaaaaaaagaaaagaaaaactaagcatctaaaaaaataagctgcatcagcaaaatcatttacaagttttcagaaggcaacttttatttaatgatatctctttagtaatggcagtgttataggccccagttgtatatcactgtcagttaatgccgttggtagtatggttttatgaacagtaataaggattttcattattttagaatgtactttgccatcattcagaataatcattgtattaatgggtaaatatctggcaaaaagaatatatatgaagtaaattttgtgtgtgtgtatatatgagatttattatatatatcctataataaatatcatataatctgctcgcattgtatataagctgtctttcaaagtgcctattggtatgtctttatatatgagcttgtatgtttgtttttcttattttaagtcttattgtctcaaattcttctttatcagggacattgctgctcggaatgttctggtgtcctcaaatgattgtgtaaaattaggagactttggattatcccgatatatggaagatagtacttactacaaaggtaagaaatcagagtagtacctaagaaataggcttggaatctttaacgtatttctaaaaacagtatgttctaatatgctcacctgatctttgacagagatataaaatcaactaaatggaggaagcgacagccttctcagcaatggtgctggagcagttggacatccttaggcaaaaaatagacctcagtttaaacctctgaattccatttcagattaactcagaatggattatagactgcattacaaaataataaatttttagaaaaaaacacgagtaaatatttagcatctagggctaggccagggatccttagacttgacaccagaaacaaggattcataaaaggaaaaagttgataaactgaacctgataaaaattataaatttttgttctgccaaagaccctgttaaaaggatgaaaagagaagctacagagtagaagattcgtgccagccacac

SEQ ID NO: 131955 - DNA, 1039 bp, Homo sapiens
tgcacagtacttgacacctagagaacacctggtagatgtttgtcattctggtgtccttcattatatgtgcatcaaatgaatgccttctgttttccattgtaataaataccacccaacagtccaataaattaataattcatagagtaagccatgtggtgactacattaattaagtcttagtacatccttaatcctattcctgaaactttgacttaagtacaagagaaggcctggccaatgacttctgtcttgactagttcatttctgcatagcacctaggccaagaaaacagaccacatcagtcatcatcacccaacaccatatctgccttacctttgctggtattcttgtgcattttatattttcaaaaatgaaaattttaaaaattggttatcttttcctaaaattctgaacagttactatgttgtgattttgtaggactttggaattgtcattacaaaaatcagttatatagttttataggagtagtcaagtcggactaattgttttcttctctgagaggttactcagcagttatttcagggaaatgtgatagatgtagtgtatctaaacttctgtagggctttaccaggctatatataagagaaaaaatatggcctcgatcaggaattgttaaactttttctttaaagggccatatagtacatattttaggttctgcagactatgcagcccctgtcccaagtattcagctctgtcattgtacatccacagacaggacagaaaagaatgagcaagaatatgttccagtaaaactttatttacaaaagcagatggcagcccctgggccttagctttctgccccagatgggtaaataacaagggaaactattctatgtgttgatttttagttcagtttgggtagagtttcctagtggccacaagactctcttagccttgtgctgttttgtgtttctaataattacttctgaggaaatatgaaaggcttgataattatatgtgagaataacataaaaccaaaagttataataaatagttacttacagtaaattgaaagta

SEQ ID NO: 131956 - DNA, 1472 bp, Homo sapiens
acctgcaacccaaatataagtaattcctagacagctttgatacatccccagagattttatgtacaattcatccagctaaaaaaaaaaaagaaagaaatttacaggttttctcttgtgattgtatgaattaattgaaatgtatgcaacatgatattttccacaatgtgtgctagcctgatatatattagcctatttattttactccttcacaattattttagaggttggtatctctactgaggattttataaaatgagacagtccttgaaggactgctgtcaaaccaaaaagattggctgagagtatcagcacacaggaatcctaaatcctcaactgccaggtccctttcagagagccctcagaagaagcaaaacaatcagaggagttactgttgcttgatgatctgttatgtgtagggcacatctcaactttctgtcatgtctcctgtaatcctcataacagtgctacaaggcagatgatgttattttacccacgagggcacagctgaagcattgccaggtgaagtgactttccaaagctcaagcagttttccccaaatgggcttgtgtattttgtcacgtgtattgcagctctaccattcacttctgtgctgcctcacacagattaaatcctttgcctcagtttcttaggggtatagcgttcctttactgattgttgcagtgcattcattcttttggtttagcatgtgtttcttgagggaccttctctgtgctagacactgttttagctgctgaggacacagtgttgagcaagatacgtgaaggttccactctggtggctgttccattctagagaggtgggcatacagttcacaggaaacaaaattatatcaggttgttataggtaatgaggaaaatgagtcagggaacatgattaagaacagtgggatgggggcaaattagtctgaggagaggtctctgaataggtggctaaaaccagaattggctctaggccagcataagctttggtgcatggtaaagccctcagttggaggtcactgccactggtgttagcagcagctttatgcccttcttcattaaggcagtagacacctgtcacctgatagacttgggcttctgaacaggcttttaatgaactttgcagccatatgaagctgtggtgacaagtgcaaaacatctgcttcgtaacaccatgagctacgtgcagggttgtagagacttttcagcagtttggataacagggcagctggggaagggaagcagaggtgcagagtttgagtggctctcccaaaatcctgctgcagcagggccaattcatgtgctttactcctaaaggcacgtgctttatatgaaaggaagcagtgagggtgctagggctgttgtgtggaaagacagctttagttgcattcattttctgaggagagtatcacaaagttgagcgtgttaaactatggaatcaaaagagaaatgattgcaaatggccatttgtgt

SEQ ID NO: 131957 - DNA, 1344 bp, Homo sapiens
taattatcaaaatcaggaaatttaatactgaagaaatgctcttatccgcagtctaaattatttcataccagtaatgttccgtatcgctgttgcttcctgatctttcccttccccagcctccagtccagaattcatcctgcatcacacagtgcatccagttgtcaggcccatcttggcgagacagggtctccctctgtcgccaggctggagttcagaggctctgcttctgtggtccaggctctacctcctggctccagcagtcctcccaactcagcctcctcaatagctgggcccacgggtacgtgactccacacctggctaatttttgaatttttttgtagagacagggtcttgctatgttacacaggctggcaggcccatcttcttaactgagagaccagtttatgctttcctctagggccatcatatacaaagtccagaaatttagtgtgtgtaaaggtagcttttaagtcaagcaataagatgaaattgtcagtaaatgttactgggatcggccgggcgcggtggcttatgcctgtaatcacaacactttgggaggccagtgtgcgcagatcacctgaggtcaggaatttgagaccaacctagccaacatggtgaaaccctgactctactaaaaaaaaaaaaaatacaaaaattagctgggcttggtagcaggcgcctgtaatcccagctacgcgggaggctgaagcaggagaatcgcttgaacccggaggcagaggttgcagtgagccaagatcgtgccattgcactccagcttgggggagaagagcgagactttgtctcaaaaaaaaaaaaaaaaaatgttaataggatcaaagcataccgtttgaaaaatattactgaagtgtacatttctgttctcatttctgttgctaatatattgacaatgtcaataagattgttaccatcttgatgggcaaacagtcctgacccttgttcttgggtccatacttctgatctttctttatgataccccgtgagtatgcagttaaatgttgatgttacctgtgtctgtcatttgttaatgactgctgcatcttaaagggctacatccctgcatccctggctttgacttcactttcacacttgtccactattgccattaccatactgcagttgctgcttattttctcattttgctatatgcttctggagagctgagatgtgttttatcgatccagctttttgactctaaaatgagctttgagtacatgaatgagtgagcaaatgaatccgtaatgctagtagaggttttgcaacctgtgttttcaaagatcctcatcgccagtttttatgttaaggtaatttatgtaaagtatataa

SEQ ID NO: 131958 - DNA, 1091 bp, Homo sapiens
taaattttattaagtatttaggcttaatcaaaaggttttaatttttcctttaagttctatgggggagctaaagaataatcataatgttgagagcctgttgttaaacatttgcttcatatgttattgctaatctttacaagaacctgaaaatatgtggcattctggctattttacaagtatgaaaattaaagagaaataatttatgttaattttcttgtttatttcctaattttatagtgggcatgttgatctacaaaactaaaagaatcgaatagtaataccaaaagaacttatataattttatattctcagccaatttgctaggaactggggactaagatatgaatgttaaaatctaaacaatcagatacataggtaaacacacagttatagctgtgtggtaagtgctttcagagatatttacactttccaagacactgaagaagaacagtgagcctaagaggccactggaatagagagggtgaggcctgggctttgttctgtccctctccttcttctccatagccagtcccttactatttcctccagttccatgttctaaatggatccatctgcttcactgccttcccactgtgtctcccccgtgtttagctatctgggctacccaagtacacttctgtgttggggttccccaagatctaggagtcacaggactcagctatgatgtattacagcaaatggatacaaagcagaatcagcaaaggatgaaggtgcatggggtgaagtccagggaaaaccagatgcaagcttccaagggtcccttcccaatggaggccacaggacactctgaattccccagcaatggattgtgacgacctgtgtgaaatgttgcctactgagaaagctcattagagacttggtgcctagggtttttattgagggttctttttacatgcactctgtgcctggcatgcatccaaataccagactcccagaaggaaagcaagagttcagcataaaccacattttttgtacaaacattttaggcatagtgtaccatacctgtcaggggatggtggcaactctgcgaaaatccaagttcccagatagcaggcaagggacaatcatgt

SEQ ID NO: 131959 - DNA, 1855 bp, Homo sapiens
tatcttcctagcagaagtgctgaccatttcctgtgtgatcctcattcttccaacaagtattattgagaacctgcttggtgccaggcagtctagaggtttgagatacaataaggaacaaaacagaagtcctttgtctttatgtagcttatagttgagtgcacaaaataaatatggaatacatctgtgtcatacaacaataagtaccgagatgaaaagtagaacagtgtgagggtgggtgtactgagaagggcatgctcccatttagatgagtgttcagggaacatgattctaggggcttcttctcaggccttgcactagtaacatttcttttccacttaacatagtgtagtgatttgaactttttacttaatttattcataccttgacctgtacatataatttcctatacatatataaatgtgccaaaccgtgtctgacctgcttttttccaagtgtactctggtttccattcccactctgctcagctcctgcctctaccattcttttctcttcagccttctctgtaaccccccaccccctgcccatacttaacatgtaagtgatttagtaatcttctgtgtttttcctcatattcctgttttgttattcagaaaaggggtcatcatcaggcacactgtcctacttggttatttcactctgtgaacctggtagaaattttttcaagccccgcctttctttgccccttcctccctgggggccagatgggattctgtgaagggcaattactttgcttttagatttctgccccaagacaatgacataataaatactcctttatatataatctatgtactactgctttttctccttgtggaagagatttccaaggatggaactgcagggttcgtttcaaatagttgtaattttaaaagaagctgttggattgcttttcagaaaagctaggaaacttcatattgtcactggcagtgtgtgagagtactattttcgcactcattggatggcagttttaatagctcttttaatttttccattttaatagatacaaagttattcttgtaacttttttgctcacttagatgtaaagcaaggacctagtaactttaaacatattttcatgtcttgactgtttttcttctcacctctgtgaattaactgctcatatcatgtactttgcctattttaccaacacaattgtccttttaaattaataagtccctttacacatcaaggaaatcagtgtgttttcctgttaccttttttatgatttttttccccaaatctcttgttggctgttgactttaaacagaccggcctcccttgtcccacatcctaaggatgaccactgtcctgacttctgccatcactgattaaatctcattaaatgctgctgtgtcagctggatattcacagaggaaaacagaataaatttttgtgaaattttgtgaaagtgctttttttttgatattgtgtttcaggacttcttttatacccttcaataagatctcaatctttttcagataggtcttccatattaaaccaattcataagtattttatagttttgggccttatgttgaatgactttttggggtttttcttgccacttacaatttaaaatttatattgtgagcatagaagatattcttgattattgtttaacatacagtctgcaaccttattattgattgaacaggttttttattagaattttggattttataagtgtataataatgtaatcagcaaaagaataattttacctttccccacatacaattttttccttcagtcacaagaagctcaaagatcatgtttaataacagggcagtagacaatattcctattttgttttagattttaatttatcaattaaaa

SEQ ID NO: 131960 - DNA, 1013 bp, Homo sapiens
tttgcatgtatctctaatcatttctaaagaataatgtcctggaattttattttatggataagcattgtggtttttttaaagtttttgatttgtgctttccttcagaaagatatactgtttttttccctcctaacagtggaatgtgcaagtacctttatacctttggcctggtgttttctgagtcatgtgcacatatagtacaaacttctgtttaagaaataaaactctatatatgaactttacagttaaaaatggttaagatggtgaattttgtgttatatgcattttgccacaattaaaagaataaagctttgataaatacatttatagttatttgacaagtatactttttggcagtaatttgaatgtaggtgttagtaagtagttggtaggaaagaaatcttaccattattgttgtggtctttactcattgctgatttttacaagatgttttggtaattttgtcatgcaggccaaaacactaagaaaactgatccaacaaacatttagacaatttgccaaccttaatagagaagaaagtattctgaaattctttgagatcctgtctccagtctacagatttgataaggaatgcttcaagtgtgctcttggtgtaagtatgggaatatgggaaatagtgggctagtttgattttactttttcttgtctcttgctgtatatctaaatttctgatgaaaaaatgctaacttgtcccatttttttcaataaaatgatattttttcattttaccatgtgaaaaatagaaaaagaaaataattaatgtgagaataaaatcacctttttaaaaacagcatgcctagcttcatagttaggtttttaaaattttatccctgtgatttgttaattgttctctaagggctagtttacctatttagataatcatcccagagaaacccttggcatcaggcatgctggaataagcacagtgcactttgtgcaggcttaacacatcctgggtcaatgaagttataaatattttatcttatttggtt

SEQ ID NO: 131961 - DNA, 1379 bp, Homo sapiens
caagtttgtcatattaattgatttggtggtgttatttgttaatacgcttctttttatatttcagaaaagatgttggtttaaagcgattttttcctaagagtttactggattctgtcaaggtaattagagtctcctttatcataataaaataacaaaattatgccaagaccttttccccagtggtaaattgcttttgggaaagtaaaatgtagtttccttccttacatgtaaaatatataatttaaaaagctgacatttattctagtcacattaatggcaaataggtttttagtatagctttctcccataaaacatggttttacttcttaattgtgtttgatactctgctaagcataaaactaaaaaagttatgtgcacagttattcctgtcatctaggtcttcacaggctaaaatattttgacatgcagaagaaaaggagcaatatgtaaaataatcgtggtggtggaatcattaatattgtgtgtgtgtgtgtgtgtgtgtgtgtatgtgtgtgcgtgcatgttagtgcattttgaaggtctgtcttttgtttcaaccctttggatgcttccccgcattagtagctttggcagagcctcagttcttatccttcccatatccagcgtggagagcaccttggagtgaggtgggaggactctgaatgtgtgattcccccagctaatccagagcacacatcaagattttcaagcgcagcaggggatacaaactttagggttaaggcagagtctggctcagatgagctctgccattttctagcctcagggtcttgggcctggtttcttatttctacaatgaagaaaatagtattttgtagggttgatgtgaatatttaacagattagtaaatatattacttaccacagtacctgtcacatagcaacagtggatgttactgctcttactttttatttttcaaagatcttattctacatcccatcagctgaagcccaagcaggagaagatactcattatgagaaaatgtagctaactttggataagttatttcatcttttggtatttcagtttacacatccgtaaaatggggataaaatccatttctaacacgagattaataagaggattaaatcttagaaagaccaaaagagagagaactgtcgacgtcatgttgattatcattgggccggagtgttggtataatttatcagatgcaatctgtgacaaaagctctgtattcagatatctgggtcctgctctctgtcaaacccatccagaataggactgtaaggattagtcactgtttccctgagtccagaaagtaacagtatcccttcctctctcacatagcttcttgataatctaatgggaaaaatagatataaaggtgttggctttaaaaca

SEQ ID NO: 131962 - DNA, 1064 bp, Homo sapiens
aatgtgaattgtattctaccctatctgtatgtgaggccaagataggaaaatgaaatggtaactgaaagatagagtctatgtgagaaccagaggtatacaaaggaatgaagagagccagacatactgtcaaaaggatacagagttacaggaagagagatacttgaaagaaatttccatgaataatacattgacatatttttaacagccaaaacagttaaagaaagaaaagcaggttgtctgtcaaggtgaattagtgaatggtatgtttggagagaagaattttaagttcaagatctgtttgaaatgagagtcaaattttgcactgaagttagtgtaaatttggcttatttctggaaattacagaacttcagatgatcagagaagaggtgaatagaagaggacaacttagggctttaaccagtgttaaaggctttcaaaaccttacgcagtttttgtcaggggtcagtgaaatggagaacatgagaattgctatacataagggcttgtgattattattacttgaaacaggagagctagacacagcataagtttgtaaattagatccttcttagaggattgcatggaaagttgaatgatctattgttttgatatggctgtttcatcttagttaatttatatgtgtgatatttaaagtaagtaaatatgatagttaaaagaaagaggaatctttagtttattgtagttctaggatgctattgtgcttattttgctgtcccctctttctaaattcctgtgcttttgctccactgtagtgattcgttgcagttatacaacttgtgtgaattcagcaccctatctccatataagtagattagttgagtgacctcttgaagcagaatatctgggttcaagtccttatcgcaccttgactattctatttgccaaattttattagtaagctcttggtgtctgtttccaaacgtgtaaaatggggataatggtgatacctacctatatatgagattgtcgtaaggagttagatgagataatttatgtcaagagcttaatacctcttgtacccaacactgaataaatgtggacta

SEQ ID NO: 131963 - DNA, 1092 bp, Homo sapiens
tcagtgaaatactgaataaaatttgagtaaattatgaactattggtttggtgcaaaagtaattgcatttgttgctgttaatttttgtttattattcagatgcctctcccccagtttttatcacttaacaacacaaacattccttatatatacatataaatgtatgtcttccctgattttaggcgatcatactgggagatgcggggcaatgcactagaaaagaagtctaactatgaagtattagagtaagtattgtacttacaatctatacctgcaaatatgcagaactaaattcttagtttattttaaaattaaatactgattctgaaacactgctatttctaaaattttatatccagaagaggaaaaggacagaatccttgatgacattaattgtgttaataaacatttagatttgttgatagatgtcttaaagctaacattgtatatggcccattaacatacactttgtgtagatttaatcattgcaagatgatatttttttctaatttatattgaattctacagctgcctataaattgcttataaattattattcatgttctctgtataagttactacagattgttttgcacaaatagagatacggaagttactgctcatgtatcagaaaaatctagaataactagaaatttttccaataatgaaattaatgtgtgcatcagactgttatattagattgtattaaattaacccaacgtggagtttatgtcgtgggaggctagaaaccctatacttcatctttttcataattaattcagcaaaagataactgaacactgagtcctttgtagctaagtgccagagattcggaaataaaacaaaattttaacccccaggaagcattccactaaaaggaagactctcagacaagtaagcaaaattataacataatgtgctagaaactaaagtggaagtatcagctgggtgtttacaggagaatggtacttgatgtgtgaggtgttttcacatggagatgttatttaacctaagtcttaaagaatgagtgattcacaaagtgtagatatgtggggtttgttgcatgggagccaggaagccagtcaagaggataa

SEQ ID NO: 131964 - DNA, 1038 bp, Homo sapiens
ccatacatgctgcccacttaacaacatattctctcatggccctcatacctaggtaggtacagggcaagagtcagttctaacacttaacctgtccattgctccaggagaaatttcaccatctctagggaacattccctgatgacctcattcaaaggtgaccttctctgaactcaagggaacacatgttagaggcattagatttgggagtatttaagattgcttcataataatttttaaagagcaagtaataataaactgattaggcccgaattcaaagaacttttcatgtatttccagtgtcaccagaaacgtagccttaactgtgtgttcctgaatgtatgtttttttaaaaaaatgattatgaatgttgcagcctggtcttgaacagtatgatctccctgtttttgaaagtataacccctccttgggtctggaccttagaaagtagtaactgaaagatagctggtgtgctttgacaggttggggggtgatgacagtggaattgcagaaatgtgtttttaagtttacatgccttgttaataaagaaaggagagaatctctttatgttttcttttctaaaacttctccttgttcttgaaaatactatttcagaaacaaagattcctaagtaatttatttaacttgatattctcataccaaagatttctgataattgactaaaagaaatgaacattgcattactttttagcatatagttttttttttgttttgtttttgttttgttttggtttttttttttttttttttttttttcagtttataacagtcattcttgtggggggtatgttttagggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaac

SEQ ID NO: 131965 - DNA, 2787 bp, Homo sapiens
gcatcatgcatgtagtaggcacttcagatgttcatgaataaatgaatgaacagtttatgaaagaatgaacatggaggaaagagtcacatgacctatttcgaacagtggtgaaggtcatttgtttgaaagtactgtctaaaaggtaagtggctaaatggaaccaagcaaaataataaaaactttcagaaatgaacaaaagtatagcctcatctcactagtgagtaatcagggaaattaaaccatcataacaacagtaaaatacctgtggaagtttttttggtcattaaattgatcatcataagattaattttattcattaatgtgagataaatgatactctgtaacattatgcatcaagtataattggtatagttttgttgatggccaggaagtttggttgtgcttatcaaaatgtttcagttaaaggaaattttgtctgtttctatgcagtggtcataaatacctttgatgacagctagaaggatgttcatagcagtatttttatttacaccttcctttctccctcagaacaaggaaatctttattcatcagtagtaaaatgaccttgcacatttaatgttatgttcctgataagatacaggcatgatgtgaacactggcttttattttaaccttgaaaagaattcttttaccatgaatgtctactatgagaatttaatcagaaaagttgtgtatttctgacacttgggttatgagagacaggtttcagagtagccaattattgttttgtatttcataggaccagatagatgtgtcttcaaagtcacgatgagaaatttaaatttaattctggtacctttagtggcatattaaaaacccatgtcctattatccttttagagacagtcatttttattctaaatgtacgtgtgtgtgatatgaaaatggggcacttccatatggcagcactgtagggttggttgagtttacattcctcactaaatacgtagttctcagaattatttgttgagttatccagaccagatatttagttctcaaaattacttaagttactgagtatatgcatttagcaccacatatttaagcactttgtatatttataatgtttgccactatccagagaaatttataagggtgctagagaatgagcagtaggacagagtacgatatggatgcgtaatgagaaagcaaaaaatgaaacagaaggtaatatctgtgtgtttattgcttttcactgtttcatggagagtgaaagttgaaagctggtttgctcatgaggtactactgtatgcaaaggctgtgtcactcagatccacactttgaagtcactctgagtctcttcaggcagcatgatcaagtgaatggaataagattctctctcttacgtgaaactccaagacagaaacctgcctttccctaacagataccacagttctgggctaagcctctttgagactggtttgctgcaggtctcctatatgtgtgctgtgagttcagcagagatgaagtgactttttcatggggtcactacagaaggcaactggagaagctgggctttttcttaggatgtgaatggtgacaattatgagaaatgatttgtgttccttactgccttatattcaacatcaggttatggaaggttagtagaccaagtgacctgaggcagatggctagagaccactgtagacactgatcgcagctctaacaagagagagccgcctcttgaattggtagtagcagtgagctgtggagcaaggagacttactgacctgtggtttaccaaggataactggtgttggtgcgtactgggtgttgatctggcagagctggacagggaaccaggagcttttgtgggaatttcacagaggtgctagcttccatcctttatagttcatggatttgtgtgttggcaagaagctgcagaagtcacttctgagagaattgttaaaaggtgctccttcctttaggcaagttccccaccccagagcacaaggtttaaagactagaacgtggactcttttcaccctcagctggatatccttgtgtaggtagggtactgtcatttacagtggccctgtcaggaattctgggcttggatcaaaaagccaggaaggacattttatgcctctgtcagttccacataggagtctgtaggctgcaaacatccttcctgtcctgatgagaattcatcatctttatgaacctgtctttgactcttccagcctggtcctctgttgatgctttctctcttgataccatgtttactcctttcctttgtccctctctctgccacttcctgtgcttggtaaacaactttgtacctgggattgagttgtctgaaagagagattgactctaccacttcattcactcagtgccctgggaggtctgccacatgccaggtaccagtatggggagcacagcacagcagcacacatcctcagtgtgcatatactgggttttggacagtttttgtatatggtacatgttacgatttatctttgcttatggagaaggctggggataatatcctttatcatgatcagcagcattgtgctgtaataaagcaatacttgatgagtgcaggaacttttttgtatgtcttaacaagttgtattatagcttcaattaattgctaattttaaaaagcagtgattattttctttcatagacatttttcattttaatatcagcatcatttaaaaaaaaacttgtcttatcacctaaaagattgagaaggtcacagttggttgtaatttgcataccctcgtgtaaaggacagcaaatggttctgtcatgttcccaaat

SEQ ID NO: 131966 - DNA, 2073 bp, Homo sapiens
taagctatcttttaatgctctgtcctatgtctcaatagttttatttttttcttttaagacatctgtattctgtaatatggaagtttttaaggaataaagaggaattttaacttaaacagggttgtaggaaataagagtaacatgtattttcttattttaaaaattagttttctttactcactgtaaagattgtatattcaatttgaaactcggtattattgtaaggtgggcttaggaataccatacataaacaattttcttctttaatgttgttagggtttttgttcacataaaaatgtaaatataaaataatagcattttcattgtaacattcaagacagtatttgggaaacatatttagaagttaaaaatgctatgtaattggtgcttgactaaaagcaaatcagctgttttgcttagagtagtagaaatatttaagttaggaaataaagttcttaatgaagaatataataaatattttttgttattatttctaatatatttaaatgtcatgttactcccttaggaaagatttttaaaaggaggaagctgcactgttgtaaaaggctgcagttttatgagtagaggtatagactgattgattttagttttcagggtaaaaattttagtaccactgggtactaaaccaagttagcaccaaactacagtttcaccattaaaatcgcttttatttagttgttgctgacatctattgattctttcctaggcttttaaacatttacaaaacgtgatattagaactattttagtattcattttgttcacttgattatgtaattagatactcagagtaaatattttgctgagttaaatttacactcttggattttaaagggctttgggaatgggaactttttaaaattttagtttctgagcatcagaaatgtatagtataagtgagtgtgactaatagtgttcagagccaaagaattctatacttcttgaaaattttggtcttttcctggatttgctggggttcgtttgcatattgccacctccattgtatgataacattgtgttagcactgatgattaacactaaggctctgatttccttcacaaagcctaagctgtattcaagatctacacatccagtaccaacagaatattaaattatcagctactggatttctttttattcagtgtgactttaaaaccgtgaactttggaagaaaagagattatagtgtttttgctcaccccaaagtgattgatggaaacaacttatttttcaattaagtttgctggctgtcagagcaaatgagtacaactatttttaactgaaatatgcattatgatagaggttagggttgggtgagagggaacagagctcacacgtataaaagatgggaaaaggtagggatagtgttaagggtcagaatcagtttcatatgtagggctgcagcaagccatctcctcatatacatggttttgctttccagttgttcagaggaggttctgacaaaacctgggagctgtcatcctgttccttcctggtgctgcacacactgcttccattgtgattgcccagtgtgtaactatcttagtaaacttcctctctctcccctcatgttactcttgtaccaggacagggaggcaggaaaccttgttgttatgctggttaatttttatctgtgtgataaggacaaagatgttggtgtataggaattggctgaattggttatattcaagtataaaagttacaacttgtagataaagacacagtgaaaagctcaaatccaaagaatatacaaatctctatctgcagttagacattctaaaccacacatttgattttatcagtcacattaacctcaaaaagcacagcagtgtcccaatttaagaagacacataaaataccaggacaagctaaaaataatagagcagactatatttatataccttgaactgaaacctttaaggtacccttaaagccttctggggtgtttgaaccaagctcactgtgcggttgaatttggtgtaaagaatccaccttaggtcccatccaaggaagattatattttaaagtattaaaaaggactttgttttaacatg

SEQ ID NO: 131967 - DNA, 1831 bp, Homo sapiens
aactagccagtacttgcctcattttgcagctctttgaccttgggcaagttgcttggcctctctgaacttcattttcatcttctatgaaaatagggaagtagctgcttcactgagattgtgttatgggttaaatgcagttattttatatacagctatagttgcttgataaaaggtataggttattattagcagtatcacctgtatcctcttcagctcttctctgtggcatgagttggttcctaacatttccatagctgctgtttcaatctggtctctacttagtcaccttggtctctggcctggagaatttatgctctttcatatcttaacatcttcctatactctcaagatcttgcacattaggagatgatatttggatattgaaataaattatgaagtagttgcaggggtaggagagaaagcccccatctactggtcactttaaagtcacagaaaccaggttcatccctctccctcattctctccatcacttttcttgtttgtcctctcatcctctctgtcactgcgactgcattagctccagtcaccaccaccctgtgcttacaccactctctctcctgctcacctggtcctgtggcaggtgttcagtctgactaaaaaatccttcctgtggtagggtggtgtgctgtggtgtgaagaccctggcatcgtagatgaccgagtgggcttggtaactcctgtacctcttcctagtctatgaccctgtctttagtcttagtgctctcatttttaaaagaattgtaataccaagtttgtttaaaagatgtgaaaattagttgtaatcagtacttagtgtgtagaatataattgtaggttactaatgaaggtagcttttattttgtaacttttgagagccgtaagttccaagatggactcagtgtgcttggattatttgtacagtccattagtcgatggctcagattaaactccagtccgttctcacaggagtgtgtcagatatgcttgctggtggatgtgctcttatccttcccatcatgacagtggtcctttacagtcttggtctcttagtataatggtggaggctggggatattttttcatgtattctagttgatctagttgcttgtttcctctgttcttttcctagcttgctcatgtttttctggagcccctttcttcccagtgttccctggggtcagagttcatgctggtgaatgatatgttttcagtggagcatagaagaggtcacttgaactctggctactattaggagcctgaaagtaaacctagagacaaagccatcatcaagagtagcatgttagaaatgaaacaactgtcctggggcatcactggacacaaataagcctcttgttctcctcagcctttgttaagctattgttttcagaagttagtgacttcataaacaaagcctcggtcattttcactgttaagtaaaatacttgatttttgattggtttatacaaatgtactactaacaaaattacccacatttaggaaagctagaactgtagagtctcagtgtgtcttatgtacattcggagaacaaaggcaccaggagcctagttactaattatcttactgctaaagtggaatgtgttcagacagctaaatttttgagatgaccttgactgtctcacagtttgaatggaaaaactaagtagctctgcattttaaaaagttgctagtacagattgtaagggtgttttctgtctgtcttctttagtatgagtttattactcacttatgttttgaaacgaagaaaggaaatcatgcctcttggatacctcaatattccctaagctaatgttaaagaatgtggctacctcaaat

SEQ ID NO: 131968 - DNA, 1027 bp, Homo sapiens
tttgccgtcttctcattacttagaggtgataggagggtggtggaatatggcctacacttcagtaaggccctggagacaatatgtacagaacagacagaatttccttctgtcacggagcttgcattgtagtgggggtagccaaacaataaactgaatgttgaagtaaatcatgaggtgttttagaaggtataagtgctgtgggaataaaatgaagcagggagagcagatgggccatgcagtttcagacagggtggtctggataggccttgttgagtaggcgacatttgagcatagatgtggcaggggaaagggagcaagccatgtggataacgcgggggcaagagtgtcccacatagagggacaggcagtgcagagtccctgacgtgggcagggagtggcaaggaggtcagtgtggttgtgccaaggaaactaggggatccttggcgatagaggggagccatatcacgcacggccttacagactgtgctaagtatgtaggtgctgaatctgggaaagttggagaactgttgatgagttttaagcagaggagtaaaattgtgtgattgatgttttggaaggatcagtgcacaactcagaagggttgtgaatagagtgtagggcggtgagagctggagcagagagaccaggtaggaggcctatggctgtaatccaggcagcctgggccggggtgaggccaggagatgtggtgagaaatacatgtattctggttatatctggaaggtaaagataagagtttacttttcaagtaggatttaccagaattgctttaaaatatgccagtactaaaagaggttggtgtaaaggtcacagaacttttaaataagtggttggcttttatattagtatgtagaattcataaataagggaatatagaggactgcttacgctttttcacttatgttgccattaactgtagtctgtttctgttcttttcaagatgtcactggattaggaatttaaaagcatagtttgtctttaatatttagcaggaagaaaataataaaac

SEQ ID NO: 131969 - DNA, 1034 bp, Homo sapiens
cctgctataatatgctctggggccctgggacatttcatgggtgtaaagtagcttttttccttctgtttggttctatcgtttatggacagtttgtctaatagatataaaataaacatttatatgttgttgaaaagttgttcctatctccccctttctttaatgctctcatagttctaattagctatacacatttaacaattgtgataatacttttaacctctgattgacaacttacttaagatcatgtgtcacttgttaatgttgtaattgcagtgctgattcaaacttcaaaatggagttttttatgtcctccttttctgcataaacacagtaacagtctaatctctctaactccattttgatatctctttcttttccctacagaaaagaaaacatcttgctagagagagatcaatagagagttgttttcagaagtgaactttatatgcagaaaataggaataagtctataacaacagatggtcagaaaatttcatcactgtcatagcagaggcttagcagaatataacttgataaacactacttgtttaaaacttttgaggccgtttagcaggaacattggggaggtgttatttctcatgggtggtttagatctcttagagcgttctgggccattgtgaggtcttgtgcatttgttctgagtcagatgggaagccactggaggatcttgagcagaggcgtgacgtaaattttaagaaacttgttgggatggttgtgttctaaagttaaggaatcaaggatgatgtcaaggtattttcattagcagctaggagaatggagttgctaatttcaaaaaaaaaatttatttttttattttttagagacaaagtctccttatgttgctcaggatgctagagtgcagtggctattcacaggtgtgatcatggtatgctgacagcctcagactcctgtccttaagctgtcctcctgcctcagcctcctgagtagctgggactacaggcgcatgacactgaccccagtgctatttactgatttggggaaatctgtttcagg

SEQ ID NO: 131970 - DNA, 1018 bp, Homo sapiens
gtacatgcttggtatagatgcagtcattcatttttttcctcaaatattttagatccatggttggttgaatctggatgtggaacccgctgacgtggatggctgactgtattgtatgttaaactttatcatttgtgacttctctgttttaaatgacctgttgattttctgatttgggatataaaggtttagcttatttatgttattccccatatctcttcctgcattacttattgttaaatagttgatatgtgtatttttcttttagaagtcttctgttgtaattttaccaatatctttcctttgcttgggttattgattcatgtcaatatcttgattccttttaagataaagatagtattgccctaaatattgacccttccccccagttccagcatgtctccctgttctgcctcatattttgtttttgttatttcttttatgttgggatttttacatttgtattttatctgcaactacaagtgttctggggactgctcatgggttgaactctaaaactagtttattatttttaattttaagttttcttgagctttcccagcttagctttctttcaaggccagtttttctctttgttttctccggtatttgtttctttttcatgaaggtggtattccctgtatgtctgatgatcctttattgtctgtaagtgtatagggaagcaggactagctacttttcggagttagatttagcccctggtaggaattcagaactgaagtactttgcttcagcatgcttttagtctgtgggcccctaaataacaaaataaaggagagttttactgtaaggttgttaacacctataccagaaacctttgctttattttctagagaaatagccccttgggatttttaaaaaattattattattattattttttgtccgagggtaaatgctgagttagcctgggcacaactagtcagttaaaccctgttttcacccctggctattaacatcagccctccccaatacctcatggccaggcccaaagcctcatc

SEQ ID NO: 131971 - DNA, 1418 bp, Homo sapiens
catagtatatatagcgccaagtactgtccctagtttcaggcatctactgggggggactaggagcatatcccctgcagataagtgggaatagctgtatcttattctcatgggttctagattcagatattggtttagctaggtattatatttcctaactccttaattttaatcaaattatttaacctattgaaagtcaattttttttaatctgacaaaggggattattatagaatctcccttatggggttattgcgaagatgctgtgagatatgcgtaaggtgttcactcaaaattgttagcaatgattatttggtgccatttttctcattttaattagcagaaaacggagccctagagagattatattacttgtaatttgtcagtttgtaacttgtagatcttggtgcatgtttcacagtttagaaatcgtacaattgagggtaatcctactttgtcttgtttccaaagattgctctttcttctaagtctggtggtaaatggaggacagataggttcatagagtatttataaatctcttttgtgggcattttgtttatgttgttacagtacatatctcataaacttggacttcatggagtcagaattcatgataatttatagctgtattgaatttgactttcgcaagtgtttttggagtatgggcctaggattattttttaatttccacatgagtgtcagttcacatctttctttgttctcttttctcccccaaatctatttctaggtgttagtgaagggaaattatgtcatacagtttccatttctttgcaaggcctagaagtctgggtcctgtgtccccctgtccttcataggctaagggagaggagcctattctgtcccttgtgctgtgccagatgtgattgttacagtgtgagaaggtcacagcccctctatttgtgttcccctatttccttcccccgtccatattgtacctttcttcctataacagtgcattctgtttatttgggtgtgagtctgtgtgtgagggcagttttgttatttcatctctgcttaacccgcagttaacttgcactaaatgctgaattaggactgtttaacgcctgtcacaaaataagttctcttttcttagtagatctgagcaaaagaaagaataccaactgtaacttttcagcaacattagctgtaaaaatatttcctcttggtatagcacaagacagttccatagcagaaatacaaaacttacattcttagtgtaatgtgctgggaaacgaaagtctaaagagaggtgagatgacaaaccagctatttgtgacccaagagccatctcattggctcattggaacttaaaaaaaaaaatttttttttttttaatttttctttgcagatagagtcttgctccatcacccaggctggagtgcagtggtatgatcatagct

SEQ ID NO: 131972 - DNA, 1031 bp, Homo sapiens
tacgggtttgaagacaggccttttccaaatttgttattcttcattcaaggtccagtacagtaagtatggtaagcagtgaagaagctaactgtaaggtggacagtacaataaagccttgaaaaaaactagtgaaataatggtggttatatatatatatagtctttcaggttctctctgactgcaatggaaagaggaaagagaaattagaagtatttttttaaattgtcatttgatttcttcagagttattgtgggcttctgaactgtgagtataattctcttgctatacttgtgtcttgagatttttggttttgttttttctttcacctgtcttagtgtctctttgatgtacaatagaaataaacaaaaggtagttgattttgcagagtgggtgagggaagaaatataaattgtttagtgcctattatgtgtagatactttatatatttttttctgagacaggtagtataataatggttaataacgtgcttagaatactgtctggtacattataaacactctgagttacaattactaattgaatcctcacaataactttataagcaaggtttactgttcttccctatttcacatttgcataaaccaaaatacagagaggttaaaggatactaagttacggccggacacagtggctcatgcttgtaatcccagcactttgggaggccgagacaggaggattgcttgagttcaggagtttgagaccaagtggctgggtgcggtggctcatgcctgtaatcacagcactttgtggggttgaggcaggcagatcacttgaggtcaggagttcgagaccagcctggccaacatggcaaaaccccatctctgctaaacagacaaaaattagccagacgtgatgttgcatccagctgttgtaatcccagctactcgggaggctgaggcaggagaattccttgaacctccacaggaggaggtggaggttacagtgagccgagatcgtgccactgcactccagcctgggtgacagagcaagaccctgtttcaaaaaaaaaa

SEQ ID NO: 131973 - DNA, 1049 bp, Homo sapiens
ctgatataaattttttacatcctagggcagcaagaacagatttagatggtaggaggatgactggactagaggcacaagatcagtaaggaaggtagtaatccacattagaaggggaaaagtcacccaacctttgtcattaaggaaatggctcacctgctgttatttagtaaagtgagagggataaagttcagaggtcgaatttagtaacatacagtctatttaataatagactgtatgttcttttaattatgttgtacatataaatgaaggacttaagggcacaactgaggaaatggagagtagggattgatgtgaagcctgtttctgagttcatctacaggcgtgactaagtaagtgaaatggcaaggctgagagagaaggaatccagcgtaattccaggatggcttccagattttttctttggtgatgagttcatgaagatctttttgctcttaattttttttttcctggaatatcttagtgattgctttgatgagggaacattgtctcttaggtccatgaacccctgaaattctaagcagaattgtgtgtgtatgtgagctgtttttccctggggagagaattctagagctttcatcacattatcagaaaggagtccaaccaaaaggaggaatcactttttgttagattgtacacatctggtgtactctaaaggtttgtgttggcaagggaaacatcatcccaatcacaggatttttactttaaatgtaatgcatctcaaactgccaagtaaaatgcaaacacatgcaactgttttctaagttgaactgtatcaaccagcaattggaatgtttttccctagtttctcctcctttccgaaagacagaataagacacatttttggtacataaaaagcgagctggagactgacgggcatggaatgcttcaacatgctatgaacattagagaaagctaaagtttgtagagtattaacgtatcttagtattcatgtggctatgagagatggtgtcacttttaggtaggatacaccagtaccataaatgagtgtagtttcctcagttggatta

SEQ ID NO: 131974 - DNA, 1526 bp, Homo sapiens
gagggaggctcgcgacggcccgacctccgtcccccgggcgcggcctcgcgggcagccaagggtgggctccgagcggcctgccggtgcccgagccccaagcccgccgtgtccccgaacgcaaaccctcaagtttggtagagccccgtgggcttcttggcgggagccctggagccctcactgaagtcctcactggagtcattgtgcttcccaagttttctcctcttccccgcccccagcccccgactctgccgcggtggcttaggcgcaactgtttgccgaatttctctctgggttccttgtgtagcggcatcctgttctttcttagaagaaggggtgtgtgtgtgtgtgtgtgtgtgtgtgtgtgtgtgtgtgaattggtttcatttaattgcagaattttgtagctaaattcagtgagggtaaagtttctttttttttttttttccgagtcatttcaacagtgtctcattcttgcatagttagcctgcagctgggtttttggcaatgagactaagataatagtaatattgtagtaattatgggaactggttatacattcaagctgaaagctgaaggcagtgcaagagtttggggatttgtatttaagacttaaccatcgctaggatttttacttagaatgtaaacgttttcatggctggaaaaacagaccagtactatttgaaatgaaataccagagcctcaaccttaatattttatttgggaaacgggtaatgaaaatgatgtcttcgagagttgagcactccgtcccatatttgaaaacttatgagcagtgcgatgcaagcacacggatgaactagttacaagacacataaaagtaaactagcattcaacgtatttttgttggggtacagtatagataatattttcatccagttatactagccaattaattagaaaagccctatgatattcaaacaaggaacattttaaggatgtttgtgtcccaatatctttgtgttttgtatttgtggttatccttggtggggaaaaacaggctgaacctaccatcattttgaaccttcttgtttattaaactgcagaaacaacaagatcaatattacaaggttttcctttaaagaatttcaggtcactatcaaataatctagtttaataatgaacacaggcacagattatttaaaacacatgcttcctttataagggagccgacaatcacctaagacttcagtgtagacgctgattagaaggacccatacatcattcagtggtgatgcatcaagaagcaagtcattggttaaataaagacatggaaatcaaaactccatgtttacggtttggggcaaagaatactggggcaaactctgagaggagatgggacttaaaaagccttattatttgaggctggaagcccattgaaagtgaataatgttagattaggagtgaagttccatgaatccagcagtgaaattgtgaggaggcagtgaggatcattaaaacgttttatactaaaatgttttctgaaaagcaccatgcttcttgatggaaat

SEQ ID NO: 131975 - DNA, 1019 bp, Homo sapiens
cacagtagtgtcgagccggcagcagccacttctcataaccaccaggggtctgcgtcagcaccccattttacaggtgggaaaatgggggctccaagaagtgaagtgagcagcccgggctctggagccctcacagcctcacggccccgacccccacctccgtggctgactccccctgcacagggggcacccccaccccgccttccttcctgaatatgattgatcacccaggaacatgacagccatggaggaactgagaaaaggaaagaaagtcccagcccagccctcggcgccagtggttcctgggccacgtccacgtcgcagccgtgtgtggatgccacattggtcactgtgactgtgagggagtcacagggctgcttctggccaaaagccccttcatgtccctgtggctaccctcgctgtgtggttatttcaaaacattgaaataacttttttctcatattagaagttatatatactgtagttattacaaagccatttaaaaatcagaaaaaagaaaaagtcacccagaacctccctgccacctggcagcatgagtccttcccatcacaccttctcatttgcccatttccttattcgtttggcatgtatgtatcgggcacctgctgtgtgccaggcactggggggccctggggaacggcagtagcaaaacaaatccatacagagacggagggacctgggacctgaggtttcatctattcaccccattcaacaacgcgtcacagtgtggctgtctacactggtagtgtctgcgctcaacgcagtgtgcctccgggcacttcttccatgtgtcttatttgtccatgtgtctcatcaactctgtccaggcgcaaccccatatcctgtcaggagcagacacccagctgctagggcaagtctcaggcatggccacctgtgaggtcacagtccctctgtgggccccagtgccctatcctggggccttcccatctttgcctgtgcgaggagcaccgtttctcaagcccactcctgcctctgtggcc

SEQ ID NO: 131976 - DNA, 1048 bp, Homo sapiens
acaggtgtgagccatagcgcccagcctgaatggcctattcttttgatgtatttgtttgcataaagcgaataatttattaggaaaaaatgggatggtgtattacagacatgtgatattatctctgctcaaagaggcataattagtggggtcctaaatatgttgttttccttttgttctttgaagatgaaatatcttatgaacaatttttttttaatttcttaatattttacaaactcaatgagttgacagaaaagcagaatagtcccagccactccagaggctgaggtgggaggatcccttgagcctagaagtttgagaccagcctgggcaacatagcaagatcccggctctttaaaaaaaagaggcagaaaatatgattacatatgataaaactttatttcccctagatgaaataatttattctctccaagaaaacactgaacacattacgtactaagtatgccctgtaaggttattcattctatttatatattactttagatctgggagatcatgtgctaaaatcgcgagtttgtaacatgatctgaggaaaccgggtacaaagaggtgaagtgggccgggctcggtggctcacgcctgtaatcccagcactttgggaggccgaggtgggtggatcacctgagggccaacatggtgaaaccccatctctactaaaaatataaaaattagccaggcatggtggtgtgtacctgtagtcccagctactcgggaggctgaggcagaagaatcacttgaacctgggaggtggaggttgcagtgagccaagattgtgccactgcactccagcctgggccatagagcaagaccccgtctaaacaaacaaacagacaaacaaacacagaggtgaagtgacttgtccgggaaggctggcggccgagctggtcagcacttggagagtctggctgcccctctgggctccccaccctgaactcagtttcatgtgtgtggaccgcaactgacttttgtgtcttaatttgcataaggaactagtgggctggaggaaggtgagaacaggaacactgcctcc

SEQ ID NO: 131977 - DNA, 1033 bp, Homo sapiens
ctctacgcaggcaggggagaatccaggcactcactctcatgtttgtttttgtttttgtttttgagacggagtcttgctctgtcgcccaggctggagtgcagtggcgtgatctcggctcactgcaacctccacctcccgggttcaagcgattctcctgcctcagcctcctgagtagccgggattacaggcacataccaccacacccggctaatttttttatatttttagtagagacggggtttcaccatgttggccaggctggtctcgaactcctgacctcaggtgatccgcccgcctcagcctcccgaagtgctgagattacaggcgtgagccaccacgcctggccaactctgatgtttcgtacatttcagtccagttgtttatttaactttttgaacatgcacacgcttaaatttttcattcgagaacgtgactaatgagaattgctgcctatgttttgacggcatggtttgttttgttttttacctcggagcagttttgtgcaatgcctgcccctctctccctcttccgtaaacccagggcctgacacctaagctctgaaacagttccccattctctgccaagcccaaggccagcctggctccctgtggctttgtgctttcttcggataattcaccagttcttataagctttacgttagaatcgttgtggggttcacagagggtctttggtccttcatattctccagaatacgaatacgtcctcctcgtcaccgtgacccttgctagaccatgacagccgagcatgatttaactgcagccacaccggaagtgcactctacagacacacccgctgtgccctgggttgaaatgcccctcacggtaacctgacgctcatgatttataaatggggccgcctgtgtgtctcatgcatttaaattgcttcacctgcatgaagaaggggggtggcatttgagcagtcagtgccgttccctgctggtttcatatcacctggttttcagtactgctgctgctgtgggtcgggggcttcggagtgtgacaaccttggacaa

SEQ ID NO: 131978 - DNA, 1050 bp, Homo sapiens
gagttgtttggaatctaggagcagccagctaatgcccgtgtgtgtgaggtggcccttgatggcagtttcctaaagcaattcagcctgcaccatccttagcccaggcagtgtgctatcttcttcagaagttagtggtgacactgcctgcgatgctgctggcagacagtgctgctgcccctgggaggcccctcccttccccctgcccttgactcctgggcctaaggctggtctggggttgggacacgctgagggtctgtgagtcccatctagctctaagagtccagcctcctctgagcggcaggttgggagttgtctgccatcaggtgactttggtgtgcttatgatgctgagaccagattttggggtctcctgggagtccctgatgctctgggattctgctggctgccccccgggtcagccctgggggaggcaagcagtaaagggggctctgggaaccctggacagaagacgtgatggagcggaaggcccattgttcgttgagtgatgaattaacactttcctttatgatgatgattcaagtcctgtttctggtttctctttcatttccattatttgctcaagtgacagagatttcctgtccctcctcgaaacggtggtggtggaggtagcagcagccagcaacccaatgttggctcctcttggagaatccaaaaatcgaccatgttccaagtgtgtagccttacttatctcagcagataccagcatctcctttcttctggaaacgtgtgcagagttgacacatatgatgtgcttagaacagagcctgtaattgttagctgttattactgtcattatctttttctccacttgggttcgtagtcagcagccttggtggtaacttgtcgagggcctgcctcacacttactgtggaaaagtcactcagtggggcagtttgcacctcattcattgcaccccactctagcccagcctccacctccacaccgccccccccccccacccacgtcttcttgctgaatgcgcagggatgtcctcatttccaaactcagaggttttctgggccctggtgct

SEQ ID NO: 131979 - DNA, 1020 bp, Homo sapiens
ccttccccaggattcactttcgtatgagaaaatgtttttctagaaagtaggtttggttatttgcacagacgtacccagagtgagtggcagagagctgtgtgatcttgggtcgggccctcggggcacacggcttgctcgggggtcgggcggcggtccacagggccatctggtggccgtcccctgactctctggccgggttgttttcctcttttgcagatcatccagtcactcgatggggattaccagcggaccacctgtttgtatcaccttcccacctctctgtagcaagaaaaatcacttcagcacctcttcagtaataatgatgaaactggtattaactgaatggcaattatggatttttaactctaattcacagtaaaccagcaagccatatgtttaaaatccaaccaaaaatcgttctgtgttgctgcatgtctcataccgttgtgagaagttgtgagatagccacttgtgcaaagaggaatgtaagtgttacctgcccgaggaacacagcagaagcagaaagagaagacgtcttaatttatcattacagatatatgaaagcattatttatatagatagaatatatagataaatacatatatttttggtggtaatgaaaatggctccgcagaatgccgacccggaatctatgcaagttcaagagttatccgtgcccctgccggacccgcagaaagccggaggcgcagaggccgagaactgcgagaccatcagcgaggggtccatagaccgaatccccatgcgcctgtgggtgatgcacggggcggtgatgtttggcagggagttctgttacgccatggaaaccgctctggtcacaccaatactgttgcagattggtaagtctcctccccgtctgtgcgcagtgaacgctgagcggagtgctagcggactgggcgtggctctgatcctctggaggcagaggatggtgcgtcctggagagccccgggcactggagtctttgtctcctctcccttcagcctgccctgatggtggttttcg

SEQ ID NO: 131980 - DNA, 1019 bp, Homo sapiens
cacctcgaggtttctggtctcctctggggagaaagagaggaggagctaattaagaccacctttggttcggtggaaagtaatgagaaatatttttgttgaaaccagttgttggaaaaattctcagtaaggtattggcccatagacctaccttaatataaactgtgaacaccatttaggtgtgtttttaggggctctaacacttcagttgaaccgaaccccatgtctggagacctaactccagaagtcctgaacttggggtgttccacatccccgatcttatcttacctgaggagagattgacctcatttcctaaaacatttccaaggtggcatttccagttagcttattgctgctttattgtatgtgtttgcccaggtggggaatttgtcaccaagctgggtttgtcactggaggcagggtggtggaaagccgagggttggggtgatagggttccgtagaccctgggaaagctgcgtgtgggttgggagtctccgaacccctaggtactatagtcagagtttggcacatgcgtacatttttttctggagaaaaggtctataatttcattttattcccaagaggttttataacctaaaggccaataccacaggagtccaggtgcctttgggtagacttcgaactccccccggacagagaatcatgctatgctcattccacccagcctcctacttttcatttttcttttctttttgttttttttgtttgtttgtttttgtttttgttttttgagacagggtctcactctgttgcccaggctggagtgcagtggtgcgatctcagcttactgcaacttccacctcccgggttcaagtgattctcctgcctcaccctcctgagtagctggtattacaggcgcccgccaccatgcctggctaatttttgtatttttagtagagatgggctttcgccatgttgcccaagcaggtcttgaactcctaatctcaggtgatccacctgcttcagccccccaatgtgctgggattacagacttaagccac

SEQ ID NO: 131981 - DNA, 1024 bp, Homo sapiens
gcttcagtgtctggtcttgtcggtggactcggaatggaataatcaaggggtgaagcatttttaaagaaagccgttttcctatttagtaataaccctagaacagagtgtctccctctggtgctgttgacgttctgggccagggccttctctgctggaggctgttctgtgcactgtggtgagttgaaaggcatccctggcctccgcctataagatgccagtactgtcccctcctccccctgttgtcgcaagcagagatgtctcacgtcattgccaagtgtccctggagggtgcagagttgcccctggctgagaatcactaccttagaataattcatatattacttattacagacatttattgcctaactctcagctcttactggaacgactcttaggaacagagacggcttcacttcaggcacaagtctccgaggacactgtaatgggacaaagagccgattgagcaggcatgaagggtctgatgtttataattaagtcattaggatttcttagaaaactaattgcttttgttcctgcccaaaacccagctgatgttttcagtctttgcagacatgtctgggtgttacttcttctcacaaaaatgactcttcttacctggtggaagaaagcagttaaaatcattgaccctattctggtacaagattgacagactgaaaacagggaaaatcgtgaaattttctgttaggaatgattccgaaaaggtgggggcggaacaagaatagcagaatgttggtccttattaaacctgggtggtttcttacactattctgtttactttgcatatgttagaaatagttctggctgggtgtggtgccccacgcttgtaatcccagcactttgggaggccgaagcaggtggatcatgaggtcaggagatcaagaccatcctggccaacatggtgaaaccctgtgtctactaaaaatacaaaagttagctgggcgtggtggcatgtgcctgtaatcccagctactcaggaggctgaggcgggagaatcgcttgaagct

SEQ ID NO: 131982 - DNA, 1031 bp, Homo sapiens
caacaaaagaattagattataaactgaaaatataagaatgaatagccttaattagatgggaaggaacacaggggcctttccagcatgatagacgggttctgtcttgataggaatttgttgaaactgtctgggtagtaccttctcactgcatgtaaattatagctgacttcataaacaacacttaacagctgtcatgatctagccagttagaaaacataagggcagaggaaatcctatttgcagtgaccatgacaaaggttaattaggagaaaacaatgtggaagaccatggaaggactgcttttaagttctccccgaaggcgtcagggtggacttggacaggtgcaggagcgctgttgttcttggagagaacgactcagcagcctgaggatattggctccccccaggctagtttataacattaatggaatctcaataaaaataccaacaaagacttttttcccagagcgaatcaaaagttcacgtgctcataaagttcttggcaataaacatgagagaattattaggacagcactgatggggaataagcagcaacatcaggaccctcccctcccccagcagaggtcgagatgtcccggcagcctctctgcctcccgcggctaggtagacaggcacatgggtgggacagattgcagccttgagaaacggagacaagtgcacgccgacatttggtgtgtgataaaagagcagtctcagggctggcggtggactctcagatcaatcatactgcaacacccagagggccaccgggagatgcaaagtggctcctgactcacaccacactcgagcatatggatccaaggcctcacacggacccacatagttttccactgggagctgtcatctgggttgaacattcagtagcctgttacatggatttcctgaccgggacatgctcttgcgttcttaaacgtatcagaatttgctggtacctttcccatgggctgtggacccaggaacctgtccttcagccttggccctttaactgaagaaatactcagactggttctt

SEQ ID NO: 131983 - DNA, 1036 bp, Homo sapiens
gctgttagtgttcctctccgtggccatctggagaggcaggaagacacgtgccggccgtgactgggggaactgcattggtaaagattgaacggggccgtccgaggctgatggtggtggtgggtttgtctgactgtgggtgcccctactcatgcctgtttctgggtggtgggtgcagaaaacacacagccgttctcatgagccggccctcatcagcatgtgccgcccacaagcggtgtctgcagcccatggtgtcaggcccatgcgtgcgtgtacatgcgcttcgtgtgtaggggctgtgaaaggggcagcacacgtttgtggtcaccgtgcggacgcgtgttgtccggactcgctagaccgcttcccaggaagcatggctcacggaattctcctgtcgctgttgaacgctgggactgtgctgtagatctgaaagtttcacccaagcttgaggtgtgtgtcagcagcaactctccagttacctttttggtgaaatttaagtttacagccagcttttccactcagcaaattgtaggaagtcatgtgttttggcatcagttacccttaaattagaaacaggacaatagaggaagttgttgattggaacaattgtagtttcgcttgtctgagtgcatctgcgaatcataacaaaattgttgtcaccgaatgccccgacagtcgctggaacagattccaaagggaagcttgcttttccatgctggggaaaatctgcccgaaaagtttcactgttcttttgaatatgagatactagaacaggtcacagcttaacttttgagcttctccgcattttaagcagctgaggcgacagcagctctcaggggtacaggattgcctgtgctggggaaggaggagcgtgacctcccttaaatgggttcagtgtgacgtcatgcctcagtagggagttttcagctgtgtactagagaagaatcattttccttttttcagataatgctctcgtgcttatataaaatagtttccttacagaaaacaatttgcttgctctaagaaagtgacctca

SEQ ID NO: 131984 - DNA, 1009 bp, Homo sapiens
cctcgttgtgggtggggtgcagggagagtttatagtccgggctgggccctccttggctttgtgaccttccagaagccacccagtgctcggagcttctgcttccgtgtggtaaccagggtgtgtgaggggtttctgtctccagcactcagtaagcgcctgagaaggggtcacagcagcactcacgctgctagacagtgcggcatctgcatccgtgccgggcgcccagctgggacctctggagcagcgcctggtgggggcactggtgagggagaggagccaccggatacggccggcctagtgcagttgtgggccactgggtcgcactgctcatcagctccccccaccccccactgaaaagtgccgtttgtcttctgcgtggagaaatgcagcagtgccctccatgccttggattcgactttgaggcacctttgcggtcactccccatgccaggtagctgctgctggagggggctctgtggccagccctgctgttggcccacgcagcatgctagttcccacacccctcctccctggccaagagcttggaaggaaggactcctggctgccacaggtatgggcagctgtgcccagctggcactgccctctgggttggctccctggctcctgcggaggtcagggaggaggtgctgccgctccaatttgtttccttgtttctttcgggttggccacttggcttgctgggttgagcctttggtgcccaattttgccctcttgttgggcactgtcactaggctcagactgtgagctagcaggggactgggcctgctgtggtatgttccattctggagatggtccccaggtggctgctcagtgccaggctcaaggcaggtgcctgagaagacagccatctggccagggtgatggggcaggcctgggaaccccgaggagggcatctgacccatggctgggtgcggaaaacgtctgagcaggtagtccttgaaagaaacagaatgttcttcttaaaaacttcttactgtggttgttttgag

SEQ ID NO: 131985 - DNA, 1012 bp, Homo sapiens
tgtttgcccggagcccccacacactgtcgtctccagctgtgcctgtccctccccaccttccactctgtgtctcttccctgccccccttgtgccccagccccagccccccctgttctttcctgccacccaatcctgtgccccacgacaaggaggctgagcccagggatggccaggaaggaacccccggcaggctctcagggtgggagagaggttgtggggatcaggggctttgcagaagggacagggaggcagcccagagcaccccagcttcttggccagcagcaggtaacctggctggagggcggggcccccatgggccatccctgggccagctgcccagggctaccaggaaggcagcttgttttgtaggaggtcaggcagcgccctaaccccacctcttgtcttccctgatgtcacaccccagggtcagccccttgggccagaatgggggtgatggtgggaaccgggaagctgagagaacagggaggaggccgggtggggcacaccaggctgtggctgtggggatggggagattcctcgcctgggcaggccgggcagcagcggggcagtcctggggggtgtggtaaatgcttctgctctcttcccctgactacatgggagcctccgtcccacctcacctggaaaaggggcttggaactgggctgctcggccttgggcacaccaaacggggcccttggagccctgggcttcctggggtggctgggtccccaccctgcctctgatccatcctgagtctgcatttcttctccaggtgccccctgcccttggcctcccaccacggcctgggagtagatagtgggctggggcaggcccagcgctgtcctctgtgggaaaggaggactctgggcctggaaatagttgagtgtggacagaaataaccctgactggcctcaaaacagaacatggaaaattaaatagggaacattagcattcaccccgcgcttgccacagccactgtcccatttgggaggcgggcgcgcttatcctcatt

SEQ ID NO: 131986 - DNA, 1047 bp, Homo sapiens
gagggtcacggccacgtggtagaccacgaggctcgtgtggtgtggcatgtcgggccacagcgccacggccacttggcgggcgtggaagggcgtgaagcagacgagaaagatgatgagcaccgtgagcaggagctgcatggcccgcacgcggcgctggcgaccctggtggagcagacccggccgcgacagtgcacacatgatgcggccggtaaacacgctgatgaccagcaggggcagcaggaactccaggacagtcagcgcaaagacacggcagcagggccggctgcctgtcacgcccagcaccgacagggtgacggcaccggcggccagccacacgaaggcgcacacggccctggcacaggcaggctggcggcagcggcgggagccttcgggccgcacgatggccaggtagcggtccacgcagatgcaggtgaggaagaggatggagcagtgcatgttgaggaagtaaccgaggacgtgcgggaaggcacagcgcaggcagcccctggcgccgtagtacacagcgaagcgcgtgggcagggacagccctaccagtagatcggtcaccaccaggttgatggtgtagatgactgagggtgtcttggcccgggtgcggcagcagaagacgtacagcgccagcccgttgagcaccagccctgccaggaagatggctccgtgcaccgccatcagcgccagccacaggcctgggaaggtgccatgcagctcctcgtccagccgggcaaacaggtggaacaggggcacctccagcccgctggcattggtccgcactgttgtcactgcggtggcattggggactgccccggccgagggccccgctggagacacagagggcatgacggcagccagcacaccccaggcctggaagcaaggagaccaggtcaccccaggcgccagcctggccttaagccctgccctgaggcccagaactcagctggcccgtctgcccctgcacgcccagcatcccccttctccatgccctcgcctggctggggcctcaaatgcctgctcccttggctctacccagag

SEQ ID NO: 131987 - DNA, 1009 bp, Homo sapiens
tggatggggccctgtgtggaccagcccgctcacacgtggggagaggccagggccaacacgtgtgctcagtgcaggacttctcagagcctttgtgaaactcacggtcctgggaacttccaaggggtgggagcgagcatcgagcatggaagctatttgaccctgtcccctccctgggggttcctgctccatccatcccaatggccacaccactagtccatgcccagagcactgatgggggctgctgcctccctgccctcacccacagcttgttgaatttctgctgggcacccggccatggaaggccagacccctgggcttggggtgctggcacctgcccagaggcctccagcggggcaccagggtcatgccggcctccgtccttggccggtgggtggggagggctatgtcctctcttccctgggctcctctcaaacccaccccaccaacctgggagttctctcttggctgcccagcagcctgtctgcctctgtcctgccacatgtgagaccaggcagcagagtggccccggccccagggcagcagatggcccagggtggctgttgagcctgcctgggggtctggctcaggaccctgtgtgctgtctgtggacgtgtggaggacgggcccagccttttccccacagaggggctctgagcacctgctaagggcgctttgcatccacacagcaatcccaggttttacagatgaggaaccggaggcccagaggggtgagtggtgtcctcacggttacccagcatggagctggtggggctgggaatcagacccaggtccactggcaggacccggcacaggccggagtggagcagagtgcgggctggggagcagaggggctggattaggcatctctggaccgggagtttgtgcacaaggggattctccgggccctgaggccgcatgtgtgaccacgggtctgtgtgtgcttgagcctgcaccccagacggcgtggccctcatggccttccagggctaaaatagccatgattcgggga

SEQ ID NO: 131988 - DNA, 1052 bp, Homo sapiens
ctcttgctgagactgcggctctaacggaaacaccagtgtctctgggaggggcatagccagttggaggtcctgcatgtcacctgccagcccctccctgcctccccatcattgggttcattgctcacctctagctgggtgtctctgggaggggcatggccagttggaggtcctgcgtgtcacccaccagcccctcctttcctccccatcaccgagttcattgctcacctctagctgggatagccgtagctgcagcagctcctgaaacccctccccaacctcagcctctccaggagctgctgggacaggcattctgtcatgtgcacctgcctggcctcagcctggtccttccgcctgaagctcctcagcctggtcctctcagcctcttccctctgcatgtgctgttccttctgcccggaatgctgtttctctccctgtgccacctggtgaaggctccgggcacccacagtcattgttccacagagctctccctgagcccctctgatgccctagtgccctggatgcccctgccccagggggagagctatgatcccacaatctgaagggcacccgctgggctcatccttcccagggtcttattgacttccctcaagatgcccctgggtgggtgtttctggccccactgtgcctgtggggaaccaatacagaggggctaagtcatgtgtccgggctcacccagctggggtgcaggaggggctgagctctgcctcaatctgcctgctggcactttgtcccagtgcctgggatcagccttctgcggcacccagccctgtgtgtggagggaatcagaggccccaggccacacagccccgtgcagtttggaggtgtcagaccaggacttagaccccagcactgcgggcacaaatgggtcccaggcagacctggccccacctttccgagctgacagctcagggtagggtgggaggtggctggtcacggccgggatgggcctcaggacaatcagagggaagagcgctcccggcagcaggaagggcacagtgagcatgaagggccagaggtgggaaggagagtct

SEQ ID NO: 131989 - DNA, 1056 bp, Homo sapiens
ctcctgcctcagcctcctgagtagctggaattacaggtgcccgctactatgcctggctaatttttgtatttttagtagagatagggtttcaccatgtttgccaggctggtctcgaactcctgacctcatgatctgcctgcctcggcctcccaaagtgctgggattacaggcgtgagccaccgtgcccggccggtcacagcattttaaggactctgccatgattctgatgtgctgccagggtggctgtgcctgagccggcctttggctcttgcgcacacactgagatgccggttcgagtggatacagggggtcagcccacttgtttcccacggccagcctccagttgggctcacattgagtaactgtctgagcccagtcccaggtagacatcgtcagtttccacgtgttccttcattcactcaggaacaaatgggctttactttatccgaggccttgtagataattattttttccctctgtaaaccaagtcctgcttaaatcccatccaaatccctccagccagagcccatgctgcctgcgagcctgctccccatctccggctgagcaggtttgtttaaggctgggctgacacttcttctccccgcgccttggtgtgtttacactggggccatcagcagaaactgcaggtgcggcagggaggctggagacagggcagggaccatgggggtttcagggcgtcctttccacacagtgtctcaggtcgccctgttcccagcctcgtcctcgttctcgttcccacaggcgaggccttggaggtcactcaggacaggggaagtgctgaggcgaggcctcaggctgctaagtggagtgagcccaggaaggctttttgagtgggggacgcccgaattggttttctgtgaagaccagggagcaaacgtgcctgccatggagtgaacggcaggacccgcagggaaaacctcaggcagcggcttgaaataccatggccgtccatggagggggctggtcagatgctggcggtgtgggcagaggaggctctgggccactgcctgagtgtgagtcctgccaccaccacct

SEQ ID NO: 131990 - DNA, 1055 bp, Homo sapiens
gctgagctttgagccggggtcactggctgagtctcgcaccctctctgagcctcaggttccccatttgtcagatggggaaggccaagacccagggtagatggagcctgagtcagtgctggcagcactggcgttgtgggctggcaaggcgtggggcacctctgtgtgcatggggtggacctgtgtgtgcctagcagcctccctgccacaaaccaccctcctcctgtatgccagggtcacaggagctgaagacagtggccgagccccgctttttctgccccctcttgattgtttcagggacgaggtctggttctttgtcaacccaagtgcccagcacaaggcttggcatatggtggtggcctgtaaaagccagtgatgtgactatgaaaccaatccactcatagcactgcacgtgctttttgggagggagctggctcagagaggaaaggccatcagcactggtccccccagtaggatctaggcaccatggggaacctgcgggcccctccagcccctccaccatgtgtcctgggggtagccctatccccctgggcctcagtggcgccgtgtgcactggctctgggggtgccaggctgcgtctcaccatcgggccagcccagaaatagctgtgaccttccgcagccagcttggcagcgcttggggccaagaggcctacgtgcatgccggctgagtcccctcaccgtgcagggctggctattttggacgtggcctcccgaggccaggtcagagctctttcccgcggttcctcaggcccctctgacgtgcgtccactagagcctcggccagtggccctggctagctccatgatctcgatcccccttcctgtccccgaccccacgggccctgggtggcacagaggaagggatcccagggactgagcacagggtgaccgcgcctgctggggctgacatggagtgtagggcttggctgttttaagaagaaaatgcagagaaagtgcccaccctgggtaggccctgaatcctgtctcagcctctcagagctctcgctgactgcacagcctgagcctcggtttactc

SEQ ID NO: 131991 - DNA, 1601 bp, Homo sapiens
cacctgggctcagatgttcacagtggctgagaatcggaagaggagagggcagctgtcctggggtggagtttccgcagatcacagcaggtgggcaggggccaggctcaggcttcttaggaactcggcctctgtccccacagagggatctgtcatctgtgtgctggggttcatcatgtcctcgggggtgtgtgtgtccctgaaatccctgtcccctctgtcctccgtcatgccctgctggctgtgtggtggctaccctgtcgcctctgggccctgggtcagtcctggcaggagccgtgcttccttgtgctcccatataaggaaatagacccaaaagggtcattctctcagcatggtcaggaggagggctctgggagaggtgtcgcctgtgactgtgggctcatgacaggcatgaaccccttgtgggaggcggggccccctgtgatccctttctattcatttccttcgtctttccccacagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgcaagaggggtccccagccccggctggccagacagggctcacagccttggaacaaagcccagtcgcctgttacaggatcctggaggaggg

SEQ ID NO: 131992 - DNA, 1082 bp, Homo sapiens
gggactgagcaagggtcagcgctgaccacaggagggagggaccactgtgccctggagaggcagcagagatacctgccgctggcaaccctggcagatgggacgagatgcgtttacagaagctttcttgggagtggagtctggagcgacctgcatggcctcctggaggagcctggcctctgcagaacgccctgctgtttgcaggcctggggccgtttgcagcgtctgcagttgtgtgcggggccgttgacagagcctctgactgtgccaggctgtgtgagaggctgcagctgtgtgcagggtcatttatggctgagtcctttcccctgtgacatgagataagccatcatggtcttgtcataatgaaacagatttgggcgtgagagggcattaagaactgtagagcagcaggaggcattgggcaccttgccatcagggagcctggaccctggacactgagccaggtgccctacagaagatggctgtccctctcgcagctgagacccctgagataacagcagcatctacagaaagattggcgagaacagcacggtgagtggccagggtgaggcctcagaatatgactgggatcagggttaagtctgtaaccaaggtcaggtctcagtgtgtgaccaaggttggggctcactgtttgaccaggatcagggctctgtgtgaccagggtcagggttcggtgtgtgtctgggatcagggctcaatgtgtgaccagggttgaggctcagtgtgtgtccaggatcagggctcagtatgtgaccaaggttgggactcagtgtgtgtccaggattagcgctcagtatgtgaccaaggttggggctcagtgtttgaccaggatcagggcttagtgtgtgaccagggccagggtttggtgtgtgtctgggatcagggctcagtatgtgaccagggtcgaagctcagtgtgtgtccaagatcagggttcagtgtgtgaccaggattgaggcttagtaggtgagcagggttagggagggctcatcctgtgaccagggttaacgcttagtgtctgaccaggatcagggctcagtgtgtgacccagatcaaggctcggta

SEQ ID NO: 131993 - DNA, 1003 bp, Homo sapiens
ttcggtaaatcgtgtgtatgttttttttttcttttttctctgtgatttctatggagctaatctcactaattctcaagtctcccggtctctgagtctgtggagggcatgctctgttcctgttgccatgcttttttgtttccccaagacagaatctctctctggtctcccaggatggagtgcaatggcgcaatcttggctcactgcaactctgcctcccgggttcaagcgattctcctgcatcaacctcctgagtagcggggatcacaagtgcccaccaccatgcccagctaattttttgtatttttagtagaccctgtctagtctcaaactcctgacctcaggtgatccaccctcctcggcctcctgaagtgctgggattacaggtgtgagccagcaagcccggccaccatgttttcaatctctggtgtttcctattgttttgttcttacagtttccatctcttggcttacactagtcatctgctctttcatgtggtctactttttccattggaaactttaacatattcattatagttattttaaattccccatctgataattctaacgtctgtgtcatatctgagtctggttctaatgactgtcacttcagtttgtatttttttcagtgctttgtcatgttttgtgggaagccttgcctagcgtattagataacaggaacagaggtaaacaggatttacactgatctggctaaggagctgggctaagtttcgtgtttgctgtaactacaggggccagaggctgggtggatattgctttcttttcttagtcttttctcctgtcagaccttataagaaaaagtattcagtcagcaaacatccactcactgtggccaggaagtgctcagtgcctggggactctgtggtgatgaccaagccatgtcctgtcaccatgcaccagggagaccctgggaggtgcattgggggctggaagtaaaaatgggtggagtggagtggaggaggtggcacaggttttacagtgcag

SEQ ID NO: 131994 - DNA, 1041 bp, Homo sapiens
cctgggtggaaaatggggtccccctgaaagcatggtcccctgttaatgacttgaactcaagcaaggcagcagggtggggttctgaagagcacagcaattggatgcccctttctcttgctccatctttgccagggctgctgcaagctgactgcccattggaaagcagggctcaccagtcacagaggagacctctgagtccttgtgatggcaggaggcctctgcctgactggcacctgcatcactgcacagcacatttagccctcgatgtgcaagccatgcttctgaggttagggtctcagggtggcactgctggccttctgggcagagcagtccttctgtgtgagggagtgtctagcacaccacgggaacacagcatgtcccatgtctattgctgtgtgacaaatgaccacacattcagcagcttaaagcaacacatgcctattataacagtttctggggctcaggaaggagtccatgtgcagcctagtgggggcctctgctcagggtctcacaaggttgcggccaagctactggctgggctatgttctcattcagaggctggactggggaaggatgcacttccgggcttgttcaggatgtgggcaggatttattcctgcacagtttctcctaaagctcagctgtaattttagaagatgcagatagctccttgccatgtgagctttcccacaaggctgcccacttcctcaggcccgggaggggtgggcaagttgagtgtcatagagggtaacatgagtgcagatgtgctatcatcacctttgctacatggtatgggagaagcaaatctccatttctgcctcacactcctggagagggcagtgtccccagggggagcaccatggcgcagggatcacagggtcttcttgaaacctgctccctcaaatgctggcagtgtccttagctactggaacacctgggagatgccctcagttgagagccacttgcccacaagcctgtctaaggcttgtccttcctctattccatcatcaccagagtccatctacgagcctcctcaactgga

SEQ ID NO: 131995 - DNA, 1043 bp, Homo sapiens
aaagcagtattcacatgtctgagagggctttgtgggatcatggagcaagtatgcttttggtcgtcactgaagccagaaatgggactggagggtgaggttcccaggagatggacctgctcactgtgaagaagcggcctctgggagtcagaggtgtttcacggtgaaatggctgctttgcaaggaagtgagctccccaaaccctgggaatgttcaatccagactcagtggggtccagagaactcaagaactggccagagactgccctgaatgcccgctaatgtccttttccatctgagactcacttctgtagacatgaagccgagcttaaggaggtgggtagatcagatggcatctcaaagtgccttccagctctaagtgcccagggccccaggctgcccttcagcattcctgtcttgctgttggctggtattttgacttaggaaatgggtggttaatgaaaaagagacacaggagcttcttgagacgtgactgagattactgtctgcccaaggaagacaactgctaattaccagctccagctggcagcccagggggaccatgctgaaggcagagagacagacggaggagaggacccggggaagggaggtgcttccagaaggcagcctgccctggagccttccagactctagccctggccatggggaggccctgagtgacggatggggaaccgaggccaccctccctgctgtgctgttcttgagcaggcctgggcgaggctatcaatagagctgttgggtccatctgatcaccagctccatgctgtccatacccttcagctgatcttggctgtcacctttgaccagcacatgtgtcgtccccacaccggggcttctgtccacttgcccagtcacccatctctgactcccatctgcatcaggaccttattcctgttgagctcttgtcaccatccctgcagacaggcagcagacggccaccatgattccatatccagtccctgccgggggccagtgccttgcgaggcaggccatgaaggctgtcccacttatgcttaggatagcaca

SEQ ID NO: 131996 - DNA, 1022 bp, Homo sapiens
tctctaggacccaggagccccaggaggctctgtctccggttcacccaaacctcagggtgccctagtcccctggggctcaccctgccctctttctgccctgaagctgccacacccacctgggaagcaacagggtgggagggatgggggcactcaggggacaaaactgtgtccagcacagcctgtgcaaggcagacgtctccctggctcaaagctggagctgagaacagtcccaggcaccagccctgcccagctccctccctctgtcctcctcctcctcccaagctgcaggtggcgcagtcagagctgggtggtgttggggctggaggcgggaggggcagctccccatgtggcctcaggcacctgcccaggttctctctgcttgggcttccggtcttcaagctctgctttcgcccagtgagcctgggctttggatgtctgtctgctcgtgctcatttcctctccttcctctccctctgtccctcccttcttccttcttctctcaaagctgtctgagtgtgtgtcaagcaccaggctgggatggtcagtgggaggagatgatggaatgtctagggcatggtggggacaggcccctagaccagtggcgtggccagggcagatggagtgcatgcaggctgcagctccaggaaggccgagctccccgcctcctctctgccgctctccctccatggctcccccagctcttccttcctccctctcttctcattcctccctgcagccctccctggggcactgccttggagctgggaggacagaccagatagctatagcctgtggaattcttgagcacggctggaggatcagcaagcagggatttgaatcctgtgtctggcaagactgcccgggagacctcctggctcacctcctgttgcccccagtttctgcagctgtgaaatgggaataatgactgtgctcatctcagggagctgctggggccccagcaatgacagcgatagtaacaacagcatgataacaaagccctgcagccctcagcccccggcccg

SEQ ID NO: 131997 - DNA, 1053 bp, Homo sapiens
tttctgggctctggctgtcccctcccccatctctgcctctgtccttgacccgggcgtcttccgtctgtgtgtttgtgtcgtctctgtctcatcatgacgcccgtcattggattcaaggccatcctgaattcaggataatctccagatccttctcttaactacatctgaaaagaccctttttctcaagaaggtcacattgacaggttccagggcttaggacatggccttgtcctttcggggacaccacgccagccactgcagtaaggagggagtgggtgaatagaagtgggcctggtgtgaaggtcatgagcatctgtgcctaccgaggcctggcatgagcctggggtcctctagataagaacacagtggaatgccgatggcgcctaaagctggcctccgtggatgggctccgtgggctcacagggccgagtgaggagatggcctccttctcctaaggggcttacgactggaacactgtgcccaagaccacccaaccagcaagagacccccaggccaggtgggcaggactcctaaccatgagggtttcccagtcacagctggtgcctctgtgcgttaataaaacccaggccccaatggggaggccccttcgtcggtggggtgtgtgggggctgagcatgcatgtgtatgtctgtgtgcgtgggtgtgtgtgcatggacaacacattagaattctaagaaaccaaagaagtcccagcctgagaaacagagtcccctggcagtgagctcagagaggccgagggtggctctgagtccccatgggcatcacggctcccagggtggctggggccctggcctctgggcagcacctgctagctgcctgccctttccttgctgctctcatcttcatcctcccaccccttctcatccatgtttctttgttctcctttatgtatcttcataagctgccttaaatcctttttgaacaaggcagggagtaaatagataaataaataaaaatccccttgctgcagatcgtaaaccatctttccgaggccctccgcttactccagaagacactgctcatcactcctct

SEQ ID NO: 131998 - DNA, 1069 bp, Homo sapiens
ccatggttaccactaccccttcaccatggtcagctcttcaccatggctaccagcaccaccatcaccatggttaccatcactttggttacctcttcatcaccattgttaccatcactccactactgctgtcaccgccatcaccatggttaccaccacccactgctgctctcaccacacccccccttggttcccaccaccacagttacagtagccatccccacccctgggtggggtcatgtccaactggtgctcaagacctactctccccaaccctgggtcttggaaggtggccttcccggcatgtgtcagtgagctaattccttggtggattctgcccataggaggcacctacaggagatgagggtgaaaggaaagtgggggtgggtatttgcccccagttccctctctgacacgctcagctgtgtccctctgtggaggccacagctcccatcagaaagccctctctatgcggccaccatctctaggcttcggtaggctctcccagccccagcccctcagcaggtgtctcccagctgctgctagcctcaggacacttcagcatctcttactgagcctccctacccagccctaccgctgtaaatagtctcccatggaaactctctgcgatgaccccgagaacctggatggggcacctgatgtcaccagtgagacattcccttcaccaggtgtccctgtcacccaagcaagcccatcagagtctcctgtgggactttctgctggagacttgaggggaggctgtctctcccaccggggctcccagttgaaggaggtgagtggccggcagccactccacactccgcaggaggacacgtgtgtaacataacacatgagagacaaggcacggtgaccactgcactctggatccagctgtgccccagcagccaatggcagggcgagacatggcctcttgctgtctgcaagtctgctttttcctgactggggcagtcattgcttaaggaagaagcgagaactggcaggatggatgccagaaagggcctgctttctctcccatggctttataggggtcctgctgctcgggcagagagtc

SEQ ID NO: 131999 - DNA, 1062 bp, Homo sapiens
ggagccggccactagcacacgtgaacacttcagttgacatggaaattaattcattttaaattcagtaacagaagagatggctgggaagctgggtttgtaccctggtgccatccttctcctcgtgagcctgctccggcccggggccttgtcttttgtcatttccttcaataccagctgcggccccgtgaggtgaggccttgtgtgagtcgccgctattgggctgtgtacacagtaacaccgcccgggcggcttacacagcagcaacatgcttctcagggccctggagccggcaagtccggcatcacggcactggcagggctggttcctcctggggcctctctccttggcgtgtggaccacgtcttctccctgaatcctcacacggtcgtctctgcatgtgtgtcctcatctcctgtccttatgaggaccgtggtcggattgggttaggcccctctgacccctgtatgacctcattttaacctaagtacctctgtaaagaccccagctccaaatgcagtcacattctgagggactggggaggaggctgcagccttggagtttgttgagcatggtgggcacagcctccccccagcagtcatgttgcccgttatgggtagagggtggtctcaggaagagaagtgaccagggctgctgagttaggaggcaggactggatgcaggtgcagtttccagtgaacgtgctgcctccctgaacccagaccccatgcttcaggcctcagtttccccacctacaacacaggtgcattattacctctttcacctgccagctttgggattcgatgaatgattcacccaatttctcaaaggtctttctccttcgctcccttgctcactcccttagtgtgcgtggagccgccctgatgtgcaggcatcgccctgggcacagggacccctggggcgagcagtgagggctcctgcccttttgggtttactgaccagcagacgcggcaaatgggccaacagtggctcaggagagtggacagtgccagacagcctcatcctcacagacacagggacacagcatgggtgagggcttcccagag

SEQ ID NO: 132000 - DNA, 1017 bp, Homo sapiens
ggtggacccagcatctgggcctctgcccctgccccccacccccggcgctccctccacgctctgacacatgggagacgcacagctccccaggcttccacatggattgatttggcggccccaggaatagatgtgtccatacattaggtgcatgtggaaacatggccccaataaccccagcccgcatgcctctgtctgaagcattctcgcaccatgggaattattttgctattttggggtatagatccttgcaggagctgagatgccatttccatcgtgggtgccacgatcatgaaaaggagaatcaatgacagggtgcgaggcgggatgagggaggggagccccagctgtgtctggtgccggagtcagcccccaggcttccagaaaggtccaggtgccgagggcacccagctggagtcagcccccaggcttctagaaggtccaggtgccaagggcacccagctgaagtcagccctgggcttccagaaaggtttggctgccaagggcacccagcctgcacctcctggcctctctgaatccgccagaggtgaggtcagcgaggatgtccagccacaggaaccaggagctcagatgaccttgtggactggaggggacaggagacctcccaaggccacgtggcagctggacacgggcagggtcttgcccaatcacttgagtttctgccccacaaatacaccaaccagagggagacagcgccccctgcacatgcagaccctgtagaccccgaaagctcctgtttgtggagtccccgcccctggccccgcccctgctgaccaccctggccccgcccctgctgaccaccctggagcagccccttgggcttcatctcagatgcacgagaggtcgtgggtctgggttctgactctggtttcaaatcaagcttggtggttcaaacttaggaaggtcgtttccttgacttcagactcctcatttatacaatgagccaataataccttcccccgaaggttctgagtagctggcattttgatatcttaggga

SEQ ID NO: 132001 - DNA, 1039 bp, Homo sapiens
ctgtgcctggaagccaggcccaagcagaggcgggctgggggagtgcagagggtgagtcctgggcctctgcggcccgagggcacctgggcagggtggggccagtttgggaaggtgcaccaggccctgaaccactgccctgttcctgagggccaaatttcctcgccacaacagccttcagggtttgctacgaggcatcccctaggtgcccccgggggaaggcgtgccaccaagtctccttccagaaccccttagttgcattcttagcaactcggtattctaatcctgagagctgggagcagccacgttgcaggcagggaagtagcagaacggtaggggaaggggcctgcgccggtgctggggtggcagccctgtaagaggctgcttgtgggggacgtgggcctgtgtccggggcgaaggaggctgccttttaattgggaggccaagcaggttaaataaacagcaattggattttgctgaggcctgagctgcctgcagtgtccgcgggtacagagaacactggagaatctcattttcgtgatcagattgttatagattcttcccccagtctgctgagaaatgtaaatgtgaattgtgtttccaggtgctgtaaaggacagcctgtaggggtatggggggcagggagggtgacccagtctgaactcggccctctcaggcctgggaccccagaaaccgtgccctttcctgtctacagaagctctggccgtgcccacttgaccagtccttctctgggagaatgctgaacagaaaaataaccctaggcaaagatttaaatcaatctgctgcgtctaataaataccaggctcacagctgagggaagggtagagacagcagtcacgggagttggggtgctgtcgcccttctgcccctcggccccgtcctcagacaacgtgcccatcctcctcacctcacctgggagtgtccttggtgactcaggagcaacttcagagtcagacagacctgggttcaaggtgggctgtgccacgcctcagctgcagcgtgactgtggctggatgtatct

SEQ ID NO: 132002 - DNA, 1031 bp, Homo sapiens
acaggggcctccttgagtatgcggggcaccactctctagggtgtctatgggggaacagaagcaccgggccgaggccacgcccagcctgaggtttaccggcgtggattctccatcagcaggtgcatgcgtcgcacgtgttattttagccagtcctgcccagcggtgtggatgggcattttgttgcagttttcatttgtatttcctgttggcagatattccattggccaaggaaatggagagggacagggacaaaggttgggaaagggcctggtggggcctgtagaccccgaggcccataggcactgggagtggcagcgggacgctgaggcagtgtaggaggggcctggtctggtgcaagtccaggtgcaggggccatgttagaagcatcagtcagggcagctgcaatggccggtgggacagatggccacactgaggcctggggcttttctccatccccctgcctccagccccaagcgccctgggacttcctgatgttggaatcccccttcttacaagcctcatttctgaacccctagagcacctctctcagccaggtgaactctgagtaaatgaatgactgaagggatggatggatggatggatggatggatggatagatggatggatagatgggtagatggatgaatggatggatggatggatggatggatagatgggtggatggatggatggatagatagatggatggatagatggatggatagatgggtggatggatgaatggatggatagatggatggatggatagatgggtggatggatggatggatggatggatggatgatagatgggtggatggatgaatggatggatggatagatgtataaatggatagatgggtggatggatggatggatgcatggatggatggatggatggatgaacagaccagtcatgaaaagcttctcttaggaggcaggcagttagctgttttggggatgaggtctcaggatgaccagggcacacagggatgggcttttgactccctgtcctctcagctctccttgtcc

SEQ ID NO: 132003 - DNA, 1067 bp, Homo sapiens
ggtctgaacctccgctccttcccctctgcgtgtgtagacaggcacacatcgcggggcgggggtgccgtgtgcacccgtgtgcacctcacggtgtgctcgtgctgacccatgtcctcgtgagcccacaatgggacacaggttttcgggccgtggcaccctggtgttccgtgtttcttgcctttgtggggacacgcgtgcctgctctgggtgtctgcctgcacctcacaccggggtgtgtgttggttttgggtggcgtcggggctggctgccgcccgcccactgtgatgaatgtggcctgcgtcttgtgcagtgcagctgtgggcgtggcagcggcactcaacaggctgtgcactcagcctcctgacgcgccctatgacctggcggcccatggggcgccccatctctttggcatccccatcaggccaagccaccaaccctgttcgagaccctcctatggctcctgacagcagctcccagaacatgggccaagaccttcagggctcaggtctggtccggacccctctgcagcccctgtcctgcctcccaccttcctctccagctctggtctatttctcacacccgcacaatgccctgccccagggcctttgcactgccggctcttccttctgcccggacctctgaccccttcatcacccacccacctgcccttccgtgggacacctcctgggtaagccccacttctaggcctctgtaggttgccttcttgcactccccagagcctccttggcagagctggtcaggggctttttcctgcatattcccgcagccttagtgcttggggtgggggattgcacaggaccacgccctcccccttgccccctgccccctgccctgctcccagttcgagggtgttcacatgggcacccacgcgtctagtgagtgccacttcctctgtgtgcacgccggctgtctacagggggatcccaggcctgtgcgtgtttacccagaagtcacagctctgccgatggcgcagctgcagccagggaggccggaggcttccagaggacaaagggagggcgtgggctcgcgggcccggaggggttaac

SEQ ID NO: 132004 - DNA, 1025 bp, Homo sapiens
atcccctcaggcccctcatctttaaaacaggaagggtaaaaatatcttgtttcttagattgccctgatgaatgagaactggggtgaagtgtttctaagcagaagcgatgttgacgatgaaatatcaatatgctcgcgtattcttaggcagggagactctagagggctcagggagcagagacagactggaggcagggatattcgagcagcttgaggtgtgcacggagattctgagaaagggaatgtttggaggtggtgctcagaaagaggtgggaggatgtgtgttcacgcatgcattcatgcaagtgtgttgtgtgtgcgtgttcatgcatgtgcgtgtgcaagtgtggcatgtgcacgtttgcatgcatggcatacatgtgtgcatatgtgctcatgcatatatgtggtgtgggtgcccccatgtaagtgtgggtgcgtgtgtgtgtgtgtgtgcgtgtgcagtacattactcatgtgcgtgtgtgtgtgacatgcatgcacggtgtgaatgtatgtatccaggctgggctctgtgcagcgatttttgacagaacacaggtaaaggctgtggggcaggggccgttggtcttgtggaaagacggctagagggcatattgactcggctgctggcaacatgaagcagggagcttgtcatcttgtgcaggatggggtggaatgtcgtctcctaggcccagagacagttcggaccctagtgcccacgctctgtgcccagaaggccctgatgcttccaggaccacagcagcaaaagtgatctcagtagtaatagtcatttattgagtgtttactttgtgccagaggcacctgcacgggagataggctcctgtggaggcacgctctgcctcagggccttcacacagctgttccctctgccaggaagtcttccctagagacccgcagggctcccgccttccagtcctcacgcacatgtgacctttcattgcaggctaccctgaccgtcctgttgaaaatggcagcagctctgggcccactctctgacccttt

SEQ ID NO: 132005 - DNA, 1050 bp, Homo sapiens
agcaggtgaccaaggtcagggttcagtgggtgaccagtgtcagggttctgagtgtaaccaggatcagggctcagtgtgaccagggtcagggctcagtgtgtgaccagaatcagggctcagtgtgtgaccaggatctgggctcagtgtgaccagggtcagggctcagtgtatgatcaggatcagggctcagtttgtgacaagggtcaggactcagagtgtgaccaggatcaggacatggtgtgtgaccagggttggggctcagtgcgtgaccaggattagggctcagcatgtgaccagggtcagggctcagcgtgtgaccagagctcagcgtgtgaccaggatcagggctcagcttatgaccagagctcagcgtgtgaccagggtcagggctcagcctatgatcagggctcagtgtgtgaccagggccagggttcactgtgtgaccaggatcgaggctcagcgtgtgaccaggatcaggactcagcatgtgacgagggtcagggttcagcatgtgacgagggtcagggctcagtgtgtgaccaggatcagggctcagcatgaccaggatcagggctcagtgtgtgaccaggatcagggctcagtgtgaccagggtcagggctcagcgtgtgaccaggatcagggttcagcatgtgaccaaggtcagggttcagcaggtgaccaaggtcagggttcagtgggtgaccagtgtcagggttctgagtgtaaccagaatcagggctcagtgtgaccagggtcagggctcagtgtgtgaccaggatcagggctcagaatgtgaccaggatcagggctcagtgtgaccaggatcagggctcagtgtgtgatcaggatcaaggctcagtgtgaccagggtcagggctcagtgtgtgaccaggatcagggctcagtgtgtgaccaggatcagggctcagtgtgaccagggtcagggctcagtgtatgatcaggatcagggctcagtttgtgacaagggtcaggactcagagtgtgaccaggatcaggacatggtgtgtgaccagggttggggctcagca

SEQ ID NO: 132006 - DNA, 1031 bp, Homo sapiens
gaggagcacagtggtttgtggcgggaggggagtgagagccatcagtcaccatcagctgagaagtagtgaactcttagagctgtaatcattattcagaactgaactggtcacagatagagcccagatcccaaactcagactgagtttttaccctgttcacacactgagttctgatcctactcactcactgagccctgatcctggtcataggctgagccctgatcctagtcacatactaagccctgatcctggtcacaggctgagccctggcccagttcatacattgagcccagatcttagccacacatagtcctgaccttggtcatacactgggccctgatcctggtcacaggctgagtcctgctctggtgtcttagctggaatgacttgtgtgtgtcacatgcttgtagggccacctcctcttccagccacatacagcaactgaccatgtgacccactcagcctagaaagacttacaggcttccactgcaatgcaagtcacctgcctgcctcaccccggttgtgcagacacacttgcacccatgggctcaacactcaagcccatgatgtctgctcatgctctgtaaaccctgagccctaagagcacctggtgtccctgcaccccagcaactagatccgtaaccaaaccccaacctcccaggcccaaacaccctgggtcatccagtcctgaacgctggcctggcagcatggctcaggtgctcctgctcccccacacccctgcaccagcctggcttgtagtgctgagggcctggggaatggggatgctagggaggaaaatggggagcaaagcggggggtgggggttgcagagttctcatatgtttcaagccatagacactgcccctaccgtagcccatccctgtatagttccttgaccacaggtgtctctactggagtggggtggagggcggggacagtggcagttatgtcaaagtcatgtctgtatccctagaattgagccctgacccagtgagaatcaacagtggtttatgagcaaggcagtgattacgtg

SEQ ID NO: 132007 - DNA, 1038 bp, Homo sapiens
gaggagtcccaatggtggcggtcactggtggtctgcagaggggtgggcagtggctggacctgtcatggggccctatctaaggggaaaggcacagccctgccctgggattcctgtctgagggtcccaggtcgctctaggtccccactcctcttgggcaggaaggggacctgctgtagcaaggcccctgctcagctggtcctgggtggtgtcactgccccagctcctgctctcaccctggacacatgggggtggggagcaggtgtaactgacccagattcctcaggcctgggctcaggaggggacctcgctctgtgacccagatattccaagtttctgtagctgacgagaggtggcaaatggtctcccacgtgcgggagcagtcgctgtgtgcgaggagggaatgacttgcctgtttgcagagatgggaacaggtgccccctgcagcaggaaggatttcagtcagactttcgggggaacttccagatgttgtaagtcaggatctggtacaagaggatgcgtcccagagattttgttgaaagagggaggtctgaggctttgccaccttgcctaagtcgacatgcatccaagatgcacacaagggcctcagttcagggcccagccctccatctgtcctgctaaaggccagtccttgactgaggtctagtgcagcaagggaggctcgggtaactcccaggaaacctgcattggctgagtttatttcctggctcaggatgggtctcaggttgcccctgacggtcccttgcagacctgcatttcagtcaaggttcagatgttgcaggccctgggtgggagggggcaggcagccagacacataaaaactggattccaggcccactgctgtcttgctgtgtgaacttggacaatcgctgcttccctgagccttggtttctttatttacaaagctgacctaagggttcctgcagaaatcaaatgataaactgccagaaagcccttagcacagagtagaagccattatcgtggaggtgcagggaagggtgaggagaagggtccctgtcc

SEQ ID NO: 132008 - DNA, 1049 bp, Homo sapiens
agagctggcctggagccagggtgtcggcgcagatgcgggctgcgcagatgccggctctgcggctgcagcaggcctacgacggccggaaggttgagtaaccgctctgagtcacacctgtgaggcggatgatgccacctgtctcagagtggtggggactgaactaggtgatatatttatggcacttgacatagtctggcgtgtagtaaacagtctgaaaaggacagttgttgttggcatgacttctgtgatgtgcctcagactgtattggaaggttgtgaccagggtcacagttcatttgcaaccaggtttggggctcagtgtatgaccagggttaggttcaggggtgtgatcatggtcagggttcagcacgtgaccagaatcagggcccagtgtgtgcccaagatcaagactcacagcctgactgggatcaaggctcagaatatacttgggtcagggtttagtgtgtggctggattcaggggacagggtgtgatgggaattggggctcggggtataatctgggtcaggggtcagagtatgatgggggttcagggcttagtctatgactagagacagaaattagttttgtgggcatttgggagccatagacggtgttggggcagtggcaggacgaaggtggtactgtgggtagaaatgagtccttagggggcaaagggtggatatagggttcaggagaagattgggagtgggagttcatgtggtggaaactggcagagactcggtcaccagccaggagaagccattggtgggagggggccggctggttcagacctagtatgcagggagggcctccgagaattggtgacttctgtgctgggaggagagcccggcgcctgaaggtcagggaaggcgtgcagggcagggggcctggcatgtgcaagggcctgggccgcgctgtgcctggcttgagccagtctccggcaggggcccggcctggctctgcctcccctcggcgtgagttgaggccggtcttggtctacccctcctagtgaggcctgcccaggccaccgcccatcccttcttcatcgc

SEQ ID NO: 132009 - DNA, 1094 bp, Homo sapiens
ggggttggaggggcagtggggcgccatccttgggcagccccagacccctccccacagccctggctgtgggatcctaccttctttattccttcctccaggcgggaggcaggagaggcgtggggtacctggcggtaccccaggcacctggggatggaggttgtgggaaaggggacagagacaggagtcccaccctgtacacccctccccaggatgtgtcaggaaggcaggctgaccctggcggctgtgggacccgagccccagcagcccctcctgtccttggggccacgtggggcaggctgggcagagcctgctgcaggcagtggtccgtcactggtgtccatcctctcttctctgctccggccacatcagaaaagtaggctgcccaggaaagaggccaccacccatcaggctggccaaggctgtgatgtgggtgtctgggaactctgcatccattgtggaaagcaggccggctgtgtggtcatgagccctgagctggagggctacacggtctaccaccctggtcttctggacgtgaaatgcctggtcaggggtccatggagtcctggggtctcccagcctccagcttctggaacctgggcctgaggaagtcaggccttgcccctcggggtcctagcagcatctttctgcagagtggggatgcaggaggagggcctcagggagcctctggcagttggggagcagagagtatggcctgagactcctccttccccccagcagaggaggccaggagacagggggagaccccaggatgctcagggccagtggcttcccgggggtgctccaggaacagctcttgtattgactggtagcctggacagtggcaggcatgggagacttatgttagagcccaagaagagcctccctgggtgcaggcgcccagccagggcccttatggggtgggcagttaatctgatgggaataggggagggagatcaggaaggaagtctagagagaggaggtggcctgcccagagcagagagccaggaggagtgtgaccccagggagagccaggattggtgtcccttagacaggtttcagctgcaggctggcaggggcctccgggccctgtgggt

SEQ ID NO: 132010 - DNA, 1332 bp, Homo sapiens
aaatacacacgcatgtacgtgtacaaaacactcagatgcattctctcacatttacaaacacctgaatccacacgcaaacacagggacacaaattcacccacttatacacagacatatccacaaacacgcacgcatacactcacacacgcatccacccagagacacaaacgcccaccacacaggcaggtacatggggaggcatggtcgcccacgtggggcactgggctgtggacatggacaggggttcctcggggcagcaggagcaccgtggccctcccgagcggtctgtgcacgcgtgcacacacccccgctcccagaggcgctcaccctgccctgttgtctctgtcctacagaccgacttcgagaaggacgtggatctggcctgtagatcaggtgagcgcccgacaggtgagaggacagtgccagcccggccccctgcatggccccactccacgcctccgcctgtgcctcccccacatcacccatccctgtccactcctgctgcccccacccacacccagccacaccgtcaggcccacctggacccaggggacctgccctgggggcccagccttccacccccgtccacttcctgaggccgaaggagggtccatggggcatgatcagaagcttccagaacactgccctggcactcctgctgagcaggtgcctgtggagcgcctggctgcgtcccctgcccacctgacatctcttcctctgtcgtggccccagcgaggagcacagcctcaccctagtgccgctccccccccctgcctcctgcccaccgccctctagcacctgtgttctgtgccaccttcatttcctcattgccagtcccagcaggggcagaagtgagtggggctttcaggctagggggacaacggggagcaagaggaaggcggggagaaggacccaccatggagcccccggccggtgctgagcttcctggaaccaagtgcaaaaaacgaacgactgcccaataaaggaagctccgccgcccatccccaagcatcagactgcgagggtctgtttctgtccccaccactgttctgtgaaccaggtcctgaggcagtgacaggcagtggctttctgagctgtggagaggccaatggaccatgctccctctggtcatttagatatttgaagagcaccttctctagagacagccctggcagaggagctgggacagccccaggtggggagtgtgtgctggtgccagttgggccccaggagggcttcctggaggaagtgacttcggggctgggctgaatgggagctggacaaaaagcaccttctgcccccttggggtctcctgtgaaccagtcccacagc

SEQ ID NO: 132011 - DNA, 1003 bp, Homo sapiens
gaccaagttgctctcaccagggtccccatgaggtggccagggtcagtactgggtcatctgtggtcatctgggccagtattggagtgggtaaagacagactgccaacctgggcgggcagagcgatgcccacttagggctacacagaagggagaggaccctcgaggatggggctgagaaaggacaccttactgcccgctgcccaccaagggcccacagcacagcccaggcatgcacagacaggccgaggaggcaatcttgttcacgctggtaattttctgcctctcctgggcctcagtttccccactcataccaggagtgccactgcagccccaaggcccatcccagagagaggtggtggtcgagggagggccggggaacctgtcccgtggctgctacatctgggcaccccatagccggagctgggtgggatgctggcctcattcctggaagaaatggactatatcgtatgtcacctgctacctacaaaagtagggtgccagctgggatccctgcaaatgtgtgtatggggagtccccaggagtgctgggaggaagctacaccatcctgcccgtgtctgtaattaggggtgagggtcactgcgttgccagggccaggagacagtgactgattggaagcaggggccatgcgtggccaatgggagtctccatgggtggccagggctaggcatccatgagactgggaagcagattgcttctggataggataggaagcagattgcttctggataagataggaagcagattgcttctggataggagccctaccttcaccccaggtcaggcaaaggaacaaaggaaccaccttctctctgaccctcaacagaacagagccgtggcaaattcagtggcccccttcccatcgcccaaaaccaggaagaaacctttagacaaggaaccttgtctaaaaggaggtggcccagaagtagaataaacacagggcttggagtcggacacaggagggttcgacaatacccattcaaagt

SEQ ID NO: 132012 - DNA, 1052 bp, Homo sapiens
cgtcacccatggcgcagggcgctgagcagggctcttcacggtgaaagggccgcctccgccccactcttcccttgcatttcttttaaataacaaagccgctggaagaaccggagaggaaattggcaggaacaggaagctgggcaccacggtgctgcctgaaagcagtcatttgtcttggagtactacttctcacatgaaaagctggaagctgttgatgcttttcccttttagtaaaaagttactccctgtaattgtggaacaggccatcagaactcttcagttaactggaggtgcagctgtgtcactctgttcccaaggaaagaggccggaggctggaggggtgggtggtcgggggcagaggggcccagaccctgtgcagctgtctctcagcctgaagaacaggtcccagaacagggtgttccctgccatcggcccctctccacccctcactgctcctgcccatctagttatcacagaccactcagtctcaccccttcactgtagcgtggagaaactgaggcacagagacggtccttgcttgcctcagtttggggaaaagaattgagtctgggggtaggaacacccaggaagcccctagaggttcttcccgcagacccagtttggtgggaggcctctgagccagggagcccgggtcagatccccataggggcaagcgcctttccataaaatcccgccggtctcacggagctggtgtatgggggagagggcagacacctgggcccctctgttgccttcaaggctcaaccgagtttaagtctctcagtcccagcagggtcactgttgagggctggtggtgccactgggggttgcagggaaagtgatgggcttgggagagtgtatgagtcactataaagcaaggttgatataacagaggccctgcaaatgtggggggcagtctcctgtcagggaagcatgcagctggcggctgggtgcacctgttcattccagaccttctggatttcttgacactccaggctgctacccagaaggggcaagagacggccaggggcatgccacgattgtaaagctga

SEQ ID NO: 132013 - DNA, 1064 bp, Homo sapiens
tgcaggatcacgttgggcttggccacctgcccgccccgcggcccggggtaggcgtggagcccgccgctggtccggtggtccagctccatctgtgcgcaggtgctccggcaggcggcaaactcctcggggcggacagagggtggtccggcgctggggtccggcggcctgggtcccgtgcggagctgcggggagcgcctgtctgtcgctgcgggccggcggcggggccggcggagcacgcccggggaggcaggtccggctcggctgctgcggagggaggacgccgcgcccgagctctgcgctgagtcctggccgccggctctttatgcagccagcgaggcccgtgggcggccggctcgccgagcccggtttctcattggcccagccgcaggctccccgccagcgccccgcccgcgcccctgcaggccccgccctgcgcccactcggctcccgggcggcaagggacgggaggtcccaccccctgcacacatggcggggccaggatgactaatccctccgctccgtacctcccaccccggacggcggggctcattcagcctgcggggaccgagggactgagccgggcactgggcgcccctcccacgccccctcccgggcgctgggcgggctgtcatctgctgcctcccagggtcccaaggtggccttcctcctctccactcgcctctctctttgcggggctggagggggctggcgctggccactgctctcctgggtcctcactgcccctgaccccgcccacccagctctgcaggatgtgcagctgagcccgggaaggaccctcaccatcagcctctgtgcccaggggctcagcaagtctccatgtgagctcccagatgtggctttgagctcccactcactcctgcccgggtcctgagtccaggtcttgggctctgtgtgagggacgcacagccaggcagaggctcgctctgcctggccctggcgttggtgtgcatgggtgacaggggcccacgtggcagtgactggacagggctgccccatgcccccatacgcaggtctctggtgaggcccaatacttttctgtgttt

SEQ ID NO: 132014 - DNA, 1026 bp, Homo sapiens
ggggcagagagggacaggcagatggggagtggctttgctgggtttaagagctgtttagggggccagggctgagggggagctgggggtccccagtgtcaggttgccatcacggacctggggacgagcatgagggggacttgtaaggagccactggagtccggcctgggggggctggagcctggcgctcccccacactgggtccccagccaggccgtgtgcccaccccacacctccctggacgcccacctggcccagattgtgctgcaggaaccctgagggtggctgccccaaaatcaggacgaaggattcactgccagctggccaggccagacgcccccagagctgggggttcaggatgcccgtgccagggagggggtggcgtccaggactgtacgctgcccccaccctgatggctgcgctttcctgctgttctctgcatctccatttcaatctctccccagtgccagccaggctgccagcaaccccagctcacttccggagccataaaaggagagacgctgagaatagcgcggctgtgacgcgcccaggagctcctcacgcatgcagactctgcaccacccgcccgcccgcctgctctctgaggtgctggcctgaagggccccccgcccagccccagccctaccaggattggacaacctgggaccccggctgggaggtcaggagccaggggtcatgcagccctgccttggctcccgtatgacaccgcaggctgctgtgctcctgggatttggcatcaccatcccctgctcccaggccctgggcctcacgagggcacagcaccacgggaggggcaggcagcagagggcggcgggaggcacccctgtcccaagaggtcccggccctgcctagtggccctttaggctcccacaaattcccagggacccttcctgaggcagagggagttggctctgcactggacatggctcggggctcacagatggggacagtcattgcctactgagcgccagcaggtgctgggagttgggtcagcttctctccaaggtc

SEQ ID NO: 132015 - DNA, 1041 bp, Homo sapiens
aggggcgagaacagcagctgccccactcccaggctgctttgctgagcctcttgccaagttagggggacccagaaccacccagcctgaatctgagacttagccctggctgagctctacttccaggatggtgagggaacccaagagtccaggagcagtggtgggcagcagcagctcagcctctgaaacccacgcttgtcaagcttcccaaggacaacacttttttgcccttcttgtttctaattaaaaagaattagtcagcagagtggcatgcttatggacagtgccgagtgacattactgcatggctttattcatcaatgggaggggcagatgccgtcctactggagactggcacagaatcttgttctctgcgactatctgcttggaagcccaagccacctaccagctgaaccaatgactcattatacttttttctgactccttctccctctctctccttctctcccaccctcctttcttcaggtttggctggacccgccaagaaaaggcatcgtgcagaagcactgtacaggtattggaccccctcccccttacaggtgagcctgctgaggcagggaggggcccccagagaggagggggcagaagtgggcacagaatccaggagtgtgactcctcaattagggaagagcctgccacacaaggtgggcttgccccagacagagaggtccctgggaaagggaggtctcaggagcagggactcagctttgagctcaacctggtcactttccctctctggcctcagatttcttcaatggacactgggaacattaagccatgtcacctgcccagggtacaatctgaggacaagtggaacatccaggaatggggttgtcatctccactccatcctgactctggagaaaacaacactctctctcccacaaatgcctacaagaggccggagagacgaaaactgccttggcaatgggtcataccggccctcagccctggtctctctttctgggctgatagggaggggcctgagtccattccacagcctccatggaaggcagcctttcaga

SEQ ID NO: 132016 - DNA, 1051 bp, Homo sapiens
gtagggtctcactctgttgcccaggctggagtgcagtggtacattctcctcaccgcagcttcaacctcctgggctcaagggatcctcctgcctcaacccccagagtagctgggactacaagcatgcactgtctcacctatctttttaattttttgtggaaacgaggtctagctgtgttgcctaggctggtctcgagctcgtggactcaagcgatcccaaaatgctgggattccaggcacgagcccatgtgccagctcactcatccttaggtccgttgttacctgggctcccagcaccctcccaccctctggttcttctcttcctcaccctcccttgctggttccttactgaccaggccattctttggctctttttgttcaaccagtccccactccctgggtgatctcctccagtgtcatgccgttaaataccatccaacactggcaacgaccaaattcatgtctcctgccagggcccctccccagaaatccagactcctatgtgctagccaatgtctctgcttagctttgatcctccagcccagccttgctccatctgcattgcccccaccttcatgaacggcagctcaccttgctattcactcaggctcagcctcaacagtctccatccctcatatccagatcctctaccctcaaaatccagccagtgtttggcctcttctcactccctccaactgccctccccaatccacacctctgtggtcttgcctcctccccagtctctgtttctgcccttacccccatacagctatcaactgctgcatcaaaaaccgcccaaaacttagcagcttgaaaccaactgtttttattgcagatgattctgtggggcaggaatttggccatgctagagtcagatgtgtttcacagaggaggctgagtcacggagcataccaggcacatggcaggactggaacccaaggtccctggactggggctcccatggcagggtctcctgggacaacaaagtcctccctcccccggaaggctggctccatccctggtgcgactctgctgctgaagcagcatcattg

SEQ ID NO: 132017 - DNA, 1122 bp, Homo sapiens
aaagtcccgcggcttcggccgcggaggtgctggagcctttgcgctcagacgaagggccgaacggccagggccaggccgcgtcttcagagcctggcgagggtctcgcgctgctgggaaggcggagacgccggggcgcgcgtgcaccctcgcgcctgcagcgccgcgcacggccgccaggtgccgctgtggcgctcagcgcgccgcccgccccgccccagggaacgcgaaagtggcgcgggcctggacggcgggacggaccacgtagggcgctgagaaggtcgcgccacggtgggcggggctccgggcccctccccctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtgagcggcccccgcccctggccccggagcacggcctttgtgggacctccgggggctcctcctagtccctggccccctcccctagggaaggcccgctgcctgcacctctttcggatactgctggagtcctgcctcttaccgctcccgcccc

SEQ ID NO: 132018 - DNA, 1327 bp, Homo sapiens
gggatcgtcctgtaggggtgtcctgtagggggtgccctgtagggagtgtcccgtagggggtttcctgtagggagtgtcctgtagaggtttcctgtaggagtgtcttgtaggggtttcctgtagggagtgtcctgtagggggtgtcctgtacagtgtcctataggggtgtccagtaggggtgtcctgtaggggtgtcctgtagggagtgtcctgtagggggtgtcctgtagggagtgtcctgtagggggttttctgtagggagtgtcctgtggaggtttcctgtaggagcgccttgtaggggtttcctgtaaggcaggtcctgtaggggtttcctgtagggagcctgtagggagtgtcctgtagaggtttcctgtaagagtgtcttgtagggagtgtcctgtagggagcgtcctgtagggggtgtcctgttcaggtgtcctatagggggtgtactgtaggggtgtcatataggggtgtcctgtaggggtttcctgtaggtggtgtcctgtagggggtgtcctgtaggaggtttcctgtagggagtgtcctgtagggagtgtcctgtagaggttttctgtaggagtatcttgtagggttttcttgtagggagtatcctgtagagaatgtcctgtagggagtgtcctgtagagggtttcctgtagggagtatcctgtagggagtatcctgtagggagtgtcctgtaggaagtttcctgtaggggttttctgtagggagtatcctgtagggagtgtcctgtaggaggtttcctgtaggggttttctgtagggagtgtcctgtagtggtgtcctgtagagagtgtcctgtagggagtatcctgtagggagtatcctgtaggaggtgttctgtagggacgccctgtagggagtatcctgtaggggggtcctataggaggtgttctgtaggggtgtcctgtaggaggtgttctgtaggggtgtcctgtaggaggtgttttctaggggtgtcctttaggggtttcccgtaaggggggtttgtgggggtttcctgtaaggggtgtcctgtagggagtgtcttcaagcagtgcccctgtacgggggtcctgtaggggtgtcctgaaggggtttcctgtagggggtgttctgtaggggcgtcctgtagagatgttctgtaggggtgtcctctaggggtgttctgcaggggtgtcctgtaggggtttcctgtaagggtgtcctgtagggagtgtcccgtagcagtgccctgtacaggggtcctgtaagggtgtactgcaggcggtgctctgtagggaatgtcctgtagatgtgtcttttatggggtattctgtagggga

SEQ ID NO: 132019 - DNA, 1030 bp, Homo sapiens
gtcctgtgtgaggaggagggagtcccgtgtgaggaggagggagtgccgtgtgaggaggaggagggagtcctgtgtgaggaggaaggagtcccatgtgaggaggaggagggagtcctgtgtgaggaggagggagtgctgtgtgaggaggagggagtcctgtgtgaggaggagggagtcctgtgtgagggggagggagtgccgtgtgagggggagggagtcccgtgtgaggaggagggagtgccgtgtgaggaggagggagtcccatgtgaggaggagggagtcctgtgtgaggaggagggagtgccgtgtgaggaggagggagtgccgtgtgagggggagggagtcccgtgtgaggaggagggagtcccgtgtgaggaggagggagtgctgtgtgaggaggaggagggagtcctgtgtgaggaggagggagtgccgtgtgaggaggagggagtcccgtgtgaggaggagggagtcctgtgtgaggaggagggagtcccgtgtgaggaggagggagtcccgtgtgaggaggagggagtcctgtgtgaggaggagggagtcccgtgtgaggaggaggagggagtcctgtgtgaggaggaaggagtcccatgtgaggaggaggagggagtcctgtgtgaggaggagggagtgctgtgtgaggaggagggagtcctgtgtgaggaggaaggagtcccatgtgaggaggaggagggagtcctgtgtgaggaggagggagtgccgtgtgaggaggaggagggagtcctgtgtgagggggagggagtcctgtgtgaggggggagggagtcctgtgtgaggaggaggagggagtgctgtgtgagaaggagtgctgctacgtaagaaggaggtagatgtgtggggggagagttggcattcggcccggtcaggactccatggcccttgttacagttgtgggtagaaatggaatctctgtgacatctcctgctcccctttcacctgccccaaggcaggtctccagtactccctctcctttctgatcatgggcccaaagaggc

SEQ ID NO: 132020 - DNA, 1699 bp, Homo sapiens
cccggctaatttttgtattttttgtagaaacaggaggtctcactgtgttgcccagggtggtctcaaacccctggcctcatatgatcctcctgccttggcctcacatagcatggagattacaggcgtgagcccctgtacccagccccagactagctaatattatgactgatcaccattccccattccccattcccccaccccaggaccactggcagaggccactcactctgccttcttttctgtggttctgagaaggctgctgagtttcctcctcttgcctgtgcagccccctcctgccaggtttcaggagggagatagcctagagcatgtctgcactgagtgaggagtgggtcaggagagaagcagggaagtccttgtgtgctggcaggtcccttcccctctgctgtctgtgtcctcatctgcaaagtgggggtgcatggtcttggggaggagtgaggcaccacccggccccctaaccagtgtgtctctccagagcaggacaggctgctttggtttgtgacctccaggcaggacggccatcctctccagaatgaagatcttcttgccagtgctgctggctgcccttctgggtgtggagcgaggtgaggtgcccttggggaccccagacctttgtccagctgtgccctgctccactccctctccacccctctcccctgagcagacgccccaggggtccttccaggccgctcccagcagagggctcacccggcctggccacactgtctcactgtgtgtttgagtgtcgcttgacctgctcgacggccagggtggggtgtcactgtctttgctctgccttcagcccagggcctggtatacagtaatttctcagtaaatgtccactggggtcaggcctgggagggacactggaggcttccctgagacaggtgtgtcctccttccgcagccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctagcccgggccggggctcagcagaggccattgctgtctgtctgcagccgtctgtctctcccctgacagcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgac

SEQ ID NO: 132021 - DNA, 1050 bp, Homo sapiens
gtgaggctgggagggtggtgcccgctggtccgggtggccaagagaggctggaaggatggtgtctgctggtcagggcggcccaggaggtgctgtccaggcggagcccggggctggtgtgggtgcgccatgctcctgagaagtttctgggttgtggctttaatgttctcctgcaataagaacgctgacacttggctgaaaggtcctcacgtctcccccagtacacttctgagatgccaggaaggcattctgaacatcaggctgattcctgggactcccctccagggtgacctcaccggagtcaggagcccccgccccgcgcccactgccccactaggatggctctgcagtggcctgaggacagtgaacactggggtgtaaagttgcccactgtgatggttttgacctttgaagaaatttgggaaccaagtgaaagcccggcagctatttctaggcatttcagagggtgcttccctgcacgatttcagagggtgcttccctgcacgatttcagaaggtgcttccctgcacgacttcacagggtgcttccctgcacgatttcagagggtgcttccctgcacgatttcagagggtgcttccctgcacgacttcacagggtgcttccctgcacgatttcacagggtgcttccctgcacgatttcacagggtgcttccctgcacgatttcagaggctgcttccctgcacgcactctgccgcacaccacactccctgggccaggagcctgctgcacagaaggaggttccttttcttctctttccagcgcttttcttctccttttcttcatctctgctcctcctctaactgaggaatgtgcgaatcttttttgttagttttgaggctgcttcttatgcatatttcatctggaacttcttgctttgggggtgatctgctctaccagcctgaaaaggatgagaaatatcttctgaatacatgagaagtgcggtgattacccggttcctctgttggtaaagaccacactctgaaagcaagaagatggcttaaatttgggttgagtggaaacaggcacctgtg

SEQ ID NO: 132022 - DNA, 1028 bp, Homo sapiens
tgtgtctgcatgtgtctgtgtgtgcatctctgtgcgtgtgtctgtgtgcacgtgtctgcgtgcgtgtgcatgtctgcgtgtatgtgggtgtgtgtttgcctctatgtgtgcgtgtatgcacgtgtgtctgtgtgtgtctgtgtgtgcgcgtgtgtgtgtctgcacgtgtgtgcatatatgtgtgtgcgtgcgcatgtgtgtctgcatgtgtatgcacgcatgtgtttgtgtgtgtgtgtgcgcgcgcatgtgtgtgtctctgtgtgtgtgtgtttgcttttggggcggtttaggacggtggggggtggtgcacaggtgcaaggatgccccccaggacacaggcgcacgtgcacacccatgagggagggaggcaccctgtgccacagagccctaggagtggaccccgggctgccgtgggcagcagggtttggccttacagtctgaagtcgatgcttctggttacagcgaagctgtcactgtccccatgatccccctgggcctgaaggagaccaaggagctggactggtctacaccgctgaaggtaggtactggcctccaagctctgagatacacggccctgccctgggaccaagggggtcttggaggctttctggtccagctgtctggttgaacagatagggaaactgaggcccagagggagggaggcttaaaagggacgcaagggacctggcagaaatggccacagggacccagcctctgctgcgttcagggccccgctggtgcctgcgccccaggccggggctgatcccatagagtgggtgtgaacatgtgccctaccctcggatgggcaatgccctaggaggatggggcctggaagccccagccggagcacagggtacaggctcgcccatggagggcaccactggcttggggccacacacccagcactggctcacgagggtcctggggagagctagaacagactggcactgcctggcagggccccacgggagccactgactgtgttccgtgtccgagtcactgagtggcagatggcacctgcctcc

SEQ ID NO: 132023 - DNA, 1047 bp, Homo sapiens
catcaccctccctttgcccctggccccccacacgcctcaggtttctgcgttcttcaacgccccctttcctgccccaggtaccatgactagctcctgctcctgccccagccgggctcgctggccactcagctctggagctgcccttttgaaacttgagacgggctgagtggggacagtaggcagggcccctgagggtgaagggcagcagcaccactgaccctagctagggagcactgggctggacgcaaagcacaaagcgaggagtggggggggctccagcctgggggtgcgagggagcggaagccttgggtcctcgggtgggagtctgcggctgctgggccatctgggagagtgaggacgaggctgctctctggtgctcaagagtggggcaggtctggctatttggggctgggcggctttgggacatccctttttaaaccaggatggctttgtcaccacctcaggtccccagaatttctgagtgatgtcacctctgcctcttaactgcagtgtccatttcagcatttgccctgtaggaaattggatctggtctgggaaggatcatgcgcgtatttgaggaacccgggaaagccgccctcagcaggctggtcctgccctgcccaccccgtgatcctgggtgacctctgtctgtaaaaggcaggcagggctgtgtcaccggagcagaccctcctcctccagatggcaccccctccccgcctcatccccttggctctcaggcctggcagcactcggccatgtccagccccaaggtccatttccttcctgccaccaccgcactcccaggccgccctcccaggccgtggtgtgcggtttcagaaaggcgggggtggtgcttatgcttggggttttgaggagcatctgatgaggcacctctaaaatttagagtaacagacactagccaggatctgccagcgccagcccagggcttcagggacaggtgcccttcccccagacctccacagctgcagtgggcagctgggcagatgcctccgccaagcgggctttgcccccacaccttctctgctg

SEQ ID NO: 132024 - DNA, 1197 bp, Homo sapiens
tggcagctgggccaatggcccgtggtcacccagctggagtgtgtacccaccgcaagtgctgctccctgtcccccttgggaggccaggcctgggctcggcccctggcactgaccatcagagctgtagtctgtcctggggccaggtttgacgggcatttcctgtctctgcaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggtgagaggtgagggcgggggcgctgggagatgacaccgaccggctagcgtgtggtgggcattgcaggccagaccccctaacctccaacatgctgtggctgctctgggccttggctcacgcccctgtcttggggaggaggtcaggggcctcatgctcccagggagccagtccaaacaagcacttcccaaatgggtcacgtcccatcctgggagttaatttcactcttccatacacccggcgccttcgtagccatccctagtgagaccaacagggcagccggagaatggagggtgccaggaggccttcctctgccatcccccaggaagggccctggagtggcgcccacctcgcgtggctgagcggcccctgattttctgtggggtgggggagagttgctcacaagcaccatgtttcgcttttggaaaaaggatgatgccaggtacggcaaacacgcccgggcgagcgcacacctggggccgcggcgcccgtaatcgcattggcgacgcctcgacaactgtgtctggaggcagccggcgccgccaccttgcgccctcccagcccagggaaacaggctcaggagaaggaaatgctttggattcacttatcctacaaattaactagaaaaatattttggtttcagtccaattttaccccctttcttgtccatcaaaaaaaaagagggagattgcaggtggtgttgggattgcagaggctgggccatgctggctccccgacccgcctgggacctagagagagaacaggttcagcccctggaggaggtagactccgacggcagggtctgcgggggtcagaggagaggcaggaagcgtacctccctg

SEQ ID NO: 132025 - DNA, 1001 bp, Homo sapiens
ttggcaaggcgcttgatttaacagcgtgggagcctccaccggaaaaatggcttgaataaatcaccgcctgacgccagaaaatagatataatctcagcattaactacattaatagtagcaggagccgaattaagaaagccataaagcataggcgggcgggcataaattatggcccagctcagtaccctcagtgctctggcttgcctggggcggtcctggggcgggacaggggcaaggcgcccccttgcctgcggaggctgcttccagccagctcctcccctggcccctctcccctggccagggcggtgggcggggccaggcggtggtgggcggggctccgtggcccagccgcggtgggagggcgcatccccccaaaggttggctgaggggccccagctccctcctttccattggctgcttgtcctccaggactcccccaccccaccctacccagcttcttggaaccaggccctggctgagcccttcccacctggggcgtcccctgcccagtgggtactagcagtcatggagagtggcagagcaaggataggattcagttagggcataggtaccagacccagctccaacctttctctggtgtctgcagcctggaaggctccctgcaggcaatgacatttggccaggtagacacaagctgatccccacccaggccccacctcactcctctcattgctggtcttaggcccttcccagagaagcgccttcatctggatgaacagtcctgggggtcagcgctgccactggcttgggggacagagggggcatgactgctggcccttccgggcctcgtcagcgtcagcagccacgggcagaaacatggacagcggatctgaggagggtgccatccaggcttaactttaattcttggtcaagttcaacatggtttgtgttccctattcgcttgtctccagctggcttgtttcttatggattcatggaactccaagtgttcagggggagtcgcctttttgtcattttcctc

SEQ ID NO: 132026 - DNA, 1124 bp, Homo sapiens
atttttataattttttattttatgaaacaggacagggagcttagtgacttattactattcatttcgtttcaatgcagtaaatattgattcagttgggggttttcaatttaaaccactcggcgattatataaaatattactggcctctgaaattatgcttaccgatcccttcggctgctcattaaggaaggagtgcaatttttagatcccttttgccttcatcattctaataaatgggctgagatacggttttgcacggaaggtgccacagaagctgctagcaggggcttgacagcatggatgcaactcttaatttggaagttgtttcaaagtgtgctgtggttatttatttatttctctgtttgtttgaggcaggcaggcctttcggctttgtgagtggagtccttggcagtgcccatggcagcagggctgagctggcatccccccgagcctgcataccttccaccttctccaggtgtggccgagggccagacccctcctgcagcctcggccttggtggtttggggtagggaagagggaggagaagccagtcttgccagggcctgagctagcccgcatccacaccgaggctgggatgtccctgagggacaccgctgatcctctgggactttttccggacaaagggagagggactttttcctggagatcttagaccccagcccttgctggcaggcagggcagatctgggccaggacacaggaccctgaggagggagcccctgggccaggacacgggaccctgaggagggagcccctgggccaggacacgggaccctgaggagggagcccctgggccaggacacgggagcctgaggagggagcccctgggccaggacacgggagcctgaggagtgagcccctgggccaggacacgggaccctgaggagggagcccctgggccaggacacgggagcctgaggagggagcccctgggccaggacacgggagcctgaggagggagcccctgggccaggacacgggagcctgaggagggagcccctgggccaggacacgggagcctgaggagggagcccctgggccaggacacgggagcctgaggagggagcccctgggccaggacacgggaccctgaggagggagcccc

SEQ ID NO: 132027 - DNA, 1004 bp, Homo sapiens
ctggctgttctgggaacccctgggagggaggagaatagttgtgtggctcctgggctctctcctctttcctctcctaactagcttcttgcgtttaattttttgggataactttttgttttgatatacttttacagaagttgcaaaaataccacccaggacttccttactgaaactcaccagttgtttatatgatattttatcgcatttgcagtattgctttctctccctttataaacgagcttttgcacagaagcggagccctggtgcccccggagcctggtgctttggggtgtctctgtgaccatgcacagttctccagtgcaggaagggctgggagtctggacaagagaggccagctattttgtgcactgtccttccactgggcttatctgatgtctttttgtgatgagatgcagattcgcaattttggcgggaaagccatggcagcactggtgtggcctcaggctgcctggtgcagcagtgttggcctgaccgctgggtttaggccatccggcagtttctctgcggagcaggttactttgggcaattgttggggaaaagtgtgaggactgagggagcatcctgtttcttaccggacttctgtccactcattctagatgttgggataactttcccacccctccttccatgctgtgagtggtggctttccctgtcgcctttgccctgcgtcgttgttgatttgctttaacggcgtggacccaggagtcttactccacttgataggctgtaatctgctctgttattctggttctcaggtggtcccagccttggctggtggaagccgcttgaggctggcctgcgtccctttgatgtgtcctctcattcctgggcacgtcatcacgttctgcacggcaggtgctccaggctcaccgtggagtcagctgtttctctgcagaaccccggctccttggggggcagtggctctcggccctccatggccaagaatcatgcagccacaggtgtcagtggtgctaaggtcttgg

SEQ ID NO: 132028 - DNA, 1046 bp, Homo sapiens
ggtccctgagagccggccttggccagccctcccccgggccccaggactgctgccttgaagtgaagcctgtcccagagggcctggaatgcaggggtgcgaggcagaaggtcagtgaagggttttggaggagtcaccctgaaggctgaggctctgctgaggggatttaatttttttgttgttctgagatttgtagatttgccggtgccctcaccagctccagcaagttcattaatctgaactgaagctgaaatgtgacttatatccctaactgcttgtcactttttttctctttccaaattcatttgacatgaaagtgcgaaataaacagaagctgctgtgcttaagcagatgaatcggaggcttttccatctgactacaaatggtcctgtcacgaggctgcctctcactgggctgccttattttattttattttagtttgtgtctgtgcggtaaatcttaagtaatctgtgcagttttgacgagagttaggccaggattttgaagggctctgaaacgcttctccaaagtggcgtctcattaaagaggaattcagcctggggacgggaggggtcctcactgcgatgctgcgctccccacgcgtgtctccttaatgagcaggtgtgcctgcacagcctcctgggacgccagccaccctgccccacctcctgcccgtcttctggtttgggcactgtcttcgtcggctggggccgtgtcacacagtagcacagactggggcttcagcatcagacgctgacttctcacagtcctgggccggacgtttgagaccaggttgctgggcagacttggtgtctggcaagggccttcttccgggtttacagacagctgtcttcccacgcatcttcacatggcccagggagaggcagggagagcgtggtgagtgcgtgtgcactctggggtctcttatgaggatgctcgtcccatcatgagggccccacctcaggaccatttcacctcatcacctctgaaggccctgcgtcctcacgccatcccgctggggtcagggcttcagcatcgggtttcgaggg

SEQ ID NO: 132029 - DNA, 1050 bp, Homo sapiens
tataagcatctcgggggctatttctgcaaatttatgaagataatttttattctctcgataaggttaaatttacacctgctatttccatattaattcacattgctaagtggatctaattttcttccgttcttctatctggtgagcatggcctttcctaatgcaatttcccccacactaaatcactgtgatcgggagtcatgatcgagctaaattaacttaaattaatttacttaataagagccccggatcatcgggaatgaggttcagatttatggattctccgctcctgcttcccgtcctgtggtcgtcgtcagcccgacgtcgagggtccacctctcccaggggtgcggctcggggccaagtgatgattttcctcagggcggacccagcagggcctctccttctggattctgaaggccaagaaggcgtctggtttgggtccggctggtctggttcctgtagctgggcctgcccaggagggccctgatggtgttgttgcacagaaacaagtgcccatgccctggggctgaggaggccgggaggaggaggaggtggcagccggcccagcgcccagggcctcctgtcggcgccatgtggctgagagcagcgggtcagctgataggctccctccaagttccctgtccttccaaagtgaagcctggccagctgccctgcagggagcggccgtgactctctgagtgccctggtgtaggggctgcaccacaggcatgggtgggcaggaggtggagcaggcatcgcctttgatggatcaagggccccagcaccagaagcctgaattcagcccacccctggaggccctggctgtggttggtggccatgggctccaggcctcagtgtcttctccgtgtgtgaaggccaggctgagtccgccccaggatgcacatgtggctgagggggtgtgtgaggggccctccttgctttcctgaccgcctcaccccagtcctgttccactccttgccaggcgtctgggacccttcgggacacgaaccctgggcttgtggatagggtgtgggagtggagtggggaggg

SEQ ID NO: 132030 - DNA, 1005 bp, Homo sapiens
tgtccgggggccgggtgaactcaggtttctggggatggcacagggcctcctgccctctctttaggccgtgtcctgcttgcctgtggggcattcacggccgtactggaaggtgccatccccagtcggtgctgctgcccggcccctcctgcctcgtgctcagggcaccggggccagagacctgggctggcacagagttggcaccgcctcagaaactgcaagaggactggaaagacacagaaacgggtcacagacaccaggaaaagtaggtttgcaggcgtgcaagctgccgttagtcagagaaggacataggcagtgtggagatggtgaggtgccagggcagctgttgataaaaagcagatcaggcagtgtacaaagaaggtggaatcttcaggaattagggatggggggcctgactggccggaatgccctcagcccacagcccacagccatccgtcaccctgggcagcgctgcagtggccccgggggctgcacctggactagccccttccctgctcgctctccttgcatgcagggtctgggctgccccaggcctgttctgtgggtctggcccatcctggccgctcgctgctgtcacttctcccgggaacatggtgtggtgcaaggtgtctgtcaggcaagtcaacatcatcccttcgtgggccccacgccgtcctgtctgctgctgtgggggtggctgtggctgattccagcaaattccgtgccagtcttggcctcctgctcagctctccccgctccccagctgggatgaagcctgcggaggcttggggaaggggcttctagaaccagggtattttctcgggctggcagcccagcagtgacagttttgctgtctttgcgctgggcccgtctgcaccagggcccactctcgtgcctgctatttctggaggccctggtgctcccatctctgtagcccactgtgcataaggcccaggggctggtggatgctggcctggggcacggtcagaggccttctgggtctccacc

SEQ ID NO: 132031 - DNA, 1033 bp, Homo sapiens
tcgtgatggggacgttctgcctgagctggccagaatcaggcaggagccctacccgaatctttccctccaaacagtggaggggcctgggaggcccgttcgtggggagagcctgagcctcccgtggtgcccactatgattccacttttccgcacaactgcagggtccccacagcctgccagtgccgtctgccggaagctgatgtcacgcatgactggcccggtttgtgtgctcatcagtactaatcactgcagcccctcgctgcgccccaggggccctgccgatgacctgcctggctggcatgatggagggccgaggcgttgcagcggggggagtgcgtatgcgccacaggctggctccatcctgccctgctcggtgtctagatgagaaaagcagctgggaactgcccatgtgtggtcggggaagagaaaagcagaggctgggcttccggatcggggagcgaggcgggagccccatggcaggcctgggccccagggactgaccctcatgtttctcggaacccagcagtaaggactggtgaatccagacggtgggtgcaaggcatggcacgctccctgagctcccagcattcacgggaggggtgtgtgtctgcaggatggtgggggcactggccgggcacaggccttgtcctgcaggagcagacacccaggaccacagcagatgcggcggccgggcctagccgcacatgggcctgacagggaggggactgaggagggcagagagaagaaacagacaaagaaccaaggaggctttcctgtcctgcctcggagagtggccttggagcgtggccatgcagcccctcactgcaccaggtgtcagtagaaacgaggctgttggtcctgcagatgggtgcccgcaggtgaacgtccaggcggtgagcccagctcctgggctgggctgcatttgaactgcatggcctggctctgcgtgaaactcgagggcctgagggggcgcgagagcagggtacaggtttgtggggtgagcaacccggccccgtcctggctgctaggggcga

SEQ ID NO: 132032 - DNA, 1085 bp, Homo sapiens
gaaattccgtcacaatcaacattaagctttattcattgtgatggctaagagccgggccatttctcctctttttcttaactggcaaaattaatcagggaaaagattttaaacatttacccgtgcgaaagaggtcagccctgccactatattgctcagcagataagggggctaataaaaagaaaattgaattactaatgatcaccaagaacagagtatataaaacctggccatcgccagttcaggaaaagggagaatcaattttcttgggacaaggtgcgttcattttttattttggcgcatattatcagcaatttaatttgagaggcataaacaggaggaaacagttagggaataatgagcctggaggtgtaaagtgccacaggatatatgctgtacacaatttatttggcacaacagataatcgctttaattgaattcaaaagtgcattgttcagcagcactgtggccgctcacgcctggggactgagactgtttggaaggtttcagcctgactcttcggtgcctctcctcccctccctgcctctcccggccctccgaagtcctctgggcctggagtcagacctcggctgggggcggggcaggggattcctgggggtctcttcctctgctgtcagtgtgccccttgccttccgtttcttccttcccttttctcctggggatgggtctgttggcagctgggggatgaggatgtgagacactggccgggtgccgaggctcatgcctggaatcccaacactttgggaggctgaggcgggtgattacttgaacccaggaggtcaagaccagcctgggcaacgtggcaaaaccccatctctacaaaaaatgcgagaattagccgggcatggtggcacacgcctgtagtcccagctactcgggaggctggggtgagaggattgcttaggtctgggaggttgaggctctagtgagccatgatcgcaccactgcactgcaacctgggtgacagaatgagaccctgtctcaaaaaaaaaaaaaaaaaaaaaggagatagaagacagccccagaagggtggcctgggcgagtaatgtttgctggaggctgcagta

SEQ ID NO: 132033 - DNA, 1520 bp, Homo sapiens
gtgctccccttgcccccccagtggtacaggagctgcagcaggccatctccaagctggaggcccggctgaacgtgctggagaagagctcgcctggccaccgggccacggccccacagacccaggtgaatgctctccccacgcctgacactgcaggggaccacgtggccctgctggcttccacgtcgccctgtgggctggccccagcagcagtgatgagctggcagccaggatactggagtcctcaggtccccaggaaggtttacagttagccctgggcaggtggaggcagtttttgtctttcctggggccctgcatgtacacagctgcggtacacaggggctgcccttcctccagtcaaaggagggaggagggccaggaggtggccaggcagctctgggccctggttggggcgtctcagccgtgcctcctgtcccttcccctgtggcagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcctgtgagtgggcggggtggggcttcagggggccaggcactgccctggtgcccgcctagccggctcagcctgtgaccctccccctgccctctgggttctggggagactttaaagccgagtttagaagtcttgggataaacacaaacttggaggcaggaaggtgtgaatttggattgttttctgtgggccctttaaggaaacagaattgtggacacacagtggttgagggtagggtgcatgcaggtacttcctgggtgttctgagggtggctgaccccagcttttcctcccctttccccacagtgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgagtgagccggccggggagaggaggggagaggagactggggaccctggcccataccctgcactccaccccacggcagtggggagcgagtcccagagtgaaccccacctcagaggaggctcctggctccgagtgggctgtaggggaacagccctgaccgtcaccctccgcctctcctcaggtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctcgtacctggcctgtctccctccctgtctcagccccatctctg

SEQ ID NO: 132034 - DNA, 2045 bp, Homo sapiens
ggacgattggacttggaggggaatacagagggcatggaagtggcgaggctggcctgttggcgagggtgtcctggtggtggggcgggctgagtcagggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattagcaattaaaactgagaaatgggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtgagccgagatcgcgccgctgattccagcctgggcgacaagagtgagactccatctcacacaaaaaaaaaataacaaaaaaactcagaaatgctaagtgtacttatttgttgaagaaacttgttacatattactaacatcttttttttttatgagaaatacttttcccataaccaaaaaattcagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggcttggtgtcgctttgtggagaaccgctggtgtctgaagcgggtgtcagccccactgcaccttggtgcttctgggctgtcctgatgccgaggcccacttcccagccatgctgactttgcctctttcccctcccagcagaaaaatggctacaaacttcctagcacatgagaagatctggttcgacaagttcaaatatgacgacgcagaaaggagattctacgagcagatgaacgggcctgtggcaggtgcctcccgccaggtgagagctgcacgtggggcggctgggcggctctgctgcccgacaggagtggccggggcacacaaagcggattcagccaggccaggaaggcagaggcaccctggcccagtggctctgctgtgggtgctgggagtggggtctcggggcaggcggccttggccgggcccccgggccgggtctgctcagggccctcctgccggcgcctgtgcacttggtgtggggccaggcctggcactccttcccccgcagacatgggcgcctttgcctgtcgtcacagcctcaggcatctcccgcttttctggcccgccaagctctcgttctgtgcagtactttcttgctgtctctatgtgagggttcatggggttttttggtttgttttttaattaaattcttttttaataataaaaaaaagactggttctttct

SEQ ID NO: 132035 - DNA, 1060 bp, Homo sapiens
cagggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaagtaagtactcgcctgtcctcatgccccattccccttcatttgaccggggaacccccagccctcgctgcacctgagggaacccagcaccacctgcgcatggcccagtctgcccagagggcctcagtttcccatctggaaagtggaggaattgggttttctggatggggcagcagcaggtgggcaccctgtgtggccgtgagcagggtcctgtcctgggctggcgggtcagcagctgacatgcggctccctgcagggaacaggtggcagtgccaggtctcggtaggagccttgaagtggcttcccctccctgagcggcggcttctgcccggagcccccaagaacatagtctgaggccactttggccaataaagtctggtagggcatcaacactgggggccagctcagtggcactgctgatgggacctgcacggctccatgggagcagagagactggtgggggtaccaccgcacgatgtcacaatgccctgtctcctgggctcttgctcccaccccacccccaacccacaacccctgcctctgcccatcagcctggccttggtaagtgctgccccagcctggggaaggaatgagcaggggagcctagggagcgtcttcatgggccctgtggcctcccatgggccccggttcctcgttggtgccattagaacttgttgctgggactgcgggattcgggccacatgcccgcaaagaactccatgttccacttagaggctgcagagtgcagtgccaggggtgccttc

SEQ ID NO: 132036 - DNA, 1049 bp, Homo sapiens
gcccgggcggccctccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgtactgtgactgggtcaaaatttctgtctcttgatttggatagggtggtcgggcagtctctgaagggggcggggatgctgttgctaagaagtagtactttcagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaagg

SEQ ID NO: 132037 - DNA, 1031 bp, Homo sapiens
gggctgggtggtagctcaggacccctgcggcgctgtaggctgagagctcccaggggaacagggctgcgacgagggagtgcctcggtccagctgggtctttctggttgccagtggactatgccccactctgagggcctcactctgtgccagttgccacagaagagtggggctccaaaggatgagagcgtgatgacctcagcctcccactgtttgacattacaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacgtgagtgagcccatccccagatcagcccttcctctccatcctaccccccaccctagaactaagagttccaggctgggcatgttgctgagtctaacagtagctgtgtttctgggtccttcctgccaggtggctggcctggcctgggtgtgcttggctgtgttcctggaaaaacaaacaccctcccatctcttcctggaagcctgcaccctcatatcagccaggccctggggccaccctcccttttgactgtccctcctgccatagtcccacccagttcctgcacttggcacccaaccctggggtgctggttccctccagagcctcctgacagcctggcttcctacagggatacagcacagacccgcgccctgtttgagaaggtccaacccacacacgtcatccatcttgctgcaatggtggggggcctgttccggaatatcaaatacaatttggacttctgggtaagtgagggtggccccagcaagcactggaaaccaggatcccaggttctgggaacttcctggcgggcttcccactctcacaggcccacattcccaccccaggaagtccctgaggatcagggcttggcacagcctggtgggggcagcccctgagggacccccagtcactcacacttggtgctgtggacaga

SEQ ID NO: 132038 - DNA, 1890 bp, Homo sapiens
aattcagaccttcttctgcttcagagagagctcatagagggggaagccaatccttgcaatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctc

SEQ ID NO: 132039 - DNA, 1039 bp, Homo sapiens
tgggcaccccaccagcctgggttcattgttcagataattacctctcatcctgcccggtggcccttggccagctgagggcttctaaccatcaccaaacagctagcagacggcggaaggtgctgttaaaccatagcgactgaggcatgaggtccagacgctaaaggcttgtgactttctcccctgcccagggcaacaaccccgtcccagggcagaactggagcctggcacttggccctgacagctgccctggaatgggggcagctcagccgtctgtagggtggaggggattgaggggcccttgccgtgccccaacctggcccaccctcatccagggttctctgccctgcacctgcctcggtttcccccttatggccagccgttccacacctcttctgtttggtcccttcttcctgcccatcttcccagatgtggcgccaactccctaggatggactagcttgtttcacagtggtcgtgggtgatccagacacctcccgggtgtggaggggaggctggacaatggtgtggggacagcaggggcctctcctctccgtcctgacccgcccctgcaggtggtggccgtggtgatggacatgttcactgatgtggacctgctcagcgaagtgctggaggccgcggcccgtcgggtcccagtctacatcctgctggatgagatgaacgcgcagcacttcctggacatggccgacaagtgccgtgtcaacctgcagcacgtggatgtgagttcccgggagtgggagattggggaggacccgtgggagagatctgactcccctccctccccagttcctgcgcgtacggactgtggcgggccccacctactactgccgcactgggaagtccttcaagggccacgtcaaggagaagttcctgctggtggactgtgccgtggtgatgagtgggagctacaggtgcgcccgcggggctccctcacccccttctctggggcctcctcctgtaaccccagcaccccctttccacaccagggccctcctcgccaggagcccttgtcctgtagaccc

SEQ ID NO: 132040 - DNA, 1435 bp, Homo sapiens
cggccgcagggcacgggcgggtcggggcgcgggccgggggcgcgggctggggctggcggcgggcgcggggcgcaggaatgcgggcgcgccgcgggtggggctgccccgcccccaggtgctgcccgggcaggcaggaggcaggagcgacgggcggggcgggggcgggcgcgtgaatcaggccgggcgggccgcggcagggagtggctgccggaccgaccggaccgcgaggccgctgggcggcggtcggctcctgctgcccctgtgccgagaccccgcgcacctggccaggtagggcccccctcccccggcccgagcggggcggggcgaggcggggggcgggcgccccttggcgcggtcccacttgggctacccttgcgcccacacctgggccggggccgcgcgacccagagaggggcggtgggagtggagcgcggccgcgtgcgcggggccggggtggcggggctgctcggacagggggcgccgctgtgcggatatggacgcgagcgcccccgcacgacgccggcccgaaaagagccgagggggaaggggcccgggatccgggtcgagcctgcccggccgtcccgactcgctcccgccctcgcggcctagctggagtctgggtgctgggcacggcctggacccttccctggggacatccgcccgggccgccgtggactggggtggccagggtgcggcctggatccccgcgtggcgagcagggcgagtgatgggagtgctgcccctcgcgcccacgttcctgggctggggtgggcggatagggcacccagcggccgcagccgcgagctcgtagggtgcactgaccccgttgggggctggggtgcccactccgcaagttatcactgagcgacttccggtctgtgagccccgtcctccgcaccccacctttccgccgcctagagcctccgcgccctcctgcgcccatcggaacttggcacaggttcaccccactttgtgtaggaactccagatccttccatggggtcctccttccagatactcaggaaccccacttcctgccagggtggagaggatggggtccttgaaggccagctgagggccctgacttcgagtcagaggtcaggggtcagcaagcagaagagtggattcgtgctgagtcattgcccatgggtgggttccgcgccctccctcccttgggcagacgtttggtaggcaaatgtgtgggcatgcaggccactggggtgctccatcttgggctcgggagtggctgcagccccgtccatagcccaggagacacgtacccatgaaaggagacgacgtgaggaatgaagcagttggaggtctgggcatcaccctgtgaggacgaggcatgtctgctgggagggctcctggccacgggggcttccactgtctggatggtccctgcccccattacacacagcctggagcctggacac

SEQ ID NO: 132041 - DNA, 1238 bp, Homo sapiens
cagggcctttgcggccctgccttcttccagacctgtctatgacatccaggtacctggcctccaggcctctgcatgcctgccaccctgtccgtgcctgccaccgcccccatccgctcccgcagggcctccccacgctctgccgtggccctgcctcttcaccccccctcccccttcagccgggctctgtgggcctcagggctgggagcccacccgtccacctgggtggtttggggcagggctggcaccggcctgaccaacactctccccatcacagtcaccggactttgctgaggagttgaggtccctggaaccatctcccagccctggtgagttggggccgggctggggtgagctcccaggagcccagctgccctcagctcactgcccacctgtccctgccctccaggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcccgtctgcctgtccatcccccacccactagcacagacccttcctgccctccgaggcgaggctgagctccgagggctgcaccctcaccgtccctcccacgtctcccgctgcgcctcactgcgcacgggtcggccgggcaggctgcccatccccagcagggcctcccccaagtgcctgcagacccatgtccgccggccggggcccgggactgccggagtcctggactggcacacgccaccgctgcccccacgcacgcagcacagatgcagcaccgcgccccggggcacacgttttattgggactggggccagcactagaggcctgtgcctggcagctgcacgcgcactgggagcagcacctgcagctgctcagctggcggccactggaccttggtgacgaaaaagaggcggaagtgctccagccgctgctcctggaactgcgtggg

SEQ ID NO: 132042 - DNA, 1773 bp, Homo sapiens
cagggctcatatgctgcgtctgctgctcagctctcctgacctttgcgtgggaactgctgctcctgggtgttggggtgggggtgtgggtcagtaacccagcgaccttaggtgtgtgttgggctgtgcagatgggccggaggtatccaggagcggggccatgtgtggcctggccgtgggggcatctgcttgcctcccgtggccagtgtgtgtcctggccctagggcttcccacaccgggtttcagaggacctggtaggggaggggtcggtgcccacgaggaaccttgtggctaaaggtctcgggtgatgtcagcgcctggggcctttcccctcgccctgtgcctcagtctccccatcctggagggagcgtgtggagcccccagcacgtggctgtctgtggcggcactgggtcctgaatacgcacgtggtccctggcccgcaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcggtgaggctggggcccagggccggggagggctgctctagagctgacagccgcactccagcctcaccggcagccctgcctcctccaccctcccctgcagggcatcttcgtctcccgcattgccgagggcggtgctgctcaccgcgcgggcacactgcaggttggcgaccgcgtcctctctgtgagtggggatggggccccgccccacccacccatcccccctgccccgccccgcgccctctgtccccttctgcccttgggcctccctgattcgggcacgctctcacagattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggtgagacacaagcccccacccaggcacccacccagcttcagctgtgggcactggccttcccaggacctgctctcttatggccttgcggcccactccaggtgggaagccggcctgctcgccctttcccctgcagctccttgaggctggggctctgccccacagccagactcctcagtatggtccccttgacacagtctcctggctggccacatggccacagtcagcgaggatattgtcctcacgctgcgtgcctgcctgggcagcagaacactggtggcgcagaaatccccgtgggcattagggcagcccccgcccgccatccccaaggaccgggacggactcttgggagccctcccacaccctttccctgtcctgaccgaggcctgtccttgtcccgccctaaatccccaggagatccgtctgccaagagctgggggccctctggggcttagtattgtcggaggc

SEQ ID NO: 132043 - DNA, 1004 bp, Homo sapiens
ccacgtggggggcatcccaggtggccagcctgtgagtcgggagctccgtcgaagcctgaccccacttcccgccgcaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggaggtgtggattggcaggaaggaggcaggaggctgggcctgctgggtgggggctgcctcccctgcggggcctcagctgggatcggttttggtgcaggcagtgcctgggccctgctgatgcttcggggagctgccctgtacagagtggctacgggtggtgcagggccgtgctgctgggggtgccctggagagctgcctccctaggtggggttaaggtctcccctgacggctgggctcacagagcccacccccaccctggactctcttctgacccccgtgggctccctggtgtgaggccttggcgcaccccttcgtttccacctggggcgctgcgtgtctccaggatgagcccctggccttcagcttttctcagggctgagacacgcgcccctcactgggcagttagtgctgagtctttgtgtggcggggaggctttcggagcccgtctgtggccacactgtttagtagggtcttcctgtggaagcacagccacagagctggggccaccctcacccttttgtccgcacagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggc

SEQ ID NO: 132044 - DNA, 1105 bp, Homo sapiens
gtcctctgtggccacctgcaggcctcgcgcgtagcactgtgcctgtggtactgtgttattgtggggagcgtttactgagttcttgctgcagaaccaggccaggcttgttgtcaggatgcagtagcagaggccagtgtgggcccctggagggtggcagaagtggttcaggggctgggtgggccctgaggtaagacacagggtaggggattggggctttgtctggtcgccagcaggtgtcttctcagagtggaggctggtgtgaagagtagagggaggcagccacagtgggcgtgtgtaccgtgtgtttctttcctttttttgcaaatggggtgtcgtggttagaccccaggacccggtgtgacctggagcagacagaggcctagggactcttgacttgtgacactcacgtgtccaggagctcttctctgctctgcagtggtctctgccacagagtccgtgtcctccctgcccacagccttttttccggctgctgaacttgcgcaagctgggcctgagcgacaacgagatccagcggttgcctcccgaggtggccaacttcatgcagctggtggagctggacgtgtcccggaacggtggggagcctgggcaggggctgggtggggtctggggagtgtccgctggggctgcagacggcctgcaggccatggcatctgtccactgtgaccctctgtgacagatatccctgagatcccggagagcatcaagttctgcaaggctctggagatcgcggacttcagcgggaaccccctctccaggtgggtggcagcctgtggtggggtcggtaggggctatgggtcccacagccctggactggtcatccgagggcctctgcttcctcccatccaggctccctgatggcttcactcagctgcgcagcctggctcacctggccctgaatgatgtgtctctgcaggcactgcccggggacgtgggcaagtgagtgccttctcaggtggaactagggtggggtgggggaccaggattggccctgcccctgctgccactgctttccttcctcttgccccagcgcctggtctctctttcagcctcgccaacctggtgaccctggagctccgggagaacc

SEQ ID NO: 132045 - DNA, 1050 bp, Homo sapiens
agtagcgcccgacacatggtgatgcagaagctgctccgcaagcaggaggtaggcagaggggcagggtggtggcgggggagagggtaggggggcggggccgcagtgctcagctgtcttcccctcggccctgccccacagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaacgtccgtgtgtctgccgtcggtcctgtcaccgatcctgggcgtgtgtccttagggggtctagggcgaggaggcagggttgggggggtctctggacctgcttcctgttggcaggaggggcctgccgtgggcgagacctgggcagggggttggcgccccgggccccgtcccgcgggtggcggcggctgggtgggcggggctgcctggggcgccaggctctcgcgcgcgggctcgcagccgtccccgcagggtggtgctgagagaaggctgggcaccgggacaccgcgacccgctggacagcgcgcgctgccagtgcttttgtgccgcagagccggccgtccaaggcgggcgggcgggcatggtcgcttcccgggaggaggctgtgcgttaagattcgtggccaaatgccgcggggccaggggccgggctgaagaccggagggcggagggcgccgcctctcgtggattgtag

SEQ ID NO: 132046 - DNA, 4487 bp, Homo sapiens
gtgaaggagaacttgagcttgctgctgatggattcccctgctcccttaccagggcacagactccatcaagatggagaacgggcagagcacagccgccaagctggggctgcctcccctgacgcccgagcagcaggaggcccttcagaaggtgagcatggacctcccagggcactgcaggtgtgggacagtcaactgggggcaggggcaggggcggggtgcggggcaggcctgtctcccatgggctgggcccccagtgctcctcactgccgcctctctcaggccaagaagtacgccatggagcagagcatcaagagtgtgctggtgaagcagaccatcgcgcaccagcagcagcagctcaccaacctgcaggtgagccccggccggagcctctaccgccctccccaccacagccaccatctcctcctcttcacgctcttcctcctcctgggcctgcggccgtccccgcaagctgttacagtgctccgattctcaaagactcatgctcgggacccccggggtcctctctgaggcacgagtggcccagcctttcccacctgttgctcgctggagcccctaaagcgccgcagcccctttcttggctgcttggctgcagctctacccttttccccttcctggtcttcacactgtggcctctggtctctcccgtgctccctgccccagctgtgcacagccgatggtggcagcatgcagggcgtgggcctccctgcccccgtggcctggataagactgctcaggccctcacccctgcagtgagtccagaccacctgggctcagccccaggactgaggggacagtctggaggcacctcccttggggccctgctccaggcctgtggccggaggctgcgataccttcgtgggaagaggccggtgtgaggccgacaggttcctgggcctcgagcctcacgcccccccgcccagccctcagacattcacgctaccaggagatgtcctggccattcactgtgctccactgccctcctccctccctcccttcctccctcccttcctttctgccccagccggcccagctgcaaggctgcagggcggggcacatggggcgctgcggcccccctgggcaggtgctggcggccggcagtgtgggaaggcaggcggcctccctggcagggcggggactccgggccttgccgctgtctgcgtgaggtgttgacgagagcgggagactgctcggctccaacagactgaactctgtctttactgtctttcagatggcagcagtgacaatgggctttggagatcctctctcacctttgcaatcggtcaatagaaatgctcacttcttccggggctcatgtccttagtcagggctagaggggggcagtgcagcccacgtgctggggaccttgctcccctggccggccctgcccgccagctctggacgagcgcagcagagcgccaggcgtggtggggccagtggtgtgggcacccacccgggaccgcccctggggaggcctccatctgctctgagggcccaccttaaaactaatcggccaggtaactgcggagggcagccggccagggcgggtagctgccagcaccaggcccgtctgcgcccacgccacctgcacgcacggggtgtgcccacggcctccagccccgtcagtctccaggctgcctggctcttgggttggggtcaggcccctgaggagagaggggtcctaactcatggccccatcagaccctggagggaggatggttggatggggtgggggtggggggacccaagcgagcaagggaagggcaagcagggccttgtgcctggctgtcagcaaggggcagaggccacgcagccagggcggaggaggcaggggccatggctatggccttggctgtggtgggcagaggagtgtgggaaggaggtgtccctcccttcccccagaggcaggctcaggaggaggccaggtcccatctcggggatcctgaggggaagatgtggacccttctctgggagcctctgttcagaggggtcatccctgtgtgtggctcccatggggcaacacacgccttgttctctctgggaagcatctgaatgggagcccgggctgggggtctggtcagggagagagctcttggcctgcctgggggtggggccccacactgaaaaggagacatggccctgtcttgggggaaccatgacctgagggacaggcctggtctcgtgtctggggagcctgctgagtgagggggatgtgattccacctttgggggggtcttgctctgagtggggagcctgaggtctgtcagggggcccagtgtgaggagaacacagtctcgttttcagggaatgcctggtttgaaggaagatatctcaccttgggaagtcccttgatgtggagagatgcttccaggcccctctccacgggatggggaggttcggcctgcattaggccagctgatgtctaaagagggaaactggtctctggccacaaggccttttgtggagaggggcagggcctggctccagctgtctgctttgcctgccctggcccacaggctccctgtggcccactgcgtgtggctctggaagtcccctgtctggcatgcctcctgtgaggtgacaggggcgagaacccgtccctgagggtgtggggaggtccctcagcgcaatagccaagctcacagccaaggccctggaccggccaggcctgtcaccagctctaaggagcctgggggcttctcgtagggtctctgctacctcatggtgcccccgggggccaggccagtggtctcgcctgggcccgctctctcggctgggggcacaggctccaggcagctcctttgtgaggagttgcagggcactgggaaggcacagcatgagcccccacctgagttggcccagcatgagcagctgctcctcgttctctcttcagggagcccccatctggctcctgagctcctcccctggggtctcttctgggcagtggctgccctgtcttctgacctcctctcttctggccaccaaaccagtgggtccctccagcttggatggttcctccttccctcttctgtcgtggtccttggctgggacagtgggaggatctcccagcccagcctgggatacccagcccccagactggaggggtggtctgggtgggagggcgcacagccctgcctcctgaccatctgtcggctttgctgccgcagtctgcctgggaccttggcgggctggggtgcgtcctgtcctgccgctgggcctggccttccttctttgggtggcggggtcctgcgacccccacactatgactgcagggatggagcccgcacctccctgtcatgtggggagccctccccacagcagggctgggtgggtgggccaggaggggagtgggctgcccagcttcctgccgcccctgacgagccagcggttctctcccctctgtcctgctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaaggtcagcaggcttggtccgccccggccacttcgggctcgcccccacccctgggctcgcgcagcctgacaggtgtgtccctgtgtctagggctttgccttcgtggagtatgaggtccccgaagctgcacagctggccttggagcagatgaactcggtgatgctggggggcaggaacatcaaggtgaggcagggagccaaggcctcgatcccgcaggcgtgcagggctgcccctccacggaagccttttgtggccgggcctgggttgaccggtctttccatctcaccgcctcttccccaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattggtgagctggggtggctgaggcgggatgggggccacctgaggctggggctggccctgctcactgctgctcctgcccacagagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggtgagggcccacacagctgtcggcttgagggtgggcgggctggcccctgattccttggagactgattcaaggtggtcttgagtagccagaccagggactgagcacggtgacct

SEQ ID NO: 132047 - DNA, 1045 bp, Homo sapiens
cggggcctggagctcgcgcgttcttaggcatgagcgtcttgcaggaagggtgggccaagcttcccagaactcgcagtgcttgaggagccagaaggacagatttcatttcagacctctgtgttttcatttaaataaaacagtgaagcaatgcgcaagtcaaagcacaggtctggttgggactcagccctccccatcttttttcggccccaggctccagagtgggtgcaggtgggtcttggtctgttcgatggcccagccttgggagcaggtcctctcagaggtggagctgggcctgtggctgggtagttgggttctttgtgcttctccatggtagcgcccgcctccagagcattccagtggggcctcagcaaggtggcctggcagcctcttggggctgggccctcctcttggtcccccaggcacactcagggggtgggactgggacatggtatgcagcttggatcctgggagatgtgggggctggtgctccctggcccttggctggcgcccagccggccattggttggtgggagaagggccttttgtttaccaagacaaagaggagattgaaaaatgtctgggggctgagggggttggcattgattaccatggtgacagcctgctctcaagtcccagcctctggctcttgggccctctttcccactaaggaggaatgggcttggggccagctgtgagggtggtgaggacaggcctagtgtgagccggactggggcacctggtgctgagggtggtgaggacaggcctagtgtgagccggactggggcacctggtgctgagggtggtgaagacaggcctagtgtgagccggactggggcacctggtgctgagggtgattaggacaggcctggtgtgagccggactggggcacctggtgccacccacagccagcctttgaccttcagggactggttggggctctggttgcctggggaggggtctccagggcttcctgccctttgagcctgggccagcatcccagcacttggcaggcaggagggggttcttggggcttgggccagcctgt

SEQ ID NO: 132048 - DNA, 2068 bp, Homo sapiens
tgcttcagctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaagggtaggtcttctggatgcatcttttcactttgacgcatggctccgttctcttcactgacagccagaccagctctcatttggggtcatcacccttggggttccagttcctttcttctgtaggccccagcctgcaatgtcacctcatagagaggcccccggctgccatggcctggcatagctcatagccactcctttcttatcctgtgctttcttcgtagtgctggtaaaccacagaagtcatctttgattttggcattctttgctggcagctgacaccaggctcctgagagagacgtctttctctcttgtctcgtgtctgcggcctctgcagcgctcactgtggagcctgggcacgcagtaagcagtgttcattgtgtgaagggaactgacagatagaaggcagtgtcctgcagccagctctgccctgggtatctgacactggatgttgttaatactgatgagtgctggaacctgtggcttgctttgctgctttccatgtgcagggactgcaggttgtggggttgggggcgtgttgggatttcactgaatcttcacagtagccctaggagacaggccgtccccattcccagctgaggagcctgaagccttgagaccttgggaccttcagtcattcgctccacattattttttttttctttttgtgtgtgagacggagttttgctttatcgcccaggctagagtgcagtggggtgatcccggctcactgcaacctctgcctcctgggttcaggcaattcatggtagcacctcagcctcccaagtagctgggattacaggtgcttgccaccatgcccggctaatttttgtatttttagtagagatggggtttcaccatgttggccaggctggtctccaactcctgacctcaagcaatccacctgcctcggcctcccaaagtgctgggattacaggcgtgagccactgcgtctggccacattactttttaaaaaaatcttttttttcatagagacagcgtcttgctgtgttgtccaggctggtcttaagtgctacatcggtctcccaaagtgctggagttacaggtgtgagccaccacgcccagcccctacattgcttttcttgttttctgatggaaatactcttctttgctctgggctgaggaaaggcagtcccagagttggcaccccagagcccctctgctgtgccgcccctcagaggggcttcccatccctccaagcactgctgcctggtgctgggggcatcctgaccataaagacgccattttaattgcctaaagatggcagtacgtgactagctgcgattgtaaacaccggtttcctccaagttctcccagcgtctggttagcacagaaccctaagctccatgcagctgggaacttccatctgccaggaatggcatggggtgtcctgtgtagaatgcaccagtgggccggcttttcccaagaaaatgtttttccgagccacatcccactgtcaacactgttgtggcttacttgttggttagtgcagtgatttgggggagcaggaagttacaaaagtgcccctcagttcaccctgttcacgggtatctggagactggtcgtgaagtgatctcttgctgtgggcaatgagaggcagccttggctgggcacagtggtccacgcctgtagtaccagcactttggaggctgagataggtggattgtttgagaccagcttgggcaacacggagacccccatctctaccaaaaatacaaaaattagccaggtgtggcggcgcatgcctggagtcccaggaggcggaggttgcagtaagccgtagttgcaccaccgcactctagcctgggcaacagagccagaccctgtctcaaaaaaaaaaaagaggcagcctctgctctggctgtgcatgcagtgggaggggccccttgtttcc

SEQ ID NO: 132049 - DNA, 1090 bp, Homo sapiens
ccggcggccggctcgcggcctcagcttccggcctgcggaccccagcttccggcggggcggggcgggggcctgggcgcggcgtgtggcccttgcgggcgagcctggcggggttgcgttcctgtccgctaggtccggcaagcgggggtcgtcgtcctccctttgccgacgggggtgtgcgccgtggtcacgacggaagcggggttctgggggtgacgcgtgggccttcgggttgatgggatcagaaggggacgggacctgtagaaaggggcctgcagctcagagcatggggcggccttggctcactacgcctgcagctgtgaattcgttctccggtgctggagagggatctggttatctccattctcttgtctccacgtggaaaggaaggacgtgcgctctcatcctacgtgttttgagaaatcgcattgtccccagctctgcgggaggatctggggacgcagtggggaaccagacaggcagttggaggtctagtgcgcaccagaagccagttcccacccagggtgccatttgctgggcgccctagggagctgcgtgggcatccagaggagtgagtcgccccctgctctgctcagtgcccacttccccgggcagggcaggcgttattaacgtagagggagaacacccatgcacacaacacatgcacgatgaagtctggtctttccttctcaccacttagcttataggacctaatccccttttggacctttctcagccgcagtttacccctgtattacttgtcacccttcccccagcccacacccagcgggatgggataaggtctgtttgagaagacagcttgggcaaatggctgaaggctggactggcaggaccagggagtgtccttagactgccattgccaggcccccagcgggcgggctggtcccatgtcccactgaggcagaaaccagttactagggggagagaggcatttacacaagatacccagcttgcgagggcagcccagtgtgtgattcacaggactggctaactccactctttctactatgtcctttctcttgaagccacaggagtaagtgacctttgaggggcactccagagagaaaggatg

SEQ ID NO: 132050 - DNA, 1119 bp, Homo sapiens
gtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagc

SEQ ID NO: 132051 - DNA, 1047 bp, Homo sapiens
gagcaggtgggcgcgggggttggggcacggggtgacaccgccctcccagagcgggaggggcctggaggctgcgcggggcgtgggggcgctgggagagcgcggcggctggaaacctctccgcggcccctcgcggcccgcgaatcagccacccctggacccctttggcctggcgctcgccctgggactccctgagggccagtctcctcccaggaccacctccccatgcctctggactcagccgctagcttcctggggatccccctcgaccccctgaaacctgctccaaatccccttagcccagcccttggataggagcccttggctcctgggggcagctaccctccaagccccaccttcccgcagagtggctcagggcctgcagcccacgcttgggcccactggaaaggtgtggacagggaccaaatcctcacccacaaccctgacacacaccagggcacacataaccctttattcacccccaggtaaaccaagggaacatgccagggcttcagagcaccttcctagccatggacacggaggagggggtagaggtggtgtggaacgagctccacttcggagacaggaaggccttcgcggcgcacgaggtgagaccgctgccccctcctcatcctgcttgggtgaccacctgctgaccacccagcgaccaccctccctccccaggagaagatccagaccgtgttcgagcagctggtgctggtggaccacccgaacatcgtgaagttgcacaagtactggctggatacctctgaggcctgcgcgagggtgagcacgggcaaggccccgggcaggcagagaccacagctaggtggggcgggcatggggacgaacccgcagctggtggaaatcctgagctcgcaccgtgcaggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtg

SEQ ID NO: 132052 - DNA, 1045 bp, Homo sapiens
tgggttcaagtgattctcatgcctcagcctcctgaatagctgggactacagctgtgtgccaccatgcctggctaatttttgtacttttagtagagacagggtttctccatgttgcccaggctggtctcaaaacgcctagactcaagcgatctgcccgcctcggcctgccaaagtgctggggttacaggcatgagccactgtgcctggccagcttttttacttcaggtgattttttacttcaggtaatatgtttttcacttctaccatttccacctgctgagaacgtctgtcttttcactcattcttggggtgtccactcttgcctcggggagcatcgggctggaattgctgctgtgaaatcttttcctggtccctccagcatctgagtcctggggttctgccagcaactgtctgtcttttcccctgagaccggatccaatttccagtccttggcatgttgggtaatttggggttgtatcctggatgttttaaataatcagatgcgaggctctgagccctgcgagaacgcgcttgagaatgttggcattttcactttggcgggcactcatcccggctgggtcaggccacaagccgtatcccagcggctgtgtgcagtggatccgtgttggctcaattctcaaggctgttgctgtgcggcctgttccccacacgtgctgctcagctcaggcaagcaccgagcttgtgttgtttcatgctcagcgtggaggcccctcctccaggtcgctgctctgtggggttcccatacactcaggctcctaggaggagtccatttagaaagccagggtttttctcagagtcttagttccttgtgctgtcatccatttcacacgacttgggccctgctcggggcaacacagcaagagaaaagacagggaaaataagagagggaccttgcacacacacgctctggaccacagagccctgtgcccagctcctctgtcaatacaggtggaatctcgtgcaggatcgcaggggtctgtgatgccaccaaagagcaggccgggacagggttaggagagaaagg

SEQ ID NO: 132053 - DNA, 1045 bp, Homo sapiens
aggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggac

SEQ ID NO: 132054 - DNA, 1038 bp, Homo sapiens
agggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccaccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcgg

SEQ ID NO: 132055 - DNA, 1191 bp, Homo sapiens
ctggagtcccgagaggcctcccggcgccgcctgggtgcctgcgcccacatggtccctctgagctggcacttcccttggcacccccgcggcagagtgctcctgggcagactcagctcctcggggacactctagctgcacgtctgtgggtggagcccagcccgggacagcatgggattgccccatgaccgcatcttccctcgtgcccaccaggccatgcggggtccctgattgagcctttctgtcccctgcaggacagaggtggacctcagcaggctctgcataaccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcgaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaaga

SEQ ID NO: 132056 - DNA, 1011 bp, Homo sapiens
cgccgctcggtccgcagtgtctccgcgcgcccgctccgcccgcatttcaagccccacaggccccgcccccgtctagggcggcgcccaggtcggggccccgacgcggggcggggcggggcgggcaggtgccggaaaccccgcgcggcccgggcctggcgcttgcaccccgggcaaggggcggcggctgggcagccgggaccctcccctcgtccccagcagggagtcaccgcgaaggaacgcagggcgggcgcggaggcgtcctgtgcccttcagaacagctttttttttttgggaaaggagtttggagtgaaacgcggaccggccagagcggcggtttctatccccacaagccactaatgcggtgcgggctggtgtccctgcctccagccccgaccccaccttgtctgctcagcttcctggggacgctgcttcacgtcgtgtgtctgctgggtccaggggtcttcaaggctctccttggcaggcccccctgcccccatgacgttgtaagagctgggatgtcctgcctggagcagtgccaggcctcaccccccggtctggctcctccacctgggcacagagaatgttccctgtcaccctgggagtacctggtcccctctctgaagcccatcctggcacccaccttccaaggctggggcatgccagagacactgggcatggaggctcacagcctcgggggctggcctgggggcagcctcagcctggcacgggaaccttccatggatcttctggagggccctccccttggctgccccgatatcccaggtgggcagggccacggaagtacagggcccaaagcccctcctcctctgtccccaaggcccctcctcctctgtcccgtagtcctggaggtcctgagggctcaggtgctccccacccccacaagtgcccccttctcccaagctccagcccccacctctgcctgagtcattcttgaccagaaaatcatccagagccagccagccacctccaatgcacaccatgagggtaatt

SEQ ID NO: 132057 - DNA, 1040 bp, Homo sapiens
cgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgg

SEQ ID NO: 132058 - DNA, 1048 bp, Homo sapiens
caaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcatt

SEQ ID NO: 132059 - DNA, 3694 bp, Homo sapiens
gagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggtaccgccccctctacgtgcgacgggcgggtgggcccggggatctgctttggtgggtgatgggtgctcctgggctggcggtccctgatcacaccctcttcttctgcagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagc

SEQ ID NO: 132060 - DNA, 1192 bp, Homo sapiens
cccaacctccttctccccaaggctgttcttctcctgaagcaagcctctgaccacagggtcagctgacccccagggttgggtctgggcttggcaggcagcaccctgggtcgctgtggcttgggttccattcccttgggctattgctcgagccccatgtcatggccctgagccccgctttcccgccaggctcaagaccatcagcctggtgatccgcggcacgcagggggccgaggaggtgctcagggcccacgaggagcagctcaaggaggcccaggccgtgccggccaccctcccggagctcgaggccaccaaggcctctctgaaggtatcgtttcgaggcttgggcttcatggcggggtgggggtacagcgggcccagctgaagccgcacatgtccctcctgtccccaacagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggtgggcttgggtcggtggggacggggcggctgggcgtgccctgcggccacggctctgaccacaccatcacccaggccctgctggaggagatcgagcgccacggcgagaaggtcgaggagtgccagaggtttgcgaaacagtacatcaacgccatcaaggtgaggcccagccgcctgcaccaggccccaagtccgggaccgttgccaggatgatggcgggctttccctgagcctgggccatgccagggaaagcccatgtgagggtttaggggctgggcaggggccatcggagggcagagctggtggctgaccgcagtgcattgccacaggactatgaactccagctggtgacgtacaaggcgcagcttgagccggtggcctccccggccaagaagcccaaggtccagtcgggatcagagagtgt

SEQ ID NO: 132061 - DNA, 1050 bp, Homo sapiens
ccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgaggtgggtggcgctgagcgatgggcagtgcgggggtgggccgggcccagccactgcagacctcaccgtctcatctgttgcagggccagctctcccccgccacccggggtgcctaccgtgactgcctgggtcggctggacctgcagtacgccaagctgctggtgagtgggggcagggccagccgggggaggtgggtagcccgcggcctgctgacacgcaccctcctgcccacagaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggtgagcggtggcccagctgccctgaaccccacagccccctccccagctgtgccctggccgtcccctatggtcagagaccagtgggggccctgggtcgagtttgctgggagcgtggcagagccgggtgtggccggccgtccctgagaccctttgctctggtgccaggcgctgatgcgggagctggagctgaaggagaagaagatcaaggagctccaaaatgctggggaccggctgctgcgggaggaccacccggcccggcccacggtggaggtggggctccctgggtaggggcggggctgcggggggggccgtgccgggtccccaggcggggcggggcggggcctgaccgggacctgctgtcccgcagtccttccaggcggccctgcagacgcagtggagctggatgctacagctgtgctgct

SEQ ID NO: 132062 - DNA, 1050 bp, Homo sapiens
ctgaaaggttcttccggagccgacctggccctgcctttgggaccagggctgtcccaggtctggtgggctggggtctgaaggcccagcgccccaccccctgccccctgcctatagggcctgagtgtggcccctgtctacagggagcggtgcaagcaggccagctcaaggtgccccctggctaccacccgctggatgtggagaaggagtggggcaagctgcacgtggccatcctggagcgggagaagcagctccgcagcgagtttgagaggtgggtggggccctgtggtggcaggggaaccacccgagggtgtgtcactgcctgggaaggaaacccccctccccgccccgcccccggcgggggaacccaagctcccactcgccttaggacagtgggccacagccagggagaccggagcgggaggcgagctgcagtctgtggccagggctgtgccggacccggccaacgcggccccttccctgtgctgctgctgcaggctggagtgtcttcagcgcatcgtgaccaagctgcagatggaggcggggctgtgtgaggagcagctgaaccaggccgacgccctgctgcagtcggtgagggggtgtggggcaggcagtgggcgggagggaggccggaggagcctgccccgccctgcagccctaaagccaggagggggctgtccccctgggctcctggggcaggggcaggggcaggggcggggcatgtggtggggaatccaggcctgagctcctccctcctcgtgtgcagctaactctcactgcctgctttgggcagagttggtttctggccacggggcagaacccacgctgggctgccttgcccccgccaggccccctccccgacagcggcttactgttaggggaggggttgggggagggcccaacccactgctgattgcccaggaggacagggcccacgtggcattacaggaggagttacccagggtgggtgatggaggatgaggcccaggaccccacagacatggtcatgggggtctcggttcttggactgggctaagtactctggacttggtc

SEQ ID NO: 132063 - DNA, 1049 bp, Homo sapiens
gtgtaaagccaggctgccagaggccccacctgccagcctgcaaccatcgatggagctcgacccccagccttttccaggcctgggggttctgggccaggtttagtggtacacttgtgggttcctcttatgcccactgcccttccactctgctccatcccagctccgggaggtgcagggtgcagcctagccctccccagctaggggagtgggcacctgctgtgtggtggcagtgagggttgggggttctgagctgcgtggtggcagctgccaccggctggagtggctggacttgtggccccgaggcatggccagtcccagcagcttcccaacagggaagggccctggagcccggtgctgccctggctggtttggtggccccatgcactccccctgggtgctgagctacccctgcccctgtgcatgtggctgtgggcacagagcaggcctggtggctgtggctgagctgtggcctcctctctgctgtgagcagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagtacatggccccgggggcagggggctgtgggctgggggcacccccacagcgcctccactaggcaacttcagacacgttggggcagggaggagggcaggaggaacagggatgagtgccagctggccgcctcggggtggtggagttcagggcccagccccaccctggtgtccttcagaagcaccaccacttgatctcaagactggagggcccgcgggctgctggtcctcacagccaggtgcatgtgccctctgtggacgcctccggaggggcctggtggggagggtggctgcagggaaccccagctgcctggcaccctcagctctgcgcagtcctctgtgctgtgcccctgggcttctgggtgtgggggtggcagggtgctctcagctctgccc

SEQ ID NO: 132064 - DNA, 1050 bp, Homo sapiens
ctgtggctgccaccgccaggcaggaggaccccccctttagtgccactgccctccacacgaggcttcctggctattgtctcctcccaccccttccttccttccctcagcctgggtcgctggacttcccgagccctgatgggcctggcctggcccctgggccggtggcctccctttccctgcgggggagggtgaacctgggatgaggggctgctgccccctggggaagacccttggctcggttgctgcggcgctttggggcatgctgagggtggggcccgggagctgcagctgcactgtgggtgctgactgtgcctccccacagccccgggagaaggggaggatgcgtttccacaagctgcagaatgtccagattgccctggactacctccggcaccgccaggtaaggctgcccggcaggccctgggccccacccagacccctcaccaagccagccccgccctgtgggccgtgaccgagagcccctcgctcacaggtgaagctggtgaacatcaggaatgatgacatcgctgacggcaaccccaagctgacccttggcctcatctggacaatcattctgcacttccaggtagaacggctgcccccaggacccccaccccctgcaggagtttccagggtagcctgggctccttggctggcgggttgatccgctttctggctagggcgtggcctgggaggtgactggcgccgtaggtatggtggcacctgggtgccttcctgccagccgcaaccctggactggatctgtggcctgagggtacaggcctctctctgaggccacctatccgtgccctctggccctggctgggcagggcccagagcctccctgtggaggaatgcaggccccggtgcctgccctggggaggcttctgcgcagcacaggctgactcacccgctgcttgtcctggctgcacaggaaaccacaaatctgagagctgagcaggcagagcctggtgctggcacggcagctgagtcacacaggctggcaggacgacaggcagctaggggtgggtgggcagaacctggcctgagc

SEQ ID NO: 132065 - DNA, 1050 bp, Homo sapiens
gggccgacaggcgcccgcgaggctgacgggggcctccgagcgtcagatgtcgggcctggaagggcgaggaactctgcgctctggggaaggttcgctgccctgtcagcagcacacgcggcttcccttccaacaccccagcgggcccgggccctggctctgccacacccctgcttgggtctcagtctgtagaggccgggggggactgcaggacgggacttgtgtgccctgggctcagggtgcgcccaggaccctcccatttcctcgggggaagagtccggggtggggtggctgcacctggtggcgcctgggcccctggcacctgggtctctgctgtgtggctgggctgcgggtgagggcgcctgggtctcagtgtgtgatctgagggaggctttggggctccccaggcaggacctggccagccaggctgctgtgtctgcacggtggtcacctgagggcccccggggcttctcccaggccccaggtaagctggtcttgtctcccccagatgagcgggatcgtgtgcagaagaaaaccttcaccaagtgggtcaacaagcacctcatcaaggttggtggcgcatgctggtgcgtgtcacaggggctgaggctgtgggaggcgctgagggagggtggcccctgccgcccaaggctgtccccatgctgcctgtgtgctcacctttcatctctgaaacctgttattttctgtcctctttcttccctacgcctgctcctgcctctctcttcctcctcttccttctggtctttcctggtctctccttgcagcactggcgggcagaggtaggtgcctccgtggggcagggtgtgttccgtgggctcccgggagactcagcccccgcctccttccctctgggaccagcacccactctgtagatcagccactcagggcctattggtggctctgggggactggccacctcagccgctgctgtccccacaggcccagaggcacatcagtgacctgtatgaagacctccgcgatggccacaacctcatctccctgctggaggtcctctcgggggacagcctggta

SEQ ID NO: 132066 - DNA, 1053 bp, Homo sapiens
cctgggctttggcctgggtttccaggacacgggggagggaggaggtgctgaaggcggggctccaggccttctgtggacttgctgcagtcctgggccagtgggattcccttcccagtcttggggtttccatcctaggaccgtctccactagctgcgggacctcagccatagggtccacacctgtaaaacgggggcgatactcctcagagggccacggcagtgcctgtcgtgagggaccctgggctggcggccgagggtcagcagccctggacagcacaggtgtcaggcaggtgtgcagaggcacctgagctgggggtgttctgggtgcgtcccaggtgggagagccagctgagctgcagctgtagagggtgggtgtagcctggctgggtggggcgggtgtgtctgttggttttagggtcagaataggattggatggggcggggcaggctgggctgggagggaggggaggtgatgaggagggaagagctcagagcaaagaggcacccagaggcaggaagtagggaaggggagcttgagccaggcttgggaggtggaggcccctgaccgagcccccagcccacctggtcccagccctgccccgccccagcccttctcctcacccggtcccagccttgcccgagtccgtgtctggagtccccaccgtgccccttcccttccctgagcccctgccccattcctgaccctggcccggcccagggcggcatctttggaggcctgttagtggcagggagaaggctggaacaggggcctggctggggtgggctccacgtgggtcctggaccttggccccggctcccagtttccagctgtcgtggactccctgtgcccacctccctggctgttccgggatctcacactgtgcctcagcagagtggcagccccgttcctgcaggcaggagccacctggtcacggccgggcccccagagcccatacccagcaggcgcggggcttggcctcagggtagctgctggcccagggcttctgaagaggcgacagtgtttccagaggctttggacccagggaggggcggca

SEQ ID NO: 132067 - DNA, 1049 bp, Homo sapiens
caggaggtgtgtgctgcgaggcgggggggggtggcgcatgccgcaggggggcgtgtgcggagctggcagggtgggccaggaacattctgctccgggctcctccctgcggcttcccttcccgcctgcaggcccctggctggtgggagggaggggactcccgccgagccccgccccatctctgctggaggaagctaccgccctttcctgcccggagccggcttgggggaggcggggctggttgggtggcggcccagcgggggtcagtcctggcacccctgcaggcctgtgtaggagagaacctaggtccacgtgcttttaagaggccttgggatcattttgggacagtgtgggtatcgtgggttagtttggtggggcccttggagatctgggggggattaggttagggaatcaggccaggaagatgcggtcggcctgccgggagtgcaggaggtcagtgtgggggggtgcgctgagggactggccaagagggtagggccttctttgggcacagggctgggcaggcttggacccagctggtgttgttcccaaagccacaaccctggtgggtggagggtccgcaggtgctggtggtccgaggggcgtggccactgtggtccctacatcttcctggagcctcacctcctgaggctggccttttcctgcctggggctggcttcagagggagggagagccatgccgcagcgagctggccctgccagagggctgtgggaaccgtggctatgccttcggagtttccccgccaccacacctctgtgtacgcaggcgtgcgcgtgcgcgtgcgtgtgtgcgcgcgtgtgtgtgtgtgtgtgtgtgtgtgtgtttggagcctgcaccgtggcgccatggcgacggccccataaacccgcccccacaagctgcttgttggccgcctgccggctgctggccagcgcctcccacctcgggatcccccctctctcccactcccccccaccgccctatttataatcagttcccgggtttgccgggcttggtgggaaggggtgtgtcggcttggggcgagcagcgat

SEQ ID NO: 132068 - DNA, 1093 bp, Homo sapiens
ggctgaccccattagccataggggtggttggatcagagcagctgcgaagggtccctggtggtcgtggggggtgggtgagggatggagctgcagtgtcatctggcggcagtggagatgctggcgagtgggcagactggggggcgcagccaggaggacctgtggggctgcctgtggggcatcctgaggctgggtgggagaggcagagaccagggtgcaggtcggacctgtcatctttggagccagtgtacaaggtgcctgacccagggctgcgcagaggcgagacgcccggggaaggggcacactgctggggccggggaggtgggaggtggccgaccagggtctgggggcttgatctcagcagcctgccagcccaggccctggagttgggccggctgaggaagttactgggagatctggatgggtgggtatctcctgcagggcgcgggtaacggcttcaaggccctcgcacgtgtgtcccacaggctgttctaagcatggctcgttgcagtggactcggggggctgtggggtgggccgggggctgcggagctggggagtgggccgtccgagcgctcctggatccggcctggtgacctggcagtctggctggggttagcggggtcgcgtgccccagaaccacaggctgggggggaggggtgcgcggtgcggccgggagcatgcgcccggggcggccctgtccggcgcattgatcagctgaagccccgcccctggccggcaagccctgccccggacctccgggctcctcccccggctgcggcgctggcctgggcagtgcggtgcggggctggactctgcctggtggtggcacagccgccctcagccccggcgcagacatggacccctcgcgagccatccagaacgagatcagctccctcaaaggtgcggtcctggggccgggcccgagccggggggcgcggaccacacagtgacctctggctgggtgcagtccacgcagggtggcgggcagggtctgccatccctggggtgacactgtgggtcgctgagccagagccgcaggagaccccagactcgtccccctccgggctccacctggttcggggtcctactgggct

SEQ ID NO: 132069 - DNA, 1165 bp, Homo sapiens
aaatctgacaggctttctgtcctttcccttcctccaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcgggtgagtgacccctcaggactcctcaccttcagccccctcctcctactggggactcaaagtacctttcctgtgctctaaacctgcaaactccatctctgcaatggccctgcagctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtagagat

SEQ ID NO: 132070 - DNA, 1563 bp, Homo sapiens
tatgtctcctatgctgtcttcttcatctctctcatcgtcctcagctgttgtggggacttccggcgaaagcacccctggaaccttgttgcactggtaacccccaaacctgagcctctgtgcctgggtccggccatgcagtcccacacgcccactcttccgggcctggtcaccgtggttctccttgtgctcatgaggcaggggccggcaggggtggcatgggggcacacacccaaggtcagcctgtgtctcccaactgcagtcggtcctgaccgccagcctgtcgtacatggtggggatgatcgccagcttctacaacaccgaggcagtcatcatggccgtgggcatcaccacagccgtctgcttcaccgtcgtcatcttctccatgcaggtgaggggcctcccgtggctgggctgtggccgcaggggctgagcagctttcccaggcccagccccatggcccgttcctctcccacctgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcgtgagtgaggggtgaccttggccgggggcgggatgctgggcaggcaggcttgtccctcaacaccactgtgctgtcacctccagttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgccttcccctggtcactcttctccctgccactttcaacatgaagttgggaggggctccaggccctccctgctgatggagacacaggaccagaaatgaatagtggagattaatacagtgccaagcctctgcccaca

SEQ ID NO: 132071 - DNA, 1049 bp, Homo sapiens
caggcacagtgggctgctgtcggccctggggctggccctggctgacgtggtgcatgaggcacaggaaccctgctccctgctctacgcgcctgagaccttcgtgcagctggaccagaggctgagccgcctggaggagcagtgtgtggatgctctgcaggcccagggcttccccaggtgggctcccagggtgccctggacagagggcttacgttgtcctcaccacgcccttggtgggtgttcctcctgatgacttcccaggtggtcccggggtgtgcgagaagcagaacaggtgtccttgccgggcgctgggtggggtggggtcagggcagggggtttggtgtgagtgcccccaaccacctgctgcaggtcccagatcagcactgagagcttcctgcacctgcgctaccagggcacggactgtgctctgatggtgtctgcccaccagcacccagccacagcccgctcgccccgtgcgggggacttcggggcagcctttgtggagcggtacgtggcttcctgactccggatccctggcaaggggccctcctgtctggccgcctcactctgaccactccttgggtccccgcggggagtgcaggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaaggttggtggtcctgcctgtgccagcctgacagcacccatggggcaccgggatggggaccaagccctgtgagaggcatcggggagggtgctgggcccgggcgctgtactcacccgcaccctctgcagatgacccagtgctactttgaggggggctaccaggagacccctgtgtacctgctggcagagctgggctatgggcacaagctccatgggccctgcctcatcatcgacagtaacaggtgggctgaagtccggccagggtggaggatgtggacgggtccactgcggggcccctggtgcagggttctctggc

SEQ ID NO: 132072 - DNA, 1144 bp, Homo sapiens
tgtggccgtggaggggcttaacgggcagctgcccaaccttgacctgctcaatctcttccagaccttctgccagaaagggggcctgttgtgcacgcttcagggcaaggtggggctgcctgcctgcctgagggctgaagggcacagggtctgtgggaggggctgtctcatcctgtcctgcacctctaaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaagtaagtagtctctggtcccccctttccatgcccaggatggggtctagctggagcggagtgggggatggcctggtggctctggccagccgtgaacctgccccacacctgacagggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaagatatcctctgccccttgccatctacctgtgaccagcctccagtctcctcaactctaggctggggagagtcttccatcctgatggggggtggggtacgggggtgagccctgggtccccctctgggcagatcccgttacacctcttgttggggtccttgattgggctacgctctggaactgtggatgcagctgcatgaggctggaatgggccttgaggagcccgggggtgcccctggccccagtgtaccccttcccccatcacaggtgatggcacccccttctgttgttggaatgggcttctggggtctgactggtgtttagtgttgcaacttagcctcagctggtgggatggtggtggtctttggggatcccctggccccagggtccatctccaagagcctgtgtgccctgcagggtgtggggctggcctcgctcgtggcacctctgctgatctcacaggccatgggactggccctctatgtcctgccagtgct

SEQ ID NO: 132073 - DNA, 2379 bp, Homo sapiens
cggcggagagggatggggtgggtagtgggacagggtgtgcgtctggtgccctgcaggaggaggccattgctgggtggagaggtgggcgctgagagtcagatccccaggtagggctgggtggtgtcctggcaggcgctgagcggagatcttgcaggcagtggccttgtcgtcgaagtctggcctttcccgaggccggaaagtgatgctgtcagcgctgggcatgctggcggcagggggtgcggggctggccatggctctgcattcggctgtgagtgccagtgacctggagctgcacccccccagctatccgtggtctcaccgtggcctcctctcttccttggaccacaccaggtgtgcagctggctggctggctggcagcgggaggttctgggtggagctggtaaggtggaatcttcagctttcctaaccctttccctccctccagcatccggaggggtttccaggtatataagcaggtgtgcgcctcctgccacagcatggacttcgtggcctaccgccacctggtgggcgtgtgctacacggaggatgaagctaaggagctggctgcggaggtgtggggtctggggatgcctgggacccagggctcagggctcccactgttgagatggcagggttgtgatgaggctctcggtggcaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggtacacgggctgcccatggggtggtgctggagagatgggggaagggctgacttgtgcttggaactaaggagccatggatctggtcctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggtaagaggcctccagtctggcagtgggcatgtggaatacttctccactacccccagggatgctttccctgtgttcctgggtccaggaggtcctgcccacttcttgtctggggcgtcttctgtgcatgtctcaggaggcttttgggctccttcagttttgcgtatgtccggtggagggtactgcccctttgatgccttgggtaggggcagtgtctgcttcacagagggggggcatgatcccaggttggacatgagcctgagaatagccctcactgcttgtcgttggccaggcaccccagctaccatgtcccagatagccaaggatgtgtgcaccttcctgcgctgggcatctgagccagagcacgaccatcgaaaacgcatggggctcaaggtaaaagggttgggaggccatggtgggtatcagagaagggctgggagctgggcagggctcctccccactcccttctctgagccttccttgtctgcagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtacatatttgagttattatatggaaagagtgcacgtttgcaaggaactctgataccaagacccttgccttcacaaggctcccaggatgtcccatgcagtgtggccagcaatgccctgcactgactggtagctgggagtccagacagtgggtgtgggacagaaagcggagaactgcatgttagaggaagtcagcatttggtggggtggggtgtgtctgagcacagagctgaaaagggcctagccaggcaggatgtggcccagggacctgttggaatgaacagccaagtgttaaggtgttgaaccacttggcccccattctgatggcagcagggaaccttggctgcattttaacaggggaaaggcctggtctagggcaggggctatttattgctgggctgggctgaggaaggggatggctcccagccaggtgaaggagtcaagtagacagacaggatgtgtgtcatggagtggcccctcctagcagtccacagggtagctaggtggtgggtcctggccagaagctggcagtagctg

SEQ ID NO: 132074 - DNA, 1102 bp, Homo sapiens
aaacttgacggagagaggtacaggtggggggagggggttggggggttcggggatagcagatagtccccagtggtgacagctgtcctttccttaccctgcagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggtgaggcctggggctgcttcttcaccttgtcctcgtgaccatcccaggtcccccatccatccctgaacccacattctggcacaggctgcaggtcacacttgaagacgctgcctctgccgcatccgccgcgtcctctgcacacgttgccctgcaggtccacccccactgcactgttgcagctctccaggagcaggtgggcacagggtctggggagccctgccaggggcagaggagcctaggtgacatcacctgccctgatgctctggccacaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccaggtcagtcctcgatgggggtggggtgtgggaggtggggtgcagccccacagtcctgagctccaccccctcagccacaggacctagccctcagcacccccagaagatggacggggaacttggacgcttgtttcccccatcattggggctacccccaggcccccagccagctgcctccagcctgcccagtccactccaggtgggcacgggactgggcagggagggccaggacagccatgggcattggaaagagcagggaagcaacaactgtctctcttcccccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcag

SEQ ID NO: 132075 - DNA, 1067 bp, Homo sapiens
gtggactgggcaggctggaggcagctggctgggggcctgggggtagccccaatgatgggggaaacaagcgtccaagttccccgtccatcttctgggggtgctgagggctaggtcctgtggctgagggggtggagctcaggactgtggggctgcaccccacctcccacaccccacccccatcgaggactgacctggggcttctcgaggagctgacagcaagtagaggaaagcagggtccccatcctgccgaaccccgtaagaggcaaggctgcgctcaggcacacacaggcaccgtccgatgacccagcgttgcacggctggcgggaaaccgagctctgagaacacctgtggccagagcatcagggcaggtgatgtcacctaggctcctctgcccctggcagggctccccagaccctgtgcccacctgctcctggagagctgcaacagtgcagtgggggtggacctgcagggcaacgtgtgcagaggacgcggcggatgcggcagaggcagcgtcttcaagtgtgacctgcagcctgtgccagaatgtgggttcagggatggatgggggacctgggatggtcacgaggacaaggtgaagaagcagccccaggcctcacctgatggggccaggtgggaagcaggcctcctgaagctgaacactcagggccacacgatgctgggccaggacggctgccacttgggctgcccccttctcgtctccacctgcaatagcccgggccaggctccctgccagctcttctgcagggtaaggaaaggacagctgtcaccactggggactatctgctatccccgaaccccccaaccccctccccccacctgtacctctctccgtcaagtttccagggctcctaggaagatctgcctcaggtggagggcccttgagtgtggaggcttccgggggactgggcagggagacagggcatgcttctgggcccaaggctggtggtgagttgctcttgctgcctagaggtaagatatgggtgtgctgtgctgtggcctctgtccaggcctctaggcccttggttttccaggacctttgccttctc

SEQ ID NO: 132076 - DNA, 1051 bp, Homo sapiens
gccgggcccggccccgcgcctctgaatggcccgctccagtctccgagatcgagagctcgaatagccatcgggtgccgtacccgccactcagttctgccttctacgtctactggttatggagcctgtctgtcactcttctcgtcgtactaacccgcttacccccggcgttcattggccgtggcctctctagctccgccccctaggggggtcgaccccgtaaccagtgaggcgcgggccaacctagtgcgacgtgtgggcgtggcgggggctggggtctgcgggcgaaggtggcagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagcggcctgggcgcttccggctggagctgctgggcgcgggacctggggcggtgagtgggggcggagggcgcgcggtcagtcctcttggcccgggcagggcacggagcccaaagttaggcccctccgcttgccacctgggtgcccttaagcagttatgtttctttgc

SEQ ID NO: 132077 - DNA, 1046 bp, Homo sapiens
ttccccaaagacatgaagctattggagaactcgagctttgaagccatcaactcacagctgactgtggagactggagatgcccacatcattggcaggtgaggcaggctgggggggctggcatctcggaggtcacactgccgcgcccttcagtggaacctgggggaagcatgcttcatggttctctctgcatcctataggattgagagctactcatgtaagatggcaggagacgacaaacacatgttcaagcagttctgccaggagggccagccccacgtgctggaggcactttctccaccccagacttcaggactgagccccagcaggtgagccatggtggggcctacctggggctgggggttgaggggaggtgatgggcccagctgatggttctgtctgtgcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtgagggtcaggtggagggaagggacccacagccaccccactgtccttccccactttgggtagccctgggctcctgtcaccctgactgtgacctgccctaggtggtgaatgcagtcaactgcagtctgttctcagctgtgcgggaggacttcaaggatctgaaaccacagctgtggaacgcggtggacgaggagatctgcctggctgaatgtgacatctacaggtgggccggcatccctgcagatggcctccaggcctccaggtttgtggggcacttggcgcctcacaccacctgtcaccctatactccccagctataacccagacttggactcagatcccttcggggaggatggtagcctctggtccttcaactacttcttctacaacaagcggctcaagcgaatcgtcttctttagctgccgttccatcaggtgggcaccccccgcctcctcccccacctccctgttgggccga

SEQ ID NO: 132078 - DNA, 1123 bp, Homo sapiens
gctggctggagcagcctggggccagaggaagccgtatcaaccgggtgaggcctagtggtgggggcggtggcaggcctgcgtccactgcgggagggtgcaggtccagccaggacaggcagtgtgccaaggacaggagtgccctcagggcactgcagccaggaggcgaggagcctcagggaagactcccagtggtggaggcacggctggcctggccacgccgtccagcagggcaggcatccagtaattcctcccggccaaggaacccctccagtaggaaaggtggcaacaaaagaaacagacactaattggagatgtagatggttcagggagaagaaaataacagagaaagaaaatctctgattaatatcctcaggaaaataagtgggcatcatgcattcacgggacaagaggtgtcaccatggagaagccacattgagagaataaaactgaccttctgtgaattaaagatgccataatagaaatgggaaaaataatagaagaattggaagagaaagttgtggaaatttccagaaaatagaggaaaaaggcaaaaatatggaaagtaggagagaaagagaagaatgaactagcaggctgaaccctgaagccagcattccaatcagaggcaccctagaaagaatggacagagatgggaggtcaagagatgacgcaaaggcatgccctagtggccgggtgcggtggctcatgcctgtaatcccagcactttggaaagccgaagcgggctgatcacttgaggtcaggagttcaagaccagtctggccaacatggcaaaaccccgtctctactaaaaatacaaaaaaattagccgggtgtggtggcgcatgtctgtaatccctgatactgtggatgagacaggaggattgcttgaacctcggaggcggaggctgcagtgagccaagattgcaccactgtactccagcccgggtgacagagtgagactctgtctcaaaacaaacaaatcaaaactagctgggcatggtagcttacgcctgtaatcccagtactttgggaggccaaaatgggaggatcacttgagcccaggaattcgaaaccaggctgggcagcatggtgagaccccatcgttagaaaaaatatttttaaa

SEQ ID NO: 132079 - DNA, 1234 bp, Homo sapiens
catgtgcgtgtgtgtgcctgtgcttgcgtgtgtgcacgccttgtgtgtgcgcatgctgcatggggtgccgccatggtctggagcagagtaaacatggcagtggctgtgctgcccacacaggcctggaggttactgggtgtctgagtttcagccttaggatcattgtctggggcccttaacttgcctctcagctccgtggagccagcgctggacgagcaggcccgggcggatgtgatccatggctgcctgcacagcatcatggccctgctgcctgagcccaaggaggaggacggaggctgccagaaggtatccctgtgtttcccttgcctgtgtccacatccgtgagagtggtgggaggccactgtaggctgcggggtcactggtggggctggacggcctggctctccttccagtccctgtatctggagacactgcacgcccttgaggatctgctgacgagcctcctgcagcggaacatgaccccccaaggcctgcagatcatgattgaggtgtgcaggggggaactgtcatggggatggggatgggggcacagagggcactccacctggctgctggccctctctccacatgtgggcaccacagggacagtttggtgctctctgcacttgggggtggtttatgaacaggcaggtgcaccccctcccatctgggctggcaagcagttggggaggccctgacccaggtgggacctctggagcctgtcctctcccgccactgcatggcgcggggatggaggggcccacgggtacccatggctcctgactgggggccgctaccagggtggtgctagggtggggccgacccccatgctcggagtgtgttcttctaggaccaaggtggcctccaccctgtccctccacagtcctggctggccctggatccacctgggctgggttgtgtctgtgaccagactggaggacagagtggcagggccagaggagctacggtggcctaaggctggcaccactctgggtccccggcttggccccctgtagcccaggaaggatggcctggcagggacactgagctggcccacgatgcacaaggctcctgcccccagggctgccctctgagcagtacctgtgtgacgcccctcttcctcagcacctgagcccatggatcaagtccccaagaggtcacgagcgggcgcgggccctgggcctgagcgccctcctgctgcgctacttcctggagcacctgcgtgtcagcgtga

SEQ ID NO: 132080 - DNA, 1234 bp, Homo sapiens; identical to SEQ ID NO: 132079

SEQ ID NO: 132081 - DNA, 1234 bp, Homo sapiens; identical to SEQ ID NO: 132079

SEQ ID NO: 132082 - DNA, 1234 bp, Homo sapiens; identical to SEQ ID NO: 132079

SEQ ID NO: 132083 - DNA, 1234 bp, Homo sapiens; identical to SEQ ID NO: 132079

SEQ ID NO: 132084 - DNA, 1234 bp, Homo sapiens; identical to SEQ ID NO: 132079

SEQ ID NO: 132085 - DNA, 1028 bp, Homo sapiens
gacaccagcagcactcctggccacactccagccctcctctgggtacaggtggcataggtggcatccacccacccccagcattctaatagcccaggcatctcctcctccaggccctggtgcccttccacaacctgggccttctcatcggcctcttctccccacggtgtgcggacctgtggcctgccacccgccaggaggccgtggactgtgtctactccctgctgtacctccagctcggctatgagggtgagccctcgtcaggagtgtgggggccagtggtcgtgcaggggtgcttggagggatgaggtgcggagtccaggctgtgggatcgccagggagggcctgggcccgactgctcattcctgccgcctctcaggcttctcccgggactaccgcgatgacgtggcggagcggctcctcagcctcaaggacggcctcgtgcaccctgaccccgccattctcttccacacctgccacagtgtaggccaggtaccagctgggagctctgcggccggaaggcaggctggcactgtctggggctaacagggacttccgaggtggcacctggcctcccctagcctctggaagtgccacccatggccagtgggcatgagcagggcctgggtgtttgcattagttgccggcgctgccctgcgctggccccatcacccacacccgcctacgctggggcagtgcagtccatatgagaggaaggtgctatttgtcttgagacctggcagaggccaaggagagaatggggtgccatgaggcacagccgccctctgtctgccactgataccctggcctgctcatgaagatgcaggtttctggaacagaatcttcagcggctgccctgtgtggtgttgtccccagaggctacccaagagccacgtggggggctagggtcatcgcctgcagggtgcagcgggctctagccctcttgccaaggggcctgcccttggttccagctggtcaaggtgctttgtctactgccatctgaagggaggatgaccctgggcaccgcgtcc

SEQ ID NO: 132086 - DNA, 1028 bp, Homo sapiens; identical to SEQ ID NO: 132085

SEQ ID NO: 132087 - DNA, 1028 bp, Homo sapiens; identical to SEQ ID NO: 132085

SEQ ID NO: 132088 - DNA, 1028 bp, Homo sapiens; identical to SEQ ID NO: 132085

SEQ ID NO: 132089 - DNA, 1028 bp, Homo sapiens; identical to SEQ ID NO: 132085

SEQ ID NO: 132090 - DNA, 1028 bp, Homo sapiens; identical to SEQ ID NO: 132085

SEQ ID NO: 132091 - DNA, 1005 bp, Homo sapiens
acgctggcgcatgtgtccttctggcgagccgccaggctctccagcagcgagtccaagagcatgaggtcgttggccacgttgctgttcagcagctgcaggcagaggtgctgtgacttccctctccccgctgaccccagggctcaacccaccagcccaggcccagaacaccagaggctgtccccacgccggtgtggcagacagaggtggagcacctactccctgggtctccgatcagtggcgacccctccctgttgtgccactggggcctgctctgacgcccgctgtgctctgctgcacggccttgggcaagattttggcatctttggccacgaaggccaagaccacaccaccaagggcacctggggtcccaggggccagccctgtccagctacaaatgtacccagctggacttggggagagtacaggctgcagggagcctcggtcctcctctcaccaggcacagagggggtgtccctgggtgggactgagtgagttctggcatgggggaggaggtagctagcatccacataacctccctcacagaccacggtcgagggggccttttaggggtaagaaaagggcatcccgtgcctgtcctgagcaggagccccaccttggtgcccagcatccgtccctggaagggcctacctcggccaggaaggcggtggtggtcaccctctggttctcatacgcactgctgtgtgtgcatgccagcgtcttcagcaccagggggagtcggggccctgcgtgctcagccatggccctgggaaagggggccgctgagggtgcaggggctgttgctgtgctgaaccctacccaggcaccttccaccctgcacagccctggtccgctccaccgccagctgccaggttctgggagttctatgtttcagagatgcctcccagcttgcctcgccaggcctctgcaggggtgcctccctacccctgccccagagagtgaacaggcaggagcccagggcaccattggcctgacacgcatgggccc

SEQ ID NO: 132092 - DNA, 1050 bp, Homo sapiens
cgtgcctgcctacggacgcttcatccaggaacgcttcgagcgctgccttgacctgtacctgtgcccacggcagcgcaagatgagggtgtgtgggggtggcacaccaggggggtggcacagggggcaaggctgacctggcgctctcctgccccaggtgaatgtagaccctgaggacctcatccccaagctgcctcggccgagggacctgcagcccttccccacgtgccaggccctggtaagtggagactagggggctggggttgcaccctcccagtctgactcctcactgccgccgcctcctcaggtctacaggggccacagtgaccttgtccggtgcctcagtgtctctcctgggggccagtggctggtttcaggtgggtccgagctgggggcagccttgagctggggggcaggtgggatggccaggtgttgagagctgtctctgccgcatccaggctctgacgacggctccctgcggctctgggaggtggccactgcccgctgtgtgaggactgttcccgtggggggcgtggtgaagagtgtggcctggaaccccagccccgctgtctgcctggtggctgcagccgtgtaagtggaggccctgggggctggggagccaggggtggcactgtgcttaggggccgtgtctgggcctggctcacagggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaaggtacgtggggcgccttgggggtgaggctgcagcgggaggggcctggctcagccactcagccagccttgctctcctgcagccagtgacgcaggtgacctggcacgggcgtggggactacctggccgtggtgctggccacccaaggccacacccaggtgctgattcaccagctgagccgtcgccgcagccagagtccgttccgccgc

SEQ ID NO: 132093 - DNA, 1507 bp, Homo sapiens
tgtacgtccaggaacgtggctgttctgcctggggaggggccgagggcagacggtggggggtcccccacagagaggtcttggcttctgcctctctgtggaatgggtcagttggggtcttccccgagtccccgtcttatagctgcccacttctgcctaaggcccctgccaggggagggagcccgtgggtgatgaggtcatccctgtctgtggctgcccagagccctggccaaggaatccagtgaggggggagctctggggttggcaccacttcagtggaaaatgtgaaggtgcagctccggcgcctccgagggcgggggtgggggcagcgtggccgccatgccacgtcagaccccagggctggggaacaggcgtaggtcagggccagtgacctcagggcacttgaggctgggcctgcactccccctgcaaccccctcacctgctcccctgggcggcccgaagcgggggtgggccttgtaggatcagatgccgacatggtggcccccggctgcaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggtgagggctggtggggtggggccagcagccggggtgggcccgaggggtggggcagggctggcggggtctgactggcggtctccaggcgcaccgtgcaggacccgatgacagggcgggacctgagactgacggatgagcaggtggccctggtgcggcggctgcagagtggccagtttggggatgtgggcttcaacccctatgaggtaggtggcaggggctggcccctgggcggcgggggtcctggaggcaccagcagggcctcagccactctggcccacacgcccacatcttctcccccagccggctgtcgacttcttcagcggggacgtcatgatccacccggtgaccaaccgcccggccgacaagcgcagcttcatcccctccctggtggagaaggagaaggtggggcacacagcccctggggcttggcctgggctgaccgccccgcactgcccgtcctgacccggctgtctatgcaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggaggtgggcctgcatcctgggggccgggaccctgtccccatgcttccctgtgaccctccccacccctgtgtcttggtctccacagcgcttggcgtgggaacagcaggagccaggcgagaggaagctgagctttttgccacgcaagttcccg

SEQ ID NO: 132094 - DNA, 1472 bp, Homo sapiens
gccctcctcaccctcagggcccccgggtgcccgacaggcccgagtcgggggcacccttgccctgctgctgcctctgtccctgccgctgcctccctgtccctgccttacagcgtccctgccttgtgcctcgccctccccatcttctgccacgcagctcctcccccaccctctctcccggcgtggctcccttgtccccaccccacagcttcccgatatgaggctctgtgggtgagctaagcccatcctcaccgcctcagcccagggaggggtggccctgagcctggaaagtgggggcttcccagggagccggggtacttggcccaaggaggatgggaccaccaagggtgggaatggaggctcaggctgggggctgggggtggattctgaacctttcatgaggacagttggcctccatatttggaagatactgttttgtttttaattatacaaaattttcagactttatattatcatatcaaaaacacaagatgccatcacacagtggccggaagaaaagccagcgcagaaagttccagtgggcccgggcaggtgctggggccagcgcagagtcccgctgccggcgcctgtctgtacgtccgtctgtccctcggccccgctcgcagccagggctggcctgggggcatgcttgcggtgggccttgcccagctcaggtccaaggtgggggctgtctgcagtcaccccgggcgtccacctcccccagcagcgtctgcctcctggctgctgccggccacctcctaactgcgaatcgctgtctttctgtcgcggtccttgctctgcagaggggagggaggagtgtcaggccccggcagagcccagcgccagtctgcgcctctctggcctccctgctgggtgccatctcaggtggccagcgccaaggcacctccttcccggctctccccagcttccctcaagcgttttggggaggggagcatactgctgcacagccgaaattgtaaaattaaatttcccagatgttcaggccccaggagctcgcgcgtgctgtctggagaggaaatggggattgggaaaagccgtgccgtattttctccctgctcaccctgcttttccggtgccaccaagcacagcaggagctgtaaatcacagctggccagcgtctcctgcaggggccctcacccccagcccccacatctcctgccagcctctgccttcgtgtcccatggcccacgtctcgggcagccctacaggacctggtgtcttggtgtgcggcctaggtgggggacggacagcaggtgcccaagatggcttaagccagtgctgggccgcaggggctaagaacccggggtccttcctctcttgccttgcagcctcttactttctgaactcagctgttttcactccgcctttcaacttactgaaaagggaagcttgcagcggcctggtccagctccccagcctccccgccctgggtgggcccctttggccatccctag

SEQ ID NO: 132095 - DNA, 2066 bp, Homo sapiens
ggtgcaaggacccctgggtcagtagtggcttctctccagtggtggaggtgccgggagaaggccgagctgtgtgcccagcctctagaagggcagatgcgtggttggcgggagccgggccggagctgagggcgtctgggctggtggctcctcctgcctggggccccaccttgggctgggggttcgctcagctggtttggactttgaggaggaggagactaagcaggacctggctttctcccctctggccccggcgccagggcccagcacccctgctggaaccttcagtagggtgagatgcagcaggtgagcctcccgccctggccttgccctgagcacttcaacagataaaaccctgaggaagaggaggcggcctcacgtcgcacaggaaggccgtgtggcgctccgagacaggcgggcgttttgtgcaggggagcggcgcgaacgctgaacactacccgcattgtaatcggagaggggctggggaagagagagacggagcgagggcggctgaccccacgctcccgggggacaggtgggagaggcggaacgaggagagagtgaaggattccagaggtgggccggcttcctctctcgcagacagacacgggaggaggcgggcagcgggccagccccatacctgcagttccaatctgtggtcctgacagctgcagccactttggggagggggagggaagggggctcatcgagagcggaaaaatcccagccgacacatcagccggttgcggcctgtgtccggtgcagtctgggctgggggcctgtccttggggctgggcggcccccaggagagccctgatgctgggtctgtgtgtgcccccggccggccggccggggctctccgtgcggggcctgacccggaggggtcacatgtgtttcctggcagcccgcaggtgctgcgctgggcggggcgggtggtgggcgcaggcgaccgtgatgaatcatgtgtcccgccagcagctcgttccccaggccggggacaggagctgacagctgaggcccagcagagcgtttccagcccagctcggctcgcaggggcggctgctggcccaaggtgcaggctggggccccttccgtcccagctgcctctgtggggcacaggcggagggagccctgggtctctgtggaggtgaggccagcactctgggaagggagccaggggctgtggtgggcagggagcacctgccactcgtctgcccggcggctgtgagctacgagtggattcgggtgggctgccgcaggcctgggggtcagcccacgccacccccggtctggtttgaatttctggagcagtggagggtgacggagtgttcctcccccgcccctcccctcttgctggctggcgggccgggccctcggccgctgctaccggtgcagctcagggagcggctgggctggctgcccaggcctgaggctggccaagctgcagccgcggtcggagtcaggcccgcagcggagggcttggctgtgagtgctgcaccccaaccagcagggccctggggatcctttcagctccgaggcctccaggtcgttgttccctgttcactttcttctagcctcgttagacaccccaaactctgaccccagtccacgggggctctgacatctctttcccctgcactccctcttgaccctgcccagacctccccatgctggcccgcaccttcccacctgctcctgtctggcctcctgcattcccgctctgagctggctctgccctgtccttggtgccggccgccgacgccccgcacctgcccgctcaggccagcagcccctgatgtccctgccctggagactttcactatcttccatcccatttgtccccaacgttgaccggccactgaggttgggggttcatgtggaggtttgcaacccccactaggcccaggtctggaaatgggaggcctggaggtgaggggtaggtgggctatggaccctccctacagaactacacccagtgcccagtggagggagggctggcgtgggcgccgtgggccttagggtgctatgcagagtgcccggcctggccatgctcctgggtccaccctgct

SEQ ID NO: 132096 - DNA, 1044 bp, Homo sapiens
cagatgcctcccgtccagagaagtgcgcatctgcctgggcctctgttcccttggagcaaagtggggtggccctaggggagtgatttggggccacaggtgggcaggaaagaggcttgggaggtgggagacagcctgcagctctcccatgagacagtggggtgaggagagcagggcccgtcaggcagccccgtgtccttggaggtggccgtggcaccaggaccatggtcctcctcggcactgggcagagctggctgagagagggccgacctcactgccggggcccttcagggctgtggagagggcccctggtagcagggcagggagggcgccgctggggcgtgtgctcctgcgagcggcgatctcagctggagcgcgtgggtggcagtggctgtgatgctgagaaggtctcgggccaagctcctgctggtgggaggtgcctccctgccaccccctgcccacctacctccccttctcctcaggccacttccctgcccttcctgggtctggatccagggcctggacctggatgacactggggcttcagggaccccctgctggacgctgacttttgaagacctgagcagcccctcacaggagagctgtactccagctcttggtgtcttattcccctcccccaggtgcgcaggcagcagcgagcaggcggagggaggcgggcggagcccctggaggaggcgctgggcctggctggggtcctgccgccggcagtggggggcccccaggagccggctgagctgcggctgccccgcccccgcatggccacctcacccctctcccaccgcgcctggagcttcacagacgtgatctcatccagccgctgggacccccggggaggtgggccggggtggaggggcggggcaagggggctctcggcctttgccgaagcagcccctccgctttgatttgagcggttgggagaaactgaggccgggtggctgctcaggcagaggatgcagccacccaccctccccctgcctgtggccgtgtttgtcaggaaagcgtagcaggctgagggatctgggtggc

SEQ ID NO: 132097 - DNA, 1041 bp, Homo sapiens
tgtggcggtcgtggcacgcagtggtcttggggcctgtccttgagacccatgatggtcttgagacccgtggtggtcgtggcctgtggtggtcttgaggcccatgggggtcatggcccatggcggtcgtggcccgtgacggtcatggcccttggtggtcatggcccgtggtggtcttggggcctctggtggcagcacacatggccagtgcctcatgcagggttggcctccatgcctgggaacgaccctgccactcttgggctcctgccccgagttaccttccttttccctgagtaaaaagggatgtttttcggctgtattttctctgggcttttcagttcctgctgatgtactttctttaaaacaaaatgtgggtttcctaggtacctgttgatgagtcgttgctgtcacacgagccatcggcacagagctcttggatagcagcctgtctctgtgctgggcaccctgcggctagcgtgggcagggccctagggagccttggccgtgctgaggtgctgggtgtggggtctgtggtgcagcgctgggttgtcttggtgtccttggcaccccgacagcgatgttctggctctggtctctgggcaagttaggactgcttccctcctgctgtccacgtctccagcagaaccctcttgtgggcagccctgggagcagagttctcttcccaccgaaccgggacaccgcagctctgtcgccatcctctcccaggaggtgagggcagagcccgtgtctcatgcctggttggtggcagtggggcacggcctggctggcctgatgctggggaggggaggctctggtgtggtcacaatagggggctcatgcgcttggacaccgtttctgtctggctgagcccactgtgggtttctccctttggtcctcatggtgacattctagccctggggctgggcagaggccacgcagggttcagggactacagcagcctttccttggccccagcggccccgcatcctgctggcacctcgtccttgcgctccccctcggcggctccctgcccacccgtcggtc

SEQ ID NO: 132098 - DNA, 1091 bp, Homo sapiens
catttctcttccagcccccagccccttttctagtgacctcttggctctggggccttggatgccagggtgaggtgtggagagggctcaggcaggctgtctgagggacccagtggagtccagcccagcctgaccccacagggcctccggagtgtcagtgggtggtagagagcagtgttagttttgcgatgagagctgagctccaagaggaggaggttgtccttgaaaagccccttccctgtgaggtgctaggaattaaaatgtcgatggcaaaggcaagaggctgtcttgtcagtggaggtagaagatgaggaaggctcaggttgggtggatgcttttggtggaagtttgtgactggaggggtgtggtcctggaggccacatggagctgctggtgggtggctggaggggcgagaggcagctctccctgcagtgttcagtgccccatgcctggaggggcagttgtcaccaacccagtgtttccttgcagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggtgggtgagcgaggagccccctcgagggctgtcccccatgtgcaggtggccttgggctttctgagactgccactgtactgccttctccaccgtccctcagaaccccaaggccggcgtccctccttcactgcacctggggcacgcttgggctctaggacgctggtttccatccccagttgcgtgccgttcccaggaactctgaaaatccacatgcctaggcccttccccgtcagacgatgctcgggcaaccctcctggcaacaggttgggtttccttgaggtggggattttactgcttggaatccagtggcaggacccagctgaggagggagctgagcagcatggcagggctcaagcaggcggcatgggggccccaacggaacccagctgggcctg

SEQ ID NO: 132099 - DNA, 1433 bp, Homo sapiens
gaaggccgggacgttgctgggccccgccgcgccggggcccacgggcagatccatctcgagcaaggagggaataggcggagggagcggccgcaaagaggggccgagggccgggctaacgccgtcgccgcgccagccttccgggccgcgccgccgcccgctgcgcacacacagccccggggcccagcatggccgccgccatcttgcaacgggcgcgctcccgccgccgccgctgccgccctcccgcgtcacccccggcgcgagcacgcaggccccgaccccgccctggtccccggcccagccgcgcgcctgcgcgtgttggtcccacccccttccctccacccgccaatcggggccgggctgggcggggcgcgtcctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggaggtgactgtggcgatgcggggcggcggggcgcgtccctagagggcccggcgggcacgtggccgcgctggggcgggtgggcccggcttctgtcacctgggcgcccgcgcccagtgaatcggtcttgggcgtgggtgcagctcctctatcggggggtctcaggcagagcggactgcggggtaaaggacggcgtccgggaagcaaagaaacgggggagcggggagtggggacggggcgccccttgcagcagcctctccagccgttccatttgtgcatcctgccaataaaagggctcggcttgcgctcccagtaaatgcttaacctacgtatacgctagttaattgcgtttttatgctcatgggatagacatgagaataagaaaacctgaatagaacccagtgtctgctgcatttgctgtattagaactcactgttgctctctgctagctcagccctgtcttggttgtggggatcatcaaattgggtggtggaggggatggacagccagcccctcacagccccctcggccgcggccgcgctgggttgttgaaactgccccattgctttgtgaagcgaattcaactcatcctggctcccatgggctgaatggcccgcaggccactctaggcgccaggttctgcgacttccacccttggactaaacggtcctcaggagccagttgtttgcgcccaggccacggatgccatttccactagttattgtgattgtgtagccgactgaataccaagacacatcatgactctgtgtgagagaggcattgtgtgaacactcggtatgcaatagctaatacatgcaggtcgtaccttaagtgagacttgtaaactattaggaaaacagtaaaatctagaattctgcattcaactgcttcctttttct

SEQ ID NO: 132100 - DNA, 1077 bp, Homo sapiens
tggagcacgtccacggctcgggcccctactcggtgagtgccggagacagggcacccgcccaggcatgcaggcggcagtggggtgggttgcccctgccggcactgcatggacctcctgcctttgattgcaggccccctccccagcctacagcagctccagcctctacgcccctgatgctgtggccagctctggacccatcatctccgacatcaccgagctggctcctgccagccccatggcctcccccggcgggagcatagacgagaggtgggggccgcatcaccccagccatcctgtcccccaatgaggcgagcccctgtgggcccagggcagagttggggatgaggtggggctggccgagacgccagctcacctggcccccctcgtgtgcaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagtgagtgccgcccacccctggccccacccacagcgcctggacgcacagccctgggcttcagccccgactgtcccagtggactgagcagggcagctggcgaggcaggaccctacccccaacctcggagctcggggctggggagggagacaggtgccagccagatcaccccacagtcccaaacgccacagaagccacgggcatgtccggacaggctgccgggccctgctctcagccacccctcctgctgccgccaccctcgccacaggccacgggccctggcaggtcgtgctgcccagacacatggcaggagatggtgagcagggccggcctccacacccccagcccctgcctgcaatgggggctcttgtttttgtatcttgcagtttggctcgcactccacag

SEQ ID NO: 132101 - DNA, 1054 bp, Homo sapiens
ctgggacccagcctggctgtccgtcccatagcccaggtgtgccctgtggcctagggctttcttggtcacagccaccagaccgtgggtctcatccccacagcagcaccagggcagggactgagccacccacacactgagcagagccccacctgttttcccagtgcaacgggaaacctcaccaaccctgaacactgaaatccctgatccttgtgctggagctgaatacgccccttgtctcctgggtccactgccaccaaggcccccaggccctcatggcaaagggatgcccagcataggcccagccgcacccctgcagggcacagagcctccactgccttccaggccgtcctcgaatgcgctgccccctccagcctgtgcaggcgtacacgggggtgcagcctggggggtacagtcaaggggagcccttctcccacaggagggcattggggtgtggggcctggggcactggttcaggtaccgccttatcccgggccaggaatgagctcagtgaccacttggatgctatggactccaacctggataacctgcagaccatgctgagcagccacggcttcagcgtggacaccagtgccctgctggacgtgagtggagccccgccgccccgcctccccgccccgcctccccgcgcctccccgcctccccgcctccccgcgccgcctccccgcctccccgcgccgcctccccgcctccccgcgccgcctccccgcctccccgcgccgcctccccgcctccccgcttccccgccccgcccccgggtgctgttctgacttccctccctcctccgcagctgttcagcccctcggtgaccgtgcccgacatgagcctgcctgaccttgacagcagcctggccagtgtgcgtaggcgggcggggggtgagggggaacgagaccagcgggagtgctcacaataccgtctccaccccacagatccaagagctcctgtctccccaggagccccccaggcctcccgaggcagagaacagcagcccggattcaggtgagccaagtcccaccggccccacctctgcccccaa

SEQ ID NO: 132102 - DNA, 1064 bp, Homo sapiens
catgcccgtgaacgcccagaggcggaacattcgcagagggacgctcaccaggtactgagatgggagggagagaggatgccagggagtggggtgtcagccgtccctgctgtgggcatacccctgcccagggatgaggcaagatgccccccagagcactgacctcgtggaagaaggccgaggccaggaacacccctgtcctggccatccacttgctgctgccccgtcgaagcatgggcttgtagaagtgtctgcagaggagggggcatggaaagcggttcaggttcacagccatgttccacatcacacacacacacaccccacctacctgatgcaccacttgtgcacagggatgttccagttctgccagaagtaggtgacagactcggagttcctgggggccaagagaccacagggggatcagagcacaccatggcccatcccagcccccagggacaccccagggacactcaccaccagtcccggtagaactcccggtctccaaactgcatgagctcagccacggcattcaggcaggagtggaagagccagtagaagaagatgagccagatgaggtgattggggacctggcagggaggtgggggtgggcaccaagttctagaaccttcccccacatgccactgtcccctcctgtcctgtgcatgcgccacctgtccgcactcaccgccagcttcaggaggcgctcgatgatgcgtgagtagtccatgtcctgcagaaacaagcccttcagctagccatgctcctggtcactccccagccaccccagctgcaagagcacctgagccactcaccttgaagggcttcatggagttctggatggtggggaccatccactgcaaaggagggcaccacgtcagctcccagccatgcccagctacacccaaccctgccctaccccacttacctgctggatcagccccacctggagctgggtgaagaacagctgggggggaaacagagagcagccagctgaggccctggctagccagaaggccccctagcctccagtggctgcccccagcccccaacctcaccatctcaaggat

SEQ ID NO: 132103 - DNA, 1926 bp, Homo sapiens
tgaggtgggtgctgagtctcagagcttggcatggagaccagacagggctgggtctgcaagcctgaggctgccgccctgagctcgggctgggacgtgcccagaggtgttgggaggatctggggtgagtaccctgtggccaggactaaaggggctgcaccctcctgtccatccctcgcagatcttgagcaatgcccggttatttctggagaacctcatcaagtgagtgcctttgccaggtcccacccctgccccacccatggcctgtccaggccccgccccacagccccacctgccacccactcagacccccatccctccacccccaggtatggcatcctggtggaccccatccaggtggtttctctgttcctgaaggatccctatagctggcccgccccatgcctggttattggtgagctgggctctgaggagggcctcgggtggggatcaggctgacgtggccctaaacctgccccttggtgcttctgtccacagcggccaatgtctttgctgtggctgcattccaggttgagaagcgcctggcggtggtaagcagtgcccctcacctccgtgtgtgctcaccctgctgtgtgcgctcctgggaggagctgctccccaggcctggcagccctctcccaggcaatgggagccctggttgagtgctctgctccccactccagggtgccctgacggagcaggcgggactgctgctgcacgtggccaacctggccaccattctgtgtttcccagcggctgtggtcttactggttgagtctatcactccaggtgcgcccccatcccaccctgcccatctgtctcgggccagccacgggcatggcctccggctgtggcgctgtggaggcctgagtccacctctcctgcagtgggctccctgctggcgctgatggcgcacaccatcctcttcctcaagctcttctcctaccgcgacgtcaactcatggtgccgcagggccagggccaaggctggtgaggggctgccaggggctggggctgcctgctggggggctgggcagcagcagggccccaccagccccctcccactctgctgtgctcgtagcctctgcagggaagaaggccagcagtgctgctgccccgcacaccgtgagctacccggacaatctgacctaccgcggtgaggacctctgtgggcctgaggtgcgggggacaggctgggcctgttctggtaccaaccccccattcccattccagatctctactacttcctcttcgcccccaccttgtgctacgagctcaactttccccgctctccccgcatccggaagcgctttctgctgcgacggatccttgagatggtgaggttgggggctgggggcagccactggaggctagggggccttctggctagccagggcctcagctggctgctctctgtttcccccccagctgttcttcacccagctccaggtggggctgatccagcaggtaagtggggtagggcagggttgggtgtagctgggcatggctgggagctgacgtggtgccctcctttgcagtggatggtccccaccatccagaactccatgaagcccttcaaggtgagtggctcaggtgctcttgcagctggggtggctggggagtgaccaggagcatggctagctgaagggcttgtttctgcaggacatggactactcacgcatcatcgagcgcctcctgaagctggcggtgagtgcggacaggtggcgcatgcacaggacaggaggggacagtggcatgtgggggaaggttctagaacttggtgcccacccccacctccctgccaggtccccaatcacctcatctggctcatcttcttctactggctcttccactcctgcctgaatgccgtggctgagctcatgcagtttggagaccgggagttctaccgggactggtggtgagtgtccct

SEQ ID NO: 132104 - DNA, 1024 bp, Homo sapiens
gctcacggtgtgcggggcagcagcactgctggccttcttccctgcagaggctacgagcacagcagagtgggagggggctggtggggccctgctgctgcccagccccccagcaggcagccccagcccctggcagcccctcaccagccttggccctggccctgcggcaccatgagttgacgtcgcggtaggagaagagcttgaggaagaggatggtgtgcgccatcagcgccagcagggagcccactgcaggagaggtggactcaggcctccacagcgccacagccggaggccatgcccgtggctggcccgagacagatgggcagggtgggatgggggcgcacctggagtgatagactcaaccagtaagaccacagccgctgggaaacacagaatggtggccaggttggccacgtgcagcagcagtcccgcctgctccgtcagggcaccctggagtggggagcagagcactcaaccagggctcccattgcctgggagagggctgccaggcctggggagcagctcctcccaggagcgcacacagcagggtgagcacacacggaggtgaggggcactgcttaccaccgccaggcgcttctcaacctggaatgcagccacagcaaagacattggccgctgtggacagaagcaccaaggggcaggtttagggccacgtcagcctgatccccacccgaggccctcctcagagcccagctcaccaataaccaggcatggggcgggccagctatagggatccttcaggaacagagaaaccacctggatggggtccaccaggatgccatacctgggggtggagggatgggggtctgagtgggtggcaggtggggctgtggggcggggcctggacaggccatgggtggggcaggggtgggacctggcaaaggcactcacttgatgaggttctccagaaataaccgggcattgctcaagatctgcgagggatggacaggagggtgcagcccctttagtcctggccacagggtactcaccccagatcctcccaacac

SEQ ID NO: 132105 - DNA, 1015 bp, Homo sapiens
cacagccagagtacatggcagtggccagaggcctctggagagtgaggcctggagtgtccaagctccatgtaggtccagtccgggcagggccagctgggcttgcttctgaccctgacatgctcgtcccgctgcctggaggtgcaggctctgggggtccggagagctttgcccactgtaggtcttgaggccacagtgtggctctgcctggcttctcctcctggttgtaaataaggagtggggcctgagggcagacgaggacactggggtgggggcctggatcctgcgggggtggcgctgccctgctggtgcccactcagggggtgcttgtgttgtgctctgtcaggtgccatcgcctgcaggattctttattcagctctgacagtggcttcagcaactaccgtggcatcctgaactggtgtgtggtgatgctggtgagtgggacatggtgtcgggagcgggtctaggtccaggtggggctctgtcccaggctggcctttgcctgagaacaggctctgtcacccagggtgtccaggctggagcccctgtgggctggggtgtgtggagcaggctgcacctccatgtggctgccagcactggactgttggggaggggagtggcagtggctgcccctgctgtggtcacttgggtgcccatgcaccacatacttgctgcttcccattggatcccaggagagccctgcagatgtggtgtgggcgtggggaggccgaacagtgcctggctggagcctgtgtgttgtgagctgggcctgaggggtgcagggcctccagggagggcagggtggagggggtcttgccctgggctggtgggagagtggactgcatgctctgtggacacaaggcctctctggcaggggatgtgagaagagcttcctgtgctacgccacatggcctctgtgggtatggagccctgcaggcctggccaccactctgcagtcctcctggccccttccctcagctgtgggtcctaggagccccccaggaaggtgattagatgg

SEQ ID NO: 132106 - DNA, 1074 bp, Homo sapiens
ccaaaatcagcccacttctgccttgataacctctaggccctcagctgctctctaaaacaaagccctgagggcccctgggccagggtaaaggccataaaggggggatggagggtggcaaggggattgctcaaggccagcttggtggaggaagccaatgcccaggctggccaagtccttcccatcggccatggttctctccctccacccctctctgtcagtcatccagctgagcagggcacacgcctgcaggtgtgtccaccacccccataccccactccccacctggaggatggaagtcccaacacagaacccaactctctgtccctacaacagacgctggctctggcaacatcggcagggctccaggccagcctaaccactggagcaatgaatgggccacgcagccactctcagaagggtctgcaaggacaagaacgcctctaacactgccccttgtccggggcagctgctgattcccctgtcctcggacaggcctgggctcctctggccccctccctggcaggccagccctcctctgggagcctttcctacccgcaaggcaccgctcatagcaccaagaaggaacctatcaccacaaactgcccagatcttatctgactccttccatataaggggacactgtccagggccgggcccccaccagcccgcccctcgaaaagctcctcaggagcccctgaggatgcacagacccaagaggatctggatgcgggacacctgccggctcccctctgcctggccaaggccagctccagagcccctacccagtgaccttgtcaggtgactctccccaagcctcagtttccccacagggcccatagggcacaccgatccccgcttagcccagggcccatgttctcggactcggagctcgcgcttcggccaaccccggaaagtcgcggggcccttgggtcagaggttagggggtcaggcgctccgctacctcagctcccagtggccgctgcccacgccggcgtctccgtccttgttgggggccggggctggcgcgtcccccgcggctcccacgtcggggcccgcagcggcgtcccgcacctc

SEQ ID NO: 132107 - DNA, 1958 bp, Homo sapiens
ggctccttccgtctccctgcaccaaggtgttgggtgggaaggactcgtgtgggaacattagtgcagctctgcctccgctgtcggcccaggttttcacagctccagaggctgaccctcatccactggaagtctcaggtacaccccgtgttgaaggtgagagctccaggctgtcctgcacatcagctgtgacactctgggactgttcagtactctaggaagtgggtcaggcaccttgggggcccaacgctgctccgtggggatgtctgcttgcctgcctggttctcttttcctgctgtttcctccagcagggaggtatcagaggcggggacacccaagtaggcctggcatgggcagaaaggaggtcacagctaaggcggtagagtggggttggcaccagccacttgtctgtttcccttgtggatcttagcctgtcgtctcccaaccccagctgcccctctgtctccccgcagctggtaggtgagtgctgtcctcggctcactttcctcaagctctccggctgccacggtgtgactgctgacgctctggtcatgctagccaaagcctgctgccagctccatagcctggacctacagcactccatggtgagccctgtgtcccaaggggccctgaaaaaacccaggccggggtgacgggtgctcttgtattggggccccaggtggagtccacagctgtggtgagcttcttggaggaggcagggtcccgaatgcgcaagttgtggctgacctacagctcccagacgacagccatcctgggcgcactgctggtaagttggcattggtgggagcagaggcagatgctgagctggggactgccaggccactgaccctgtgacctaccccctccccccatctctgcagggcagctgctgcccccagctccaggtcctggaggtgagcaccggcatcaaccgtaatagcattccccttcagctgcctgtcgaggctctgcagaaaggctgccctcagctccaggtacctggcgccctgcctctcccacctgtcacaccctcccccatctacagcctggaccttgcccccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcggggtcagcagtcctgggtggtggccgggcgggtgaggtgtgggggcccttgtcaccttgtagcttatgctcactcctttcactgcagagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcaggtcagcatcccctaccccagtccctggagccagtgtggctgtcactgtgtctgcctggggcctggaagttgtgtcctgcctggcctgagacctccaggggtcagaggggcatgcatactgtccaagcccctgcgtggggtgggcctgaggacaccaggggaactgggcttggccttggtggctatgggtggcagagccaggtgtcgaacaccagcaggcacagctccctagcctggcccagcccttctgaggcaacagctcaacttcctgtggtctgccctccccacagctctgtgatcagcagctgcccgggcctgctctacctcaacctgga

SEQ ID NO: 132108 - DNA, 1034 bp, Homo sapiens
cgctcggggaagccccagggagcggaacgggcgaggcttatagaccgacaaccccccggttcctctcaacgcccgcccgcccgccgaccagcttccggggcgggacttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctgggtacgttttagccaatcctccccatctgcgctcctgcccggggctcccccagttcccctggtctcaccctgttctgactccggctctgcatcctatctgtttctctgtttctttcaagctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggtgagtgggagggaggtgcaggtgtgcccaagactcctgggctgcggtcagtgggatctgggtggagcta

SEQ ID NO: 132109 - DNA, 1025 bp, Homo sapiens
tggccatgggtgtgctgtgcaggtacacaaggacccccagcccctgtgcgggtggaactcagggctgggagccaggtcctggcgcagtcagccctgacattctgctcgctcactgcaggtccttggcagggctgggcggcctctctctgctgggcgtgttctgtgggggctacctgatggcgctggcagtcctgagcccctgcccgcccctggtgggcacctcggcgggggtggtcctcgtggtgagcacagggggacatgaagtggggtgggggggcgttgccctggagcaggcacatctcacgctcagctggtgctgtgtccccctcaggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaatgagttggcattaattctttgagcacatctctctgtgtggatgcttccctgaactagagccatggcctggcctgtttaacaggctgcctctccccaggccctgggcaggtccttacccaccacaggctggtctcacggattgtacagtcatgccctctgagcccagactaccccacattgcttcttggaactgccctgggctctctgggcccacacgagctacc

SEQ ID NO: 132110 - DNA, 1037 bp, Homo sapiens
ccaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtatatgggggctgccttgttcagcagtgggctggggcggggcacagtggggccccaagttctcaccacaccctcgcccagtgcaggtgcagtacatcgacctgcgggaccgctttgatggggacatccacaccctggagctcctgctgcggctcgttgaggtcatgcaccccagctttggcttcagctgggtcctccaggtacagccccaccccttccccggccagcaggagcaaacacgtaggcagagctggtaggagcagctggtaggcagagctggtcttcaaccgccatctggcccccaggacctgaaggggaccctggcccaggagctggacttcgagaatgagggccgcaacgcagagcgctgtgcgcgggagctggcgcacttcccctacgtcgtggtgccccgcgtgcactgggacaagtccagcaaggtgggctgggccaggcccttggggtgggcacagcgctgggcctgctgagcccagcctcttgctctccccagcgcgtgctcactgccgacttctgcgccggctgcaaggtcaacgatgtggaggccatcaggagccaggggctggcagtgcatgacgtgagtgcgggggggcgggggcgggtcagggcgggctggtgctgtgtccactgcaatgcctctcctctccccagatagcagaaaagctcatcaaggcctttgctgagcagatattttacaccggcttcatccactcggacccacatcctggcaacggtaggaatttaccccaggggtgggggtctcggggtgggcgcagcgcgacctaagaggctgtatccctagttctggtgcggaaaggcccggacgggaaagcggagctggtgctgctggaccacgggctctaccagttcctggagg

SEQ ID NO: 132111 - DNA, 1478 bp, Homo sapiens
tgcccagctgggttttctgggtatgtgggcagggccctggggagctgaggctctgggggtggccggggctgaccctgggcctctgctccccagtgtctgaccgcgaccgcaacctcatggtgtacatgtacctgcccgaaggtgagtgcttcctccaccccctctgcctgggccggggctgggctagcagtgacccctaggcctttctggtctagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttggtgagtgtgggggagcaggtgtgtctgggtggggggccctagggttggcctggctcacaccaaaaccctcaccctacccctgccagccaccctggacggcggcatcgggctgctgctgcccatgcaggagaagacctaccggcggctgctgatgctgcagaacgcgctgaccaccatgctgccacaccacgccggcctcaacccccgcgccttccggtgagccccggccccgcccgcgtgcagcaccccctccaccccagcctgccctgacacctgtgcctgtacgccccaggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacatagtgagtgcgcgccccgccccccgcgcgccccgcccctccgtgtgcatccccacccacccacccacccacccttccatcccctgcagatcctggacgacttgctggagacggaccgcgtcaccgcccacttctagccccgtggatgccgtcaccaccagcacacggaactacctcccaccccctttttgtacaaaacacaaggaaaaacattttttgcttgagaggagtgtgtggtcattacacggcctcctggcccagctgctgtcacagccccccagtgcgagtgcccacggggctcggggtgtctacacctctagccccgccacctccgtcagcccaaggtgaaaagggccccgccggccctgggcggctgcaccctaggtctccaggtactggtagagctcctccgctgggggcacgaggctcaggtggaccagagcacgagccaggagggcggtcagccgcatggccaaggtctccagcctgcgtgggtcaggtcacaggtcacaggtgggtggggagcaggcccccgccacccacctgccccgcggccactcacctgagcgccacttcaaacttgagcatctcccagacgaccttggcgtggcgcaggaggctggtgccgtagacaccccgatacgtggcgcccgccaggcggctccagccccggacagcc

SEQ ID NO: 132112 - DNA, 1070 bp, Homo sapiens
caagtttgaagtggcgctcaggtgagtggccgcggggcaggtgggtggcgggggcctgctccccacccacctgtgacctgtgacctgacccacgcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagcaaaaaatgtttttccttgtgttttgtacaaaaagggggtgggaggtagttccgtgtgctggtggtgacggcatccacggggctagaagtgggcggtgacgcggtccgtctccagcaagtcgtccaggatctgcaggggatggaagggtgggtgggtgggtgggtggggatgcacacggaggggcggggcgcgcggggggcggggcgcgcactcactatgtctggtgtggtgccgatcttcttggctagctcgctgcgctccatggtgctcaggtacaggtagcggttgagcagctccccatccagcacgttgcgcacggcattctggagggtgcggcggtccacgtgcagcatcctggggcgtacaggcacaggtgtcagggcaggctggggtggagggggtgctgcacgcgggcggggccggggctcaccggaaggcgcgggggttgaggccggcgtggtgtggcagcatggtggtcagcgcgttctgcagcatcagcagccgccggtaggtcttctcctgcatgggcagcagcagcccgatgccgccgtccagggtggctggcaggggtagggtgagggttttggtgtgagccaggccaaccctagggccccccacccagacacacctgctcccccacactcaccaaaccacgtgatgtgcttattctcccacacgaccgactttttgctgagcccttcagtg

SEQ ID NO: 132113 - DNA, 1022 bp, Homo sapiens
gcccatcccatgttctccatggccctgcccgttcccccatggctcccctcatcctgccaggtgcatgtggaccaagagctgcttatctacgaggccttcccccacgactctcagctcggccagggcaatctcaaagtccgctttaagaaggtgccagtggctggactgctggggcgtggggtgggtgtggtacaaggtgtgggtttcagaccggcagcccctggaggacctgcatggttcccccccaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtaggccagcgcctttgcaggggtctgtggtagaagggagacgcggcctcatccgcagcatcctcatccacagcatcctcacggtgcctgcccccaggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacaggtggggtccggccggttcccagcagcactggctgatgctgccccagctgggggctgagggggaggggacaggagaagggaccattggctccaccctgaggaccaggaaggagtgtccagagggcgatggggttgaggtcgaggaggtggaacctgtgacttggttgctccaaaggtctggaaaggggtggttgggagctggggctgcagcccctggggtccccaccactgctctgccggctcgccgggcaagccctcgcagggcctggcctccacacttctcaggagagctgacgtgagtgctagctctgccccttggctgctctgtgactttgggagggcacacaggctttctcatcctggttccctatttaagccacc

SEQ ID NO: 132114 - DNA, 1047 bp, Homo sapiens
ctctgtgtgcagctgcgggtaagtcggtgccgcaggatgaggtggacgagattgaagtgtacggcagcgaggcccagtcgggaacacagctggccacctactcctttgaggtgagattgaggcagcagggcccccgtcccagccagcgcccccagcgggcccctgactcttgctgtgccgcaggtgtgtgacagcatcctgaacattggaccctgtgccaatgccgccgtgggcgagcctgccttcctctctgaagaggtgcccagggttggggtcggggctgggggcaggggctggagtgtgagggggggtggggggcatagtcctcacccccgagtcctgtgcagtttcagaacagccccgagccggacctggagattgtggtttgctccggccacgggaagaacggggctttgtcggtgctgcaggtgtgtgggcaggtagggggcgggcgcctcctggtgggacctgggtgggctcacacccccatcacacccccaccccatcatcattctagaagagcatccggccccaggtggtgacaacctttgagcttcccggctgctatgacatgtggacagtcatcgccccggtgcgtaaggaggaggtaggtgcgagcctgctgcagggaggccctgggatgggaccggcgctgccttctcataggccgggggtgcccaggtcgcacctgcgtgcctgccttcactggactgtggcttccagcctgcccccctttggccctgacaggaggacaatcccaagggggagggcacagagcaggaacccagcaccacccctgaagcagacgacgacggccgcagacacggattcctgattctgagccgggaagactccaccatggtgaggggcagggcctgggacctgggacctggggctggggtcccctgcggggggcgcctccctcacagctgtcgcccgcagatcctgcagacggggcaggagatcatggagctggacaccagtggcttcgccactcagggccccacggtctttgctgggaacatcggggacaaccgctacattgtc

SEQ ID NO: 132115 - DNA, 1253 bp, Homo sapiens
agtgaaaagggaggagataagagaggcagcctgggggagcccgaggcgtcaggatagcgcagggcttcctcttctctaacaggcacgcagatcagtagctacagataccccttggctctggcttcctgccctgtgacatttggacccaggggccggggctgggctgctgtaggtgtgcaaccaggcaggtttgggggtgtgcagacacagagtgcactctaaccctgagtgcttgccgcacagggcctggctgctagggagccgtgaggtaggggcttcctggggaggggcctgtgccagggctgggccgtgggcatgagagcgtgaatgggggtcgctgtggggggctgtgcacagctgtctccagaagcccttctccctgctgcagagagggtttgggcagagctcccaggaggcaggggccaggcttggtggtcttttctcgttccccggatgaggtgagctgccagatgtggcccctcactgccctgtctttctctcccctccaggctctgaccaagaatgacaggagcacaggtgagtgtggtggggcggcctggggctgtgcgggtgccaggcatggctgggccctgaccctgagccctggtgtctcccctagaggggaaggcccaccgggagaagctcgagcttgctgcctccttctccttctttggcaacgtcatgtccatggccagcgtgcagctggcaggagccaagcgggatgccctgctcctaagcttcaaggatgccaaggtgagtggtaggcttggtggggtaggcctggccaaggcgtgggagtgggtgccagggcctgggtacagccgttggttgccgggggcgacactgtcaggaccggcagtcggcagccacggctgtgccctctgaccgcagctgtctgtggtggagtacgacccgggcacccatgacctgaagaccctgtcactgcactactttgaggagcctgagcttcgggtagggccgcgctcccgcccccgcccaggccccgcccagccaccctccctccccctgcagctgggttctgtggccccaagtgtttccctcggggtctcctatgctgggcctggctgatgccccctctgcccccaggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtggg

SEQ ID NO: 132116 - DNA, 1688 bp, Homo sapiens
cccctgaacccgggagctacgagcggagtcgcttctccctgcagccgtcctgggtctggcgcggacgcaccccccggccgaccccgagccgctgcagccggcgcccctgcggcttccaacccgcgctgctccgcccgcagcggaggccccgcacttcgcgcgctaggggtttgggttccggacgcccagcccggagccgagccgccagccgcccgcatcccgggccactagggcccgctgtcgcccctgcagccacgctcacgcggcggcgctgcgcaggcgcagaagcccggaaccttcccgcccagcttctgggcccggccggactgagttcgctgctgtcccggttcctctcgagtcggctccaactgccaggtgggcggccgggcgggcggccgaggcggcagcgcgaggccggggaggggcgcggtgcggggccgggctcctgcgtgggcgaccccgctcacccttcctctcccggccttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggtaggtcgggccctgggagccctccccgctgtccgcgacgtgggtgctctcaccgcccccggttgcagatggaagagccaagccccagacaagttgagtgatttgcttaacgttcctcagcctgaggagccaggacatgaccctgaatctcttgtgctcagatcctttctcacagctgctaccctgttctgcctcccttcctaccccaccgggaagggcgcgctgccctagccgtcttgtttgctcttccgttttttcagcaagttgttcggaaggagcgaacgcccactgtgcgctgggtagcagagataccatgtgaaccacacctgcagacacttggggaaggggaacatctaaataaacacacctgcccctgcagcaagtgctgctgcgggaataaaggagtgaaggaaggagactgtgtatttccagtcgcatgatcagaagagcctgtctgaggcagagcgggagtttgtcgggggaaggacattggtagcacaaggaacaaggccaggtctaggatggggacagactgttgacaggagtcttggtacagtggggcacacgcctcaagggtttgggaaatacagtggtgttttggttgccggagggttgaaagctggtccaggaaagcaacttgcaagaggcagtttctccattgctcttgaagggaggagtacctcttacccaggcccagggatggtgagaggagggtgttccaggcagaagaaacagcctgtgcacaggcccaaagcagttgagggtggagagacatgcacagtgtggccgtggtatagactggatgtggtggtggggatggagggaggtaggccgtggtcaggactattctccacaaagcagggaggagccacaagagggttgtgaataggggctgacccagcaggcagatgggtcagaagctcaggccaaaggaggccaaccctcctgggcacctaccccggcatacatatgtatttgctggccagggctcctgtcctctgaaggcttgacgagggctggagtttctgctcctaacaca

SEQ ID NO: 132117 - DNA, 2052 bp, Homo sapiens
ccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtctgcccccacaaacccgcgaccctggccctccgttccccaccatggactcccaggccatgccctcccagggaccttacccaccccacctcctgacccctctccctgggtcttggtgggaggcaccctgggacctcccccccagcccagcgcccctactccccaggtgctggggctgcatacacacagcgaagagggcctcagcccacagcccacctggcgcctcctggctatgctggccgggctctacgccttcttcctgtttgagaacctcttcaatctcctgctgcccagggacccggaggtcaggcttcttgggaaggtacccggcgggtgggtgtgctgggggcctggtggacactgagcacctaccctcacaggacctggaggacgggccctgcggccacagcagccatagccacgggggccacagccacggtgtgtccctgcagctggcacccagcgagctccggcagcccaagcccccccacgagggctcccgcgcagacctggtgagtgggcgccagatgccccatcccgcgcggagcccctcccaccgaccccttcccacgcccacactcccagccccaccccaggcctgcggctccgcctcccgcggtgatctggggccccgccccgccccaccgcgttcctcctccacttccgggcgggacttactcaaggctcctcccaggtggcggaggagagcccggagctgctgaaccctgagcccaggagactgagcccaggtgagcccagggggcgaccccggaagggctgggggatctggggtttgtgtggagcgcgggtggggcccaaggcttggcggtaggcgacaggccacgcgaacccacgggcctctgcgcccgcagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggtgagcgcaggcggggcctggaaggagatgggcggggccgcacggggctgggcggggagacctggaacaggtgggcggggcctggaagatgggcggggccgcacctggctgggtggggagaccggaaacaggtggggcggggcctggaaggtgatgggcgggatctgacggctgggcggggagaccgggaacaggtgggcggggcctggtggtaagagggcgggaccgaaaggaggtgggcggggcatgtagctaggagggcggagctgttaatgtggactcgcccgcaggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatggtcaggatggcgaggggaggggctgctctgggccgggagctgagcagaggagctgagcaggggcgctgacccggtgcccacttgctcctcagctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggagcatggctgtgctctccttgctgggtgggaagggccctcagctgagaaagga

SEQ ID NO: 132118 - DNA, 1046 bp, Homo sapiens
agaagcacttgaacccgggaggcggaggttgccgtgagccaagatcacgccattgcactccagcctgggcagcaagagcaaaactccaactcgaaaaaaaaaagaccaccgaggctgcctgtccaggggaaggggcccagccctcgacccccacaggcagtggctccaggctgttggggaggatctgccactggaatggttaacccaggcatctccagcagccaatcacagagctctgcaggaatacctgggagaggtcctcatgcagcccgggcgggtcctagcccagccccagtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaaggtaacagccccacccgacgggtcccccagccctggcctcttcccgccagctccgccctgccagccggcagcaaagggccctgggcaaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccc

SEQ ID NO: 132119 - DNA, 1009 bp, Homo sapiens
aggggttgggggccggggtctccacctggagccgagctacaagccccactacgtgctcagggcctcacccccaaaagctactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcgtgagtgcctggtccttccacccccatggggcgagactgtcgggcatgggtatggggtgccagagggctctggccacctggggcttgctgtcctgagagccccagcacccatgtcacccccaacagctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgctgggtttgggaacagagtacagtgaggaggcccaagtgacagctgtggctgaggaggggttggggcccgtgagccgtggggcctcccgcacccgtggacacgcgagcctcatgtgcacacctgcccccag

SEQ ID NO: 132120 - DNA, 1050 bp, Homo sapiens
ccagggccaggccgccttttccaggaaggcccccgagtgctggtgtgagaccccttccccacacctcagttcctggcatctgtaccttcccacccagctccctgaattcctgagcttagtgttctcttgatccactcaggcccacgatgtacagatttgcaagcagatccattatgtccttcttatgggtggggagactgacgtgtaggcatggactttgagatcgggcactgtcagaggtaaagaagggagccacccttcctcctgtctgaccgctggctgtgcagatgatcccaccccttcctggagagtcatggggcctctccggagctctgcccactgcccctcgctacagccctggggccctcagcgaaagcgagtttgttccctggagcctgccgcgggcaccaggacgccgccggcccccgcagcgctgaggtctgccctcttcccctccgcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctgctgcctccctccccgtggctgcctggca

SEQ ID NO: 132121 - DNA, 1050 bp, Homo sapiens
cctccacgatgccctcaactgtggccacttcgaggtggctgagctgctgcttgaacggggggcgtccgtcaccctccgcactcgaaaggtgagcctggtggggcagagggcaagggcgaggttatgggggctgctgtgcccctgctcaactgatgccacacagggcctcagcccgctggagacgctgcagcagtgggtgaagctgtaccgcagggacctggacctggagacgcggcagaaggccagggccatggagatgctgctccaggcggctgcctcgggccaaggcaagcagggcgtcccttgtccctggggttgctgtgcctacgctgagagtccccgggccctgatttcgggagatgctccatcacaggtggagcgggaggtgccgggcccctgcctcaacacgcattctctctcccacagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtcc

SEQ ID NO: 132122 - DNA, 1049 bp, Homo sapiens
ttctggagccctccctttgcaaggctcttgtgtgaggggtgcatgccccgctcaacctttcccctggagatcgtcagctctttatccactctgtgctccatctgccgcaggacacttgcacccacctcgggaggagggagggggtaggagaggcgctgcacaggccccaaatggggcccaaagctggaaaccccatgtggggaggaagtggctgagtgtttgggggggtatcttccagggacactggcccagggagagctgaatgagatgaggacccgcctctatctcaacctgggcctcacctttgagagcctgcagcagacagccctgtgcaacgattacttcaggaagagcatcttccttgcggagtaaggccctgccccgccccaggagggagtggagtcccttgttcctggaggaagtagttaggggagtatttttcccagagtcctcctgagagagcagtctggctgggcctcatccccccacctctcacacctgtgccacacactgggagaaggccaggcatggttagggccctgagaccacagcatggcagggctggggcccgtgtggcatcagcagctgtcatggacactcctgggtgctcagtggtcgtcacccctctgcaggcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtacccgctgtgcgtggctccgagctcaggctctcgtagattcgggccttggggattctgcaaaacctttgctgtcctttgctctccaggtcctccaagacctgggagactttttggctgccaagcgagccctgaagaaggcctacaggctgggctcccagaagcctgtgcagagggcagccatctgtcagaacctccagcatggtgagcctgggggtgcgaatggggccctgggaggtgtgtgc

SEQ ID NO: 132123 - DNA, 1049 bp, Homo sapiens
cggggccgcggcgcagcgcgggaagtccggatcccgcggcgatccgagcatgagcctggagcgcgagcttcgccgtaagttcctcggggaccccttcctccgggggcgcggaggctggggagggcttgggactcggccccggccccggaccccgccgcggaggcccagccctcctcttcctcccacagagctgagcaaggcgaaagccaaggcgcagagggccgggcagcggcgcgaagaggccgcgctgtgccaccagctgggggagctcctggccggccatggtgagcgccgggaccaggaggcgggaggcagggccggggcccgggcccgggccgggatcgggggccggggggcgacgggctcttccggcagacgccgccccagggccgccctcgcacccgcgacgcctgccaggccgtgctgtgcccccgcctaggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcaggtgcgggcgccctcactggcctcgtccagcccggtcggcctctggagcccttttctgaggagggaggcctggtcttcgccgtcaggagcctcgggctggaggggacacctgacctgacgcagccttgccttcaccgccccgggccagtcctccggtggggaccccacagcctttcctgggactggggcaggagtaggtttcctggcaccagaaaccattactgaacgttattttagctgtgtttgtgttgggggaggtcaggccccatcccaaaagctctccctgaccctggctgctggaggcaggactgcaacccccccgccaactcccagctgcccctccccacgtgacagcgttggctgcatacagcgtgaagccactgtcaccacagagagcccttggcatgcagaggaggggcacgtgtctggccttggcctgctctgtgggggttagggggagcaggctct

SEQ ID NO: 132124 - DNA, 1231 bp, Homo sapiens
ggatgggatggaccagagccaccgcaaggagatgcagctgtacaacagcatcttcagcctgctcagcttcgagaagattggctacacaggtgaggcgccccgccgcctgctgcatgccacacaggtgtgggttggggggctggcagccaggagtctgggggcagcaggctctgggcactgggcactgacagcgccggacagccgggctctggacaagctcccggtggacaggtggacacctcggtcgagaagacaggccggagactgagtggaaggaggggccgaggcagaccccaggtgcacacctgtgtggctctcacagcagccccgcccacctgtcctcgccaccctggcttcaccatccctgcaaggtggcatctcactgtggggctccagagcctcaagacagtcagggtctaaccagaaagtgggcaggtctcagggggcctgggagctaggggcctgcccctcggaccctggggcaagaagagcaccctgccgagtgaggtcctacctgcaggcagtcactgccccggccatgggcctctcaaggctggcacgaagccattcagggagagggctccacaacaagctgagggtgcccgactcaaactgtagaaccgggagtggacacccacagacgcccaggctggatgcgtgcgcaggcacactggatctcgtggctctctgggccgctgccaccgcctttgaacgtgtcggggagcaggagccaggccagagcctggcccagaggacagcgagaagcacctgttgatgctggggccactggaggaagctccatccctctactctcagcccacaccaggcggccagctcagagcaccaggcgtggcgcaagcagggtggtcgtgggcagccagtcccgccctgctgcctggactgtgcccagcgggatgtgggcccgagcaggccagagaggccgagggcctggggtctctgcggcagccacagcccgtggtgagtagcagccttagctgtcctggagataccggggcctcgtggagtctaggcaggctggggcactgtggctgtggccgtggccaggtgagaagccccattcgcgcaggaaagactggccacctgggaacccacgcctccacggagggacttgccggccacaggctgtgggctgcccaagaggactgtgcaggcagggctgcctgctgattggcagctccggatcaggcccggtgcctgcagacctggtgct

SEQ ID NO: 132125 - DNA, 1002 bp, Homo sapiens
cagcttggctcctgcctcccagctctgaggaggtctctgcaggtagccaacctccctggacgagggggcagctgcctcctctcacctgggctcaccctgagccaagtcctctcaacccaggataaatggcctttctgaaggcccagagagcatgcctgccccagtgtgggagctgcatccgctccccacctgacagtgatggccaagagcccagtgttcctggagggctcccaaactctggacctgtaggggggtcagggcagtcgctggtccctaagggaaaagcgtgaccctcggccccaggtggctgaacccgtcactgccagggcgagctgtcacctctgtgagctgatgaggccttgcttttaggacctctaatctctgcaagaacccaagctggctctgcctgtttctcctgagcagctcgcagtgttcaccacactccagcacgactcgggacaggcacgtgcgcccctctgcaccagctggagtccctcaggacacctggctggagctgatgggcatgggcgggtgtgtgcgagcatgagcccgcaggtctgtgagcttcgtctccctttccttcttcgcagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacaggtaactgagggtcaggggcttagccttacaggcggggcccaggactgctgggagcccaccctggtgcagcagggccctgtgcagggtggtctggctgtctctgctgtctgggccttggggaccacctgtgtagcccagtgacggccctgtgggagggtgcctgcacaggatgg

SEQ ID NO: 132126 - DNA, 1544 bp, Homo sapiens
gttcctgccggctccctgctctgcggcccgagggcagtgtggcctgttggcacctctgcccatggggcacctcctctgggaagagacagcctcagcggtgcccgggacgttgcagccgcagcctcatccctgacttctctccctccattttggcccttcagacgaggcccagtgtgatgctgcgtaagacagacctggccctgacccttcctgctgctgtcagatgaggccctgggccttggtgctggcacctggaggaagggactgcgcattgttcccacccctcatggggcattcttaaggcaaaaacgggctcactcgggtgtaagtgccgggcaggggcctctcacagatgtggtccagccgctccctctaactcggccctgcacagtgccctgccattcccatgctctcctgcctgaggtgtcctctccctgcccctgcccacctcttgggcccggcagaggcagcgcccccactttgagactttgttctctccttgctacaaggatcccctcctgccccatctgaccagggtgtgtccactctgttctgtgggtgggttggtgtgtgccgtggccctcccgcctgtagcgcccatgtctctatgccacatgttgacagtccattgataacagcccaggaagcagagatggctcctctctgcccgagccccacacccccaaccaggccaacagtgtgcagtcctgggggggtggagtcaccatccacatgtccaaggagcttcgggcccctcttccccagtctcctgggcagcagtacaggactgcagctgactcgttctttgaggtgaggaaagtggcagaaaacatctttgtaaatacgtctgcttaggtatctaaaacacaggagcaaggaagatgttctggaatctctggctagttggaatttttgttttctgtggtggttatcatttgagttacttttagatctaagcagccttgttctgaatgtgggcccgactctggggattgattggccaccgtttgaggtctgacagcagtagcaggtgagggacttcaaatccagcctgggtggagggttcgagtcctggcttcatgcttaacagctgtgcggccttggacaacgtgccagtccctctcagacccatgtttgattcgggaggttaggggccgagcacgcggggtgcatggggtgtgccctgaagcaccactggccctggtgaggccttgcctgcatgcagatggcagaggaagggggacctccaactggctgagcagcgcttttggggtttgtgccacagggaagccctttggctgcattttggctctgacgacctctgtcaagggcctgtgggtccctgacccctgggtgagcgagggcactgctcccatgggcctgggcactgtgccatcctccagtggcaaacaggaggtccccagggtctgagagaaccatgcagtccaggtgtgaaaggggtcctacaaggtcagctgaccatagagaccttgggaccaccaggaaatcgtgggggccctcagccaggggatggggtcagggct

SEQ ID NO: 132127 - DNA, 1036 bp, Homo sapiens
gcctcccgagttcaagcaattctccctacctcagcctcccgagtagctgggattacaggcgcctgccaccatgcccggctgtttttgtattttttagtagagacggggtttcgccatgttggccaggctggtctcgaactcctgacgttgggtgatccgcctgcctcggccttctgaagtgctgagattacaggcatgagccactgcgcttggccagaactttttcttggatctcgagggagactccaacaagccaagccaatggtgtgaggccacgggggaacagggaagtctccttgtctccccattggtgggtgggctggagctgtagctggacctggtggtgatgggccacatggtactggtccctggtgcactgcatcccccatctagactggcccggcacagagtgatggctctgcttctgaccggagctcctggtgaccaggcctctgagcctagctggttcaaaccggcctgcactgtgcagagtggagttctgctctgggcggccagaggcagggagctgaacaggtgtaatggagaccgaaggcgctggggctgccctggctggtggccctccctggcctgggggctctgttcagtgacttccctgggaacagagcagctgagcgaggagtgctgtgggcacaggcctccctgaatgctgcgaagaacacctccggcgggtggctctcggctgtgagtggtgcccctggaaggtcaacacagacctggagacctgggctctggcctgctctgctccctggagaatctgggcacagatggtgtgggcccccacatgctgccttctgcgtgtccctggttgggcccatgctggccatcaccccagcttgggttcagtctaccatattctactagctttccttggtgaccacgttgattggctgtctcgagccagccagtgtcaggaatgcagcaggttccaccctctgttcctgctagaacgcttttcctgaccccagcagaacacatggctcagggtgggcaccagccaagctgggggctgacttag

SEQ ID NO: 132128 - DNA, 1080 bp, Homo sapiens
gcagcgggaaactggaggagcggctctactcggtgctgtgctgcaccgtgtgcctggacctgcccaaggcctccgtgtaccaggtagggccgccggccgaccccgacccggcccagcccggggctgcagcccccgccgcggggccccaggatccgcgtctcctcggaggccaggcctgcggggcccggcggccgggaaccctctctggcccttacagccacttcctcgcccagcggggctccagcggctgctccgaagctcctcgttgtctttctctcagggctttattttccgctcgggaccccccttttctgttttctgatccacggtacttcccgatctgaatcgcttgtcttccgcttacctctcccttcttttttctagacttccccacggtcccctgaacactctcccaacccacagcctcaaactgatccttagcccgcaactgctccccgcaacccacccggtcccaagctccctgggctcagagtcctgtgctcgagagctccttccccattcttccggcagccacacccccgagtttgtccctccactcctgaacatcctatggacgcctccttttctaccctcctgggtggaagaatcctttctcttggtccatttccagttcatcctgaagaacagtaaggagaggggattgctgtttgtcgggatgaaccatttgcaacaagccccacagtttgggtaccttctccagtcccagccaaaccccacatccaactggacttgccatgccccacgctaggctcctgcccacctcacccaggccaggccaggcttcctaggcagccagtgctccaggagccggcccacccctcctcccccatcttcacatccgcatggcagtgggactcagcccttaagcagcctagggctgttagggtacctggcccaggtgggtttgacatgccctttcccaggtagcagcagggacaaactggttgacacccagaggcagagtacagtgtccccaccttccctgtgtctttccctctctttcaactccccagtccctgtgagaaatgaagcaggttctctgtcagctttctttacact

SEQ ID NO: 132129 - DNA, 1033 bp, Homo sapiens
ctgtgtggtcactgaggttccatgattggatggaggtggcactgaggatgacattcaggagcacatcatggcaccactgcagaaacaggaacacagatgaggggcttgtccacagatgcctttggttcagacacattgactgagaggaccctgtccaggacggctgtccagaggacggtgcacaaggcatgccctgcgcagtgctgcagtgtggggtggggctaaggccagagggatgtgtgggatgaaggaagaagtggttggaaaagaggcaatcagggtgaccctggccacctgctgggcagtcgtccccctgtccctgtgaggctggcaggcagcctggttgggagtcgctgccattctgccccttacctagtctcccctggctctgagctgccatctccttagctatgggagctgtagcagcaaagggcatgtgcagatgaaaacgtgtgtgaaagtggggtgggctggggctgaagcccctgcttttccacaggtgtctggcaggaaaagggtggggaaggagagtgggatccaggcaaggcagagagagcacactaagactagaaggttgcctcctcacccacggcccccaccacccaccgcctgccttggggccataaagcaatgaggggccctcatagctgggcaaaccctggaccccagcaaaggggagtgggcaggcagtgaagcctgggaggaggaggcaccaagctgggctgcctgccctgcttcccagccccctcggttccctttccttcctggctagagcccagccaccctctctcctccaggtggacacccagactgggaaggggaaactggagcctctcctgctcttcagggaactctgaaaaagggtcaggatggctgcaaaggcaggctgtcacctcctcctggctggcgtctggagggaagacccagtctaggcggaatcgacgatggcgcccccggtagcaggtggtgacggtgccccctgggccaggctccacactcacaaggctagaagatgtccctggcctcagccgac

SEQ ID NO: 132130 - DNA, 1076 bp, Homo sapiens
gaggggcgagcgagcccgacatgggggaaggccgggcctcgggtgctctggagactccgcagggctcaggcaccggccgtggtacctgcggtgcctggagcgcgcggtggagacgccgcgcgcagcgtcagcgtgaccagggcatgcgagcgggagctgcgctggttcatggcggtggcggcggtggcccggttgctcctccccagtttcagcatctggaaggcggggcgaagggctggtcaggtgcagggtccccgcccccaagtggaagcacggggcggggtctcggagagcggtgcagccctacctggtgcaatgtctccaggttgggcacgtcccagtgggtgaggccagccacctggatcccgccctggccttctgggccctgcctcacggccaggcgctcgggaggccctggagcaaggaggtccctggtgagaaaggggaaggtcttggttccagaattctctggaaatccggaagggccctgggccaggggtggggagaaggcctccctggtggagtagcccacctgacagcctcattgtagatctccaccatgctgagtgtcacccggtgctgccggccggcccccatctcccggaacagcgactgcagcgccctaggaactatgccggggtcctcaggagggccctgaggatggggtggggtgcacaccgggctcacatccaagtcatgcagggcccctggggcctctcccactggggcgtgagctctgtcccacctccatgctgtaggtcttcccggtgcctgtctggccataggtgaagatgcagacgctgtagcctcggaggcaggacagcaccgcaggttccagctctctgaagacctgcgggaggcgggagaatgtgttttgagtcctccccacgttgcctgtttatgccctatttggtggggtggggagtgccacgaaggcaggtgtgagcagagcctagtctcctgggaggatggctctaagggaccatgggggagggtgtgtcctacagagaccctctgtctccctagagaaggtggtgcttgcaagaatttgccaggcaaagaagggaaaagacaca

SEQ ID NO: 132131 - DNA, 3018 bp, Homo sapiens
cctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccaggtgagcgggccccggcccccactctctctttccccagactcgttccccacccacttccaggttcaagccctgacccccaccccttcctagcccacccaggtatgccagtgggaccagtcctgagagctgagggcctcaaggcacgacccttctccgggagccccttgccctctctgccgcgcttccgcgcagaaatgtccttcttcggggacagcaggggccggcaccgcgcgcccctgagcccggtagtgggggaggggtagggcgctaccccctccccgtctgggctcacggcgccggccggccgcctggcggtttcagatcatccgtcaggtccaggccgtgttccccttcttcagggaagactacgagggctggaaagactccattcgccacaacctttcctccaaccgatgcttccgcaaggtggggcaggccagggtcggagcccgggggcggagcgcgcgcggaagtcctgagcatccaaggttgggcagccccacccatgtctgacccccacacccaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagaccccatgggcagggccgcgacccaggactagaggggcaggccctctgcgggcgcgagagccgagcccgagccgttgtcgggactggggcatggaggactgccaggggacggcgtaggggtgcagggggtcccggtgagcggagtgtcggtgctgagggaagaaggcgtcccggaggagcgcgggaccctgcggcgccgggctggccccagctccacttgacccactcggtcggcgaacttgagggagcagactgtctccccgagatcctccggccgcgtggagatctgcgggcaagaggcgcgggtg

SEQ ID NO: 132132 - DNA, 1007 bp, Homo sapiens
acccgcggaagccagcggacccacttgtgcggcggtcggcgcggggcgcgaggtgaggcgcggactcccgggtcctgcggcgggagcggagcgagggagaggggccccggccagggagagcagtggcgggcccgggaaggaggggcactgggtcgacaccgagagaggaggccgggccggggaaggatgaggcagaggagagggaggaggccgggaagggcgggaggaggaggagaccgaagggagagaggaggctggcgacggaggaggccggggaggggccctcgggagacgcggctgccggcacgcgggcgcccagggcacaggtcccgccgggccgccttgggcgttgctggctgaggcccagggcagcaggtgccaacggtcaggaaaggcagggagccgaaggctgccggtgggcgcttcgcgttttgttccaaggcgaaggtgtgtggattctccgcagcccgtcggtcaggtagacagctccggaattgtcttcattttcagatgaggaaatcgaggccgcagagaagggacttacccaaacttaagctttgtgtgggccttggagctaggctgaaggagaaagtggagtctcactggggcaagttccttcaactttcagggattcaaatgacctcacttgtagtgcggggcgtccggaccacccctcaggaattgggatcagggcaagaattactaactaagcaagcaccccgcctgggagggagcgtccaggactggtgtgggcccctgtctgtaccagagcggaggcccggggcacggtgggattaatttccatgggtgcagagaggggagccgtgtacggagtcattctaggcttaggggagacagagcaaagttagccttccccaaacctctgtgccttccttttcttcctggattcctacctgggggtggaggtggaggcgggggtaccgctgcctttctcaaagtgtgtctagtccagcagtgagccctcctgggcgtcttggcgccccagt

SEQ ID NO: 132133 - DNA, 1050 bp, Homo sapiens
ctctgtggacaaagggtgggcctcacacagggcaggacctgagacagctggaagcctggtctcacctgaggcccagggcaggggctcccccgggccaccctgcctcaagccggccttgatatgcttccttgttccccacttctcaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaagga

SEQ ID NO: 132134 - DNA, 1574 bp, Homo sapiens
gcatgctgcggccacctgcggccacctgcacctggtggagctgctcatcgccaggtagggcctgttgggcgtccttggcagggagaggcttcctctcagatggccgctcaggaggctcctcttgggcagtatctgtggctctcggcctcctgtgttcccgccttcacctttgctgaccctgcctgtgtcctggcatggagagcagggcctggggctccaggggaatgggcatgtgcccagggcagcgcggtccctgcctccccagcattcgtcctcctgccgagagggcaggcctcgggcccccccccagagtgtgcacagagaaatgtcttggtcagtgaggagggcagaactgctaaggagggaagcagagtgaggaggccaggtggcttgggaggagagggtacctgagcacaggtagggcctttacctttaacacagagggacgtagagcggggggaactctgagcagggagggtccatgagcctcctcccttcccctttgctccaggcatctgtagtgggagagaggtcagggctgcggtcattctcgagtgcccctgtgaggccgggtggggtgtgcatggcggtcgcgtcacacacaggcgctgcggggcaggcggggatgtggggtgtccacaggtaggcctgctcctccactgcacacagacacccccttctgtgttctgggctccccttcaccgcccttcttccctggggccatgctccccacagctcagcagcccctcagcgtggctgcctggtcctgcacccccgccaccctgtgctccctgctccccagcaggcaggcccatccaatgcatgtttatgggggcaccgctgcccctggaggtgccaggaacctggatccctggatggatagagactgcaggaggcctgtctggcttaatgacaggatctaggacagccgatgggccccaaggctgcctctcccagcagcaggtggacagggtgcctcctgaggggcagccctgggctgaggggccctggcggggacttctccaagtgaggagcctggcaagcggggaagggccttgtgcccagcaccccgtccgtcttccctgcagtggcgccaatctcctggcggtcaacaccgacgggaacatgccctatgacctgtgtgatgatgagcagacgctggactgcctggagactgccatggccgaccgtggtaggtgcggcggtgcggctgtgggagggctgccggtcgcgctccctctgagcctgccgcctcgcaggcatcacccaggacagcatcgaggccgcccgggccgtgccagaactgcgcatgctggacgacatccggagccggctgcaggccggggcagacctccatgcccccctggaccacggggccacgctggtgagggctggggggtgaggggcacacggggctgggggcctcgctacttggaggtgggggatggggccgaattcaggccgggcgcttgcctgcagctgcacgtcgcagccgccaacgggttcagcgaggcggctgccctgctgctggaacaccgagccagcctgagcgctaaggaccaagacggctggga

SEQ ID NO: 132135 - DNA, 1081 bp, Homo sapiens
agagccccgctgctgggggccccatctgaatcgggctgcgaccaagagtccacagtctacgccagggcggagccgccagggctcggtgccggactacgggcagcggctcaaggccaatctgaaaggcaccctgcaggtgaggagtgggcaggcagtgagtccacgctaggtccacagctgcttccggtccgggtcgccctcttgtcattttttccacacagacaggcacgggcccctgtgccaaccagggcacgagtcttcagggagcttctcggggccttcgcccttgactccctttctagtccagccttgtgctaattagcctgctctacaattgagcgtggggactcaggtaggttttagagtctacagtagctcaggggcctgagttcctcctgctgttctgttgttcccctcccaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagccccc

SEQ ID NO: 132136 - DNA, 1087 bp, Homo sapiens
caggttcccctggagggtcttcctcaactgctacagccccagccccctccgatgggggtccagcttggctgctctcctgctggacctgtgcggggctctcccagggctcctcgttccatctccgcttctcgcctccactgctgctgggctgggggctccccacacggatgctgacttcttggaaggctgaagcctctgggccctgggagccagcaccaggaccaaggacagccgactcaccagggatcagaagttgtgattcctctgagcctagatcaggcctgcaggctttgggggcccccagaaaatctgggacctcactgtgacatcgctgtaaccagccaggatctagggagcccagccgctggctcagggatgcctgcagatgctggagccggcctggccttggctggggctcagggagctgtggaggctcatcactgactttttctgcaaaggaggggacaggccctgtacctgggggctttggggtggatgccttagatgaggctcttcctagaggccacggtctgcggcccagggctggtccggcctgggaggggaacaacagaacagcaggaggaactcaggcccctgagctactgtagactctaaaacctacctgagtccccacgctcaattgtagagcaggctaattagcacaaggctggactagaaagggagtcaagggcgaaggccccgagaagctccctgaagactcgtgccctggttggcacaggggcccgtgcctgtctgtgtggaaaaaatgacaagagggcgacccggaccggaagcagctgtggacctagcgtggactcactgcctgcccactcctcacctgcagggtgcctttcagattggccttgagccgctgcccgtagtccggcaccgagccctggcggctccgccctggcgtagactgtggactcttggtcgcagcccgattcagatggggcccccagcagcggggctctggcgcctgcaggagacaacaggggcacaggccagaaaaggctgttgtggcggcagaagcgctcccagccacccctcccgcacctggagcgaggcccggcccttcttcactttg

SEQ ID NO: 132137 - DNA, 1664 bp, Homo sapiens
cctcccttctgtagggaccctccctggctctgcctgtctgtgacccctgtgtcccctgtagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccacccggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcg

SEQ ID NO: 132138 - DNA, 1027 bp, Homo sapiens
cctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcag

SEQ ID NO: 132139 - DNA, 1066 bp, Homo sapiens
gctgcctgctgagcactgcaacagacaggcattgtcacagtccccatcctacagaggagtaaactgaggcacagagagactgcattatgatcaccttcatcagctgagaggcggtggccccagtgtatcccagtcacagagtgttggagggtgtcccagtcccaagcaggctcaggctggggtgtttgtcccaccaggggcctggggacaggagatcagggcctgtcttcccgcagggacagcaagcaggaggcccagccctgccgtctgccccaggccccccagcctagtgactacatgtcccagctgctgagctgaggccctgggtttctgccgccttcctgcaaagctcattccctccttgccttcttgaggctctgaagcctgggtccagtgtgcgtgggcaccatccattctagaaaaacaagggtacctcatagcctgcccagaggggcccttggttccacatggtcccacgctggaggctggggccacatcctctgccaagacctgtggtcccaaggaccatgacagattttctaggacctaaacgtctatgaaaaaaaaaattcattttggttcctctaaaaaagagtctccttagcagtcacatgtcaactattctgtgataattagagatggactcaagacacgtgtgcacttttttttaacctggtccaaggaccccatgccctcagctgtccaccagaaactgctccttcaaagaagacaaaggtgttccgattgggggtcaggatccagaggcccccctcaccctggcaggcggtaggcgctgggcgctggggcaggtctcatgtccagaagcacagggtcctgtccatctgtccgaggtccatggctcccctggccccagacagcttctcttggcgtgttctctcatctgctgcttcccgacctggagcaggaaggtgccgcgccttccagacccagcctgggaatcctctcccctctagcaccttcccctgggctctgtgtctggagactccccaggctgaggtccctgagtccctcatcaggtgctgactcaggcacactgcccctcccc

SEQ ID NO: 132140 - DNA, 2571 bp, Homo sapiens
cccaagtataaagtaaaatccataagtaggccgggcgcagtggctcacacctgtaatcccagcactttgggaggccgaggtgggtggatcatttgaggtcaagagttcaagaccagcctggccaacatggtgaaaccccatctctaccaaaagtacaaaaattagtcagatgtggtggtgcatgcctgtaattccaactactcaggagactgaggtgggaatctcttgaacccgggaggtggaggctgcggtgggtggaggttgcagtgagctgagatcgcaccactcactccagcctgggtgacacagaccctatctcaaaaagaagaaaaaactaagtccatactgatataaatgagtaattcaataggtaggaatagacaaatctgtgcagaataatgacaaataatttacgtacatatccaccctccaggagctggagcctaactccacccctcaggtgtgggccgggcacagtgactcctcctacagagtgtggcacggagcaggaggaggagacggtacctcacaggagcctgccagccgtgacctcagctaggtcatcgaggccagtggcaacactgcggagttacgctgtgcagagcgggaggcagacccagatcagcctgaggggagccccctcctctctgactgcagcacctggcttggggccagctgccttcgcccacttgtttctgttggttttctgaccggcaggcagggggcccaggccatggctgccccagccttgctgccagccagagggcagaagctgcctgctctcctcctgctccccaggcgccttccctgtgttctcctcctgctcccctggcgccttccctgcacctccactcacgccagcacaggcacggcagcttcccagcccacacagtgctcagaagggcccccggcacctctctgccactcacacagccacgtccccccagaaacgctcagcccccagctgcacagggtgagcccccaacaggcccaggggcctgctcaccagccaagtgcgggagctgagtgggcgctggctcctggcgttttgttctgtcgtgctgatggttgtctttgctccccagtgacacagcacataaaagagctcctggaaagaaacactaagaagaagtccaaattgagaaagaaacccaagccttatgttgaagagccggatggtagggcctctccccgcagcccctgggcgcggcgtctgcacagctctgctctccagcctcggccgcctggccttctcttctctaaccgcttctgggcgggggggatggggccactaacctcaggcctgtggcctcctgagcgagctggagggcccaggtgactgactggacccctggagcggtcaagcctgtccacacgtgtctttgtggtgtccagagccatttccaacttgcttgctgggttcttgatggggtgggggcatgataacttgccggctgagggctcctggaggtgcccccaggtgagtgtttgggcctgacccccacagggaagtttgcaggtggaggggtgtgtggtgccctgcagacaagcacccctcagtcctgtcttcccgcccagggctgcccctgggccacaagagccaagcctggtgttcagaatctgcaaggagtcgtcccctgctttgatggtgggcccctagcacagccccagaagcagggggagggcttccccaccctccccaccagcacccttcccacccacactctcacacagcttccacctctctaccttcccccaggccctggctcaggaaagccctgtgaacccagggctgtgctctcccttttgagagctacgctgtcagaccaagtcagctccgcgctcacacccatgcacacacaggcttccagggccgtcctcccgacccctgcagtgtggtcctgccagttagtgcctcacgcccactcatctgtctagagctccgccaccacctctctgctccacttcctttgagaccacttggcttaggcacctcttcctccaggaagccatccctgactgcatgctgcccatgcaggcccagaacagtgccagcgagctttctgtggatgaggtttgcttagggccaactctgggaccagcaggaggctacaggggcacgaagggccctcgtggggaatgccaggatggcatctgctgggctagggacttgtcctcaccctggcacctccgaggctgccaccagcaggtctgtgccaggggtccctggcccagtcccgagtcacccagcctggcctcacccaggaccctgggagaagagggccagctgcaatgtaggggtgagattcctggccacagacgtcctcagaccactccatctggggcagcgtagaaggagctttgcgctcctacctgagctggcgtccggtggcctgagagctggaccgacaccgctggccataaaagcctcctggctgcagccaggcggagcagggagcagactcccctgtgcctggagtggagcccagtgggacattgcggcccagggtgtgtcaggtggggagcagggtcaacatcaggaggccctggccacacctggtggcctgggag

SEQ ID NO: 132141 - DNA, 1140 bp, Homo sapiens
aggaccagagcagggtgccaggcagactgggctggcctgtgaagcccagtccctggtcttgggcccttcaagaagcaggtggaattctaggggctgtgttcctcttggcatcatagttcacctcctcttcctcttccagaggggcctgggaatgtcgtgcctgagctggaggctatggagctgagcccccactgctcagcacagcatgcagcccacagtgggtacccccgagagtaggcaagtgagggccagaagacagccagacaaaggcctgaggtttcttgggcccatcttgggccagctgcctagccaatgtgtggctgggctgtttctgctgtatgtaagtagaggctgtggcttcctaggggagtgtgtgctccaggctgctgcccttcacacttaggctcgtgtgcctttgtccttgtgccttacacctgtggggtcctggcctgcatggaaaaaggaatcaggcttcagcctgggcggccgtggcttcagagctctgccaaagaaggcccatgaaggccaacagcaccgtctgggttggagtgacagcggggctggggctctgtgcagtcccactggcaggtagcctgcatcttggctgtggtactgtggccaccctcacagccagaacctcatctccagccccaggatccactcctaggttcgtctgtcagggtccctgattggccctgagcccagaagagaggcctctacatacacagtggccattccttcccaaatgagcctcacaccccctccagccagcctcctgtgcctaggaggtgtccctttcacatgcaggtgctggctgctgctcagaaagacaggcccagccaggcacagtggctcacacctggaatcccagcactctgggccaaggcaagaggatcccttgagcctgggagtttgagaccagcctgggcaacaaagtgagaccctgtctttatgaaaaattttaaaaaggaaattagccaagcatggtggtgtatgcttgtggtcccaactacttgggaggctgaggcaggaggattgcttgagcccaggaggttaagtctgcagtgagtcatgatcgtaccactgcactcctgcactccagcctgggcaacagagcaagacccccagcctgggcaacag

SEQ ID NO: 132142 - DNA, 1096 bp, Homo sapiens
gtgagtgctccgtgaaccgggccgccgggacaggggctgccgcagtgtgcagtgagtgctccgtgaaccgggccgccgggacaggggatgccgcagtgtgcagtgagtgctccgtgaaccgggccgccgggacaggggctgccgcagtgtgcagtgagtgctccgtgaaccgggccgccgggacgggggatgctgcggttttgctgttcgtgcagccgtgtcggtgcagatgtgcgggttagaggcagccttgccacacaggcgagtcttcactggtcttcagaaggagattggggtgtgattgatcagagagaaatgatgtgttctagttcattctcaggcccggtgagttgtggatttcatgcttcctctttcctctttattcatataaaattatttcttgagacgatgattattttatatatttaatgattcattgttttgtccaagcccaaaagtgtatcctatactgtacgctttacacttagtgcaaagggcgctcgtcatggctgtcggcacggccaagtcactggggctaacatggcaggcacaggtgcaggtgggtgtggcttacagggccgacctcgtatggctcctggctgatttagcacgagcgtaaggaagcttctcttcgggaggcctgcgtgctggtgaggtctgggctctttctgatgggtggagggtcctgcttgtttgcagcacgaggctgctccgtcagctctccaggtcttagctgggacgcccaaggctgctgctgatgccaagcatggtcatgggcctttgcagttggtgtgctgttgtcaccccaacaagtgagggatgcgggcgcagagctcctcactcactgccagtccttctctgggaggctttttgtctgctctgtgtgcttacttgcccagtggcctctctcattcctgattctgggcggtgcatttgacagaggcctgcctgggtgctgcggcctctgacatttgcccagacgttgcttcatgccctgctctgtggtcagtttcagagacactccctggatggtgaatctgtgttttccgtttcttgggtcggcgttctgcacacctgcaaggtaaagcaaggcttc

SEQ ID NO: 132143 - DNA, 1388 bp, Homo sapiens
tgttacccagactggttttgaactcttgggctcaagtgatcctcccgcttctgcctcccaaagtgctgggattacaggcatgaaccactgtgcctggcccctgatcagcgtcaaatttcaggtggtagcgatgctacactggtctccgtgcagaagacttgagttaaacattgacttaatcgctgcctgtgtgattgagcacagataagtcagttaagcactcgagctcttatctgcagataagatgcttgtcctgcttatttgttcaaggttgttgtgaagctgaagaatggctgagtctcagtgggttctgtaaattactgttatttgtgtataataggagttttaaaaattaatatcaacactaagaggctgatgaaccagcctcttgcaggctggtctaggcgcacacagagcacagttgatggtggtgtagacagatgtgaggcgtgggagcactgctgtctccccagctcctggcagccagggtgctggacacagggtccagaaccccttgtctggccaacagtgtttgagtctattttcctttcttgccatgctcctttcatctttcctgccttttctcttgattattactttaaactactagaggccccaacactatcctgacagagtggctgatgcttccttcatgggttgagtttactgttagccttgagatactcctagtggttttctgttacggtcccttcaagcattccctgggatcacagaggtggccagcatgttcctcctgccactcagagctgtgctgaagcctctgcagtgtaagtttccccggaatctgactgcctgctgcatgtgtggctgataaaggggagcagcttctgaaactctaggtgctgtttctatttaattgcggctgtgttgaccttttattttctattcagaattcaggcgtgctgtggaaattcccacatgtgggagggggtagtgctgtgacgtccctgagaccctcgtttacagcatgtgccggaatcacagacggcgtccaggaacagtgtggggctttctgcccaaggccactggggcccaggatgagcctcacttgggcggagcctgtctccattgctctggcagggctctcacacctggtcttgtgtttgccaggcccacccacactcatctcgcccctgtctttactgttgcctgtatgtgccagccacttgccagtcagatacccccgacagggaggagacagaccaggcctctggtgggggacacgggagtgagttgtgctaacatcctgtggacagcagaggtggccgtgtgcctggggtcgtagggagaaccctagggtggctggccgggaggggcgtggagttcaggtaggctttctggagaaggggtgtcttgtctggaaagga

SEQ ID NO: 132144 - DNA, 1037 bp, Homo sapiens
tttacttctgaattctgcctttcacatcttttcctattggagcatctgccttctgcatgatggtttataggagcttctaccacattatggacattatgcctgatggaaggttttctctagtaactcatttatatttttctttaacagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagc

SEQ ID NO: 132145 - DNA, 3321 bp, Homo sapiens
aagccgagcactcctgcaccctccttccgagcccacgcacaccaggacaccttcagccgcgtctcctggtgcgcctgcgcgggggccctggaggaggagaagtaggcggggccggcggccgctggtgactacaagccccggcgtgcaccgcgctaggctggccgtggcgcgcccggaaggtgtcgcggccctgggccccgccccggaagataaggccgctcgctgacgccgtgtttcctctttcggccgcgctggtgaacaggtaggtcatccttgcggccttgcggcatgggcagtatccgccgccatcctcttccgtgaggcgcgctgagacccggaccggccctcctgagaggatgccggtgcgggcgcccgcggagagggtagggagtggtgggcgcggcggcctcgggggcggggtcccggaaagccgggctggcgggggtacccgggccgcccggccgcgctaatcgtgagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggtgcggaacgctggccggggcgggaggggaagggacgcccggccggaacgccgcactcacgccgcctctgcccacaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaagggttagcatcgcggcggggaaggaaggtcggggtggggaggggtctgggtgttgcctgaggagttaacgtcctaagccgatatgggaacctcgcaggcagaagcttcaggtggggacatccgcgtggccagaccagtggccaccggtgggtgccgagagagttgtaccgggaggctggatgttgaatgctgtgctcgcaacttcgcgggttgcctagagcgagggggttcgcattgtttcttactgtgctgacggcctgatgctgcttccccttgcagcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgagtatcaggcagcagttgaatgctgagggctgtgggtgaacatgctgtgagtgccggtggacagccagtggctagacttggtccctggaattcgattacctgttgttctaaaacttgggttctgtaagtttgagctcatcctgtagtctcagttgtcatcactgtacaacaggcacaacagtacctgctttactgctgttgaggcgttaaatgagattgggacgaagtcaccagggtcttggattctaccgtgggcttcctgattgctgcacttgcatgcagttggttaacagcctttttagagaaggcagggagagattgtggctttctcaaagacgcctactgagtgagtgaaaaaggatttgagtctaggttaactcactgtgctgtttgggaacatcttggaatccttgtgatgaactcagcctcgcacaggggaggctctgaggttgtgttcctggaataagtaaagctgagatggggcaggctgaatcaagtgtcttacgtcaggttgagtggccggcctgacgtctcacacatggtgaggggggtgcttccctgcgcttggagctcagccagcattctaggtgatggaggtgagggccttggcttgcctgcccattgtggattgaagaaactggatgtcagctcacagggtgcaaggggctccctagggtggaggcgagtgggctttttgctgggtagttggatgcagtattgggaaggtgcatgacaggagattgaggggaggtgggggtgctctgaccgactgggggttccctgaggtatctgatcccctacaggtgtggtggctggaggtggccgaattgacaaacccatcttgaaggctggccgggcgtaccacaaatataaggcaaagaggaactgctggccacgagtacggggtgtggccatgaatgtaagtaacccagaaatgcagggttgggtattgaagttacagtggccacactgttgggtaggcaagtcccatccacaggtgtccctgcaggagggggatctacggtgggaggagcagcaggtggtggtttgtagtcacgggactgttgatcctgctccagcactcctgaaggaggtgggctcaccctccttcaccgtttctccgcaagaaacggaggctgggaggggcagtgggggcctgagctggaaagagtcagcctgactggggttgtctagcggcacatgctgtggagaggggcttcgcggaattgggcccctgacgggtgggaccccgaggccgggggcgggggtggtggggaagaggtttctaaagccatctttctctgcctgcagcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctggctgtgcccacccccatggtttcaaagggaggggtccctgctgggaggatttctgtgggatccccctggttggtactgggagggagttagactactgaagtagaccaccagtgagtggtagaagcttgaagggaaagtccacaactagaaacggggtgcaggtaccctgggcaagacccttgcttccccacagaggggaccaagaatgtggcatccaggacctgacacttatgtgggtgactcagtcccatggcctgcagtgcttggatgtgaacactcatttcacgtatcaggaaacagaataggacacaatcgttgagcctggtgttctggaccataccctcactctgtcagctccctgctaactttctcagcacctgaggcagtcctttgcccagggtcttttagcgacaccctttccctccatactggctacagccctgctgatgtcagtgtgt

SEQ ID NO: 132146 - DNA, 1084 bp, Homo sapiens
caggcaccgcccactccgggctctgggccctcctctccctcgcggctccgccccctgcccgcctctgactgtaccccgcccccaggcgccagccccgcctatctgggcttctggtcccgcccaggttcttgtccctcgggccccagcctcgcccctcctcggctctgactccaccccttctccggagcctgggaggcggggctgagaaccacagagatggccgggcctccgagcggcccagggcggccggaagtttgcggggcggggcggacgcgggtggccaaggcccgtttccggcggcgtcgcgcgtttgcgagcctcgggtggtcctcagggagggtgagtcggcgcggcgggcgcggactcgggttgccctcggtccgagtgatccctggtcgcttccttagccctcccgccttcggcattggggtccccgcgtcccccgggcctccaggcgggaaagcgcgggggctttgcggggccttgagcgcctggtgtgggaggtggtcgagcccagccaccctcccccgcggcggcgcgaggtgggcttcgtttggccgagtctcgcagctccccgcagaccccgctcgtggcggccacggtgtccggggcctgagtaaggcgagctccagctgcggccttttcttcaggcctgggtctactcccggggccctgactcctcctgcgaaatcacctccttctagagccttttctctttctatttattgccccggaaggcctaggataagtgacagtggaggaaggaacggtgccttgggtggggtaggctgtttgtcttctctaaattctggttgctattccgggcattcctactgtcaggagccaggtggggggatcagcctacctgtgccggtgacctggggcttccacccacaaaccactttctgggccagaagctgccatacgaagactctttttcccattccgacctcccgggggaatgcctgggcaggtagagggtctggggtcattggcttaattgaggtgaacgatttatatcagattacatccctgtgcctggttccatcctggcgacaggtgagctggagactggaatttatgt

SEQ ID NO: 132147 - DNA, 1011 bp, Homo sapiens
tgccttcccttgctgccgggaatttacccacactggttcatccaaccccatttcttcttgcttcaggccctttcacatgctattcctgctgcctggagtgctctctccacctccattaccttggccgaggtccctggggaagtgacccattacactgaacgttctagtctaagtggctttcatagttccctgtacttgagcgctgtcgtggttgcagtgtgcttatttgtgtggttatttaactctttcctccgccagactgcttcgtgaaggcagggtcctcgtgtccactactgtatccccattactcagtgcctggcacgtggcatccacttcttacggctttgtggagtgagtcacacatgccacacacacatacactctaaagaggaacaagagttcagtgggcctccttcactcaagtgccatggctgcttcagcccagccccatgtccctgctagagaaatctggggctggaggtaaaggagcagagagcacagtacccccttgattagcctggaagttgggcttctggcaccttgacctctaatcctttcataattgccaacaggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcctccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggagg

SEQ ID NO: 132148 - DNA, 1036 bp, Homo sapiens
agtccagaaggaacgcagatgtctggaaggcctcctgggggcctccagaaacttgcagccccagggaagaagtcagtgtggtcttagaggtggccacgcacagcccagggagaagcaggggaggtggccaggtgcaagttggcagcagcagccaggaggcagctgagggggctgggtcctgctcagagaagcccaccccagggagtagccatgaacggcctaggtgcccagtgctcttctgagctcacgtagtaagtcccttggcagctcttccagccttgtttcctcatcacaatccatgctctccattcagaactcagaccctgtactgtttcctcgccagctcggatgctggagcccctgaccccgcagcccaatccgtggtagcttcccacccttctggtcttgctttgtctcctttgcctctgcatggactgtgccccacaccagtgcctgtaggatggacctctctgctcacagaacccagccctgccccagcaatgaacattcattgctatcgaatgagtgaacaaggtaaaaagtatgaaaccacttttgagaactgtcaaaggctctgccttctcttgcacgtttccacctggggcctcacagtgctcagtgcaactatcctgggagccttgagccctggcccccgcatttgtagtcttatcatttctctgagcacagggcctaaggaacgtctttgttcctgtttatttcagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcag

SEQ ID NO: 132149 - DNA, 1267 bp, Homo sapiens
gggcagactcaccttctctcttgtgcctccagctccagctcccctgagttctcaggatgtgaggggtctatggttcgtccccccgctccagcctggagatgacatcaggtttggaagcttgaagtcctgctccagagaaaggaagcaagacctgaaaagtcatcccaggtagagggcaggatggacctgtggtctgagtctttgtgctggttgtgtccttccctgccacctggtctctaaccgtggagaaagacacaggcctctgcctaagctgaggaaaggtcaaaactagcttttcaggaggacggggagcatagataggacagtgttggggcctgaacacatcatggtagaggactcatagtagtgggtgttgatccccagcagaagggctaaagggggaatgagtctccagcaccatgtctggtttgtctggcccaccagcccggcatggcccttgtccatcggcgttgctgcttttgttcctgctgggccccagcttggtcctcgccatctccttccatctgtccattaattctcacaactgcttccatgaggagatccacaaggacctactagtgactggcacatacgagatctctgaccagtctgggggcactggtggcctgtgcagccacctcaagatcacagattctgctggccatattttctactccaaaaagaatacaaccaaggggaaatttgcctttaccactgaagattatgacatgtttgaagtgtgttttgagagcaaggaaacagggcagatacctgaccaacttgtgatcctagacatgaagcatggagtggaggtgaaaaattacagagagattgcaaaagttgagaagctcaaaccattagaggtgaagctgcgacacctagaagacctttcagaatctattgttaatgattttgcctacatgaagaagagagaagaggagatggtgataccagtgagtcaacaaacacttgggtcctacacttcagcatcttttcaatgttctgcctcactggactagccacctggcaggtcttctacctgtgatgcttcttcaaggctaagaagttgattgagtaatgaataaggcatattctcctcccaccttttaccacagccagcagaacatcgctgggatgggcctggcctaaggcatcctaccagcagcaccatcaaggcatgtaggagctttcttgccagaaatgatctcttttggtgtgcgaggacatggggtaccacctacacccaacaagtcaatgagggacttct

SEQ ID NO: 132150 - DNA, 1033 bp, Homo sapiens
atgaagcttcactcacccgatgctcacctcctgccatgcagcctggttcctaacaggccaaggaccagtaatggtctatggcccgggggttggggacccctgacctagagtgtgaagtcatttgcgtacattttaaatgaatatgaagataatgccattgagcgttcacagatgtgtgtgtaagtgtgtgtaaaaggagaaaaaataggaaatacataatttcatgatgataaaagtctaggaggtgaggtaaaagtctgtgactggagactggggataaaagaagacttcaactgaatcagtaccactgtatttcttttatataaaaacacagaaaacaacaatgtcatttctggatggtggggaagagatgatttttatagaaggcatccttttctgcattaaaggaaatagtctcaaaataaagaagtgcatgagcattaatgcctttggcagatatgtgttgacaagcactccttccagaccccatggaataggtcaggtgccaccataagcgattcagaaaccaaggcagcccaacctgttaggccttcagtgtctagctccatactctccaatatagtagacacatacagttacttgactttaaattaaaattaattaaaatcaatttttcagttcctccattgcactggccacatttcaaatgctgaacagctacatgtgattagtggctattgtactgctggcacacatacagaactttctgttattgctgtaaatgctattggaatgtgtgctattattatgttattgctgtaaattctgttggaaagagctaatctttagctgaaaacctgtccttttgacaactagcacattttggtcacattgctctttttctaatatgtccctctgcacagaggagaacaaaggtaatggctagcagattttttttttaatctctggaaaacatatgtccactataatcctaaactacaattacatctgaagtaaccctttcttgttaaagagaattaggtaaactatgtttagaaagagatttggcaat

SEQ ID NO: 132151 - DNA, 1056 bp, Homo sapiens
ttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgatatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagca

SEQ ID NO: 132152 - DNA, 1052 bp, Homo sapiens
cctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgt

SEQ ID NO: 132153 - DNA, 1052 bp, Homo sapiens
tcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagccttt

SEQ ID NO: 132154 - DNA, 1050 bp, Homo sapiens
ccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataa

SEQ ID NO: 132155 - DNA, 1027 bp, Homo sapiens
gttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagc

SEQ ID NO: 132156 - DNA, 1120 bp, Homo sapiens
ctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaat

SEQ ID NO: 132157 - DNA, 1074 bp, Homo sapiens
tggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaggcacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattgga

SEQ ID NO: 132158 - DNA, 1178 bp, Homo sapiens
catttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttt

SEQ ID NO: 132159 - DNA, 1040 bp, Homo sapiens
agtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatgg

SEQ ID NO: 132160 - DNA, 1371 bp, Homo sapiens
atgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctctt

SEQ ID NO: 132161 - DNA, 1024 bp, Homo sapiens
actaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagtaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacgtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaataaagtactggtttagatacatgatttaagaaatagaatcctg

SEQ ID NO: 132162 - DNA, 1030 bp, Homo sapiens
gtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttg

SEQ ID NO: 132163 - DNA, 1050 bp, Homo sapiens
cctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtggagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagaaataaaccttattaatataggccagatatacatgagcacctactacgtgctgttttaggtactggggatacagcagtgaaccaaagaggcaaaaatttctgccctcaaggattgtacattctagggacagttaaagtctcctgtgtacacggttgccagaagaaaaaatactaagcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtactgttttcattaattcaaaacattttaggccagatggggtggcgcagacgtgt

SEQ ID NO: 132164 - DNA, 1030 bp, Homo sapiens
ttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcacaatatttggtttagttgataaatcccatccatcagctttgcaaataattttgtgaaaacattgattcagcttgtcctgcccaattttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaac

SEQ ID NO: 132165 - DNA, 1071 bp, Homo sapiens
gtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaacaacttttaaaatgagacagtggacattagagagcagcatagttggggttgcacttaggagcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttaggatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatc

SEQ ID NO: 132166 - DNA, 1034 bp, Homo sapiens
aataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttcgtcttgttaaagttgggaaataaatcagggactcataagtgcctaatttatgttgatgtatgtaaacatacactagaaaacaggatattaaaaaaataatgacaccgggtagttt

SEQ ID NO: 132167 - DNA, 1060 bp, Homo sapiens
ccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataat

SEQ ID NO: 132168 - DNA, 1035 bp, Homo sapiens
cagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagc

SEQ ID NO: 132169 - DNA, 1039 bp, Homo sapiens
acgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttag

SEQ ID NO: 132170 - DNA, 1400 bp, Homo sapiens
tgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttttccttgtccctgtttcatctctgatagctgtccgccccgagccgattgacttacggcagtggcagcacacgctgatggattgagctgagcagggagggtgagtgcgccagttggctccgacagggagacagcatcttccgagggcgcttgtccacttgcacagcttggctcctgactcagattgcaagtcgggaggctgaagtttgaggcctccttagacaaagcgctcttccgatgggtagccggagatgcttcttctcaggtgcagaagcactagtccttgactctgagtacaactgctgggtgactaggtgatacgtgtagtgacaagaaaggagagatgaagccggacactttttttttttttttttttt

SEQ ID NO: 132171 - DNA, 1017 bp, Homo sapiens
tttttttttttttttttagatggagtctcgctcggttgcccaggctgcagtgtagtggcgcgatcttggctcactgcaacctccgcttcccgggttcaagcaattctcctgcctcagcctcccaagtagctgggactacaggcgcacaccaccatgcccggctaatttttgtatttttagtagagacgggggtttcaccatattggtcaggccggtctcgagctcctgacctcaggtgatccacccgcctcggcctcccaaagtgctgggattacaggcgtgggccaccgctcccggcggggcccgagtttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaa

SEQ ID NO: 132172 - DNA, 2068 bp, Homo sapiens
cctttcttggctctcttaactcccaaatgtttcctgtattgctgacttcttcctttgttttaagtgctgctctaacctgtgcctcttgggtaataaggggctccaaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtgtaagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttcagaacttataaaaattgccgttaactacccgttaactctagtcctgaggttttaggttttatctaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacacaaaatacaaattagttcagtgaagcagattggatttatcaaatggcaataaatgtttgctgaattgaattgaattcatctctgctggagagtttgctgtctgagcaagatttcctccctcactcttcttactctgttttttcattttacttctttattcgttcaacaaatgttcattctatggctgcactgagccagatcctattctaggtgcaggatatatagcagtgcatatatctctcacatggaccttatatctcttgggggctgccagggaagacagttgataaacaagtacatcaataaataagatatttgcagtaagtggtaagtgctgtaaagaaaaacaaagtgatatgatggatgtgaccaaggggacacgggctgttttaaatagggtggtcaaagaagggaggcctctctaaggaagttaagtcagagctagtcccaaatgacagtgagccattctcatcaagatctggggaaagagcatttgaggaggaaggagcagcaaggtgagactgtgctgaggcaggcagctgtgagcctgagtgctttgagcacagggtgacaccagtggggttgtgtcatgggctcatagcagaagggcgcacagctgcctgtgtataccacggaaagggttgggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttctgcagtgtttgtgtc

SEQ ID NO: 132173 - DNA, 1083 bp, Homo sapiens
aaaaaaaaaaaaaagacagtggtgggtgttttataaccacacaaatactcaggactctgagactgggacgttacctttagcagaacaggtaaagcaccatcaatgcacatttagaaatcgtcaggacattgcatatcagatgaagaagcaggaggcatcagcactggcctgcgggtgggacaagggaatgtcataatatttcagaccccttgacgtcaccacctttaagaagcaatatggggaagctgaactaggtgtgtcacactgtgatccattgcaaaagggactcatttaccccgttgtggggatagtattttaaagtgtttagtttcagaagttttccttcttgaaaacactctcaaaacttgtgtttacttgaaaataaacagtgtcagatttttcattaggggcaaaccagaaagcaacgagagagtctcaaggacgttattgggctgatacactgataccaaatgcagtggatgggcaaggaagtaacaagcggaagcaatgtatgtacacggtgcataattcctctttagtgagtttgagatgtgtgtgagactgtcccatggcttcccaccccaggagctgctaccttgtagagtccagtcatccacttgatgagggtggtgttcattttccttatcaccctctccctcaatttttatctgagagatggaattatgagttacaggaggaaggagtaagaggcacatcaaagcctttttgtgtggctttgaataagcggccttattggtttggggttgttagctttgggtgtgctattttcatcatgaagcacctggggtttgtttttttctaaaagatgtagataaactagagagaatccaggggaagggcaacaaaaatgatgtatgacttggagagaaggagaataacagtctataaatatttgaaaggtaatataaaagagggagagagattatttacagcagtggagaggagtttgacagggaacaaaagcatgcatctaggagcagggggaaattgggtaggactgaaaaaaaacaaagcataataagggtgattaagcaaagaaatgtaattctcacattagtttgt

SEQ ID NO: 132174 - DNA, 1035 bp, Homo sapiens
ggggcggaacagaaagtactaagtgaatttcaaggatattctactaaggccacagcttttgcctcttcctcccctttccctatggtgacatgcaatggagaccatgccagatcttaaaggtggatggcatagaaataaaaatgtggctcaaggcattggcatgttcatctacacttgcattgtgaatacaaaggtgtactcatctgcacctttccatttgccagttctcctagctgttctccgtaggaattaccttccctttggaattgtgtaccttttaaaattcagaactttttgaatttccgtctccgggtcattgctcctagttgttgtctctagtgaattcttctctaaagtatccctagattacttttactgtaaactgtaatgatttgactctggccatatttctcccaaggtctcctatctcggttacttgtaaggctactcctcccctctcttgttctctttgatcttttataattggcttaaagctctctatatttaatctgcagtgactttgtttctcctccctattttggctttttcaatccccgagaatttaataatctgtttctcattattttctattttttcttaaggtgtcgcattctctgtcgcacagttaatagtcttttctcctcttctccccatttggtttatattagctattaatgcaagtctgcattgtgtctctattttggcttgtaataaagtcctgtgtattctgtggagttggtgggcgtcctagttacagacttggctgaacctgaagacccctgcgcgtgtatatggtaatgttgtaaaaatacggccctggagataaacagttgagcacccagtttgtattgaacgaataagtttcttaagtttttgagagctttctcttagaagttgaccttttgggggcaaattactgtgactattcaacatgtaagaaagaatagcttgccgggcgcggtggctcacgcctgtaatcgcaatactttgggaggctgaggcaggtggatcacctgaggtcaggagtttgggacc

SEQ ID NO: 132175 - DNA, 1076 bp, Homo sapiens
agctaatccaagtggcttattttcctatactgctgatagggctatatctcttgatgtcgcagccctggagattgtgatggtgacatattgtttctgggtcactagttttgtctaaaacagtaggttggaacagagtagcaaaggttaattaagtttgtccatcaaggtgggaacagatatggatgcctctgatgtttctggttctgaaatcaaagttcctaaatgtgcggttgtgggcatcatttctcattttcagacaatcaaaaaaaaagtttatttgctccagaagtagagacaatgcgaagagttgttaaaagctaaaggcagcaaagtaggtctttatactaagcagataccttcatttaaaattagaaagtttccttggtttagtagagagaaatctcagaagcgtctgaggtgatttactttgaatcttgctgtctgtacttaattccttgggaccagaaccaagttatttgatctctctgagcagtttcttcctatatcaatgattattaaattatgaagactcatgagataacaagtctctatattatttctcaatagatgctcattttcttcctctgaaatttggttaatcttatcgtcagtaaccagtattttctcaggaaaattaacattaagaatatcatcagtacaacccccatccgtacaaacacacaccccagtcttaagaagcattgtagatgccttcagagactggacatgtgagagagtggagcgtgctgatcattattaaccaaatttaaaaaatacaacctttttaatttcctttctctccagccattttactgaaactctgtttcttagttgcttttatgtaaatggtacttgcatttatgcctggtatacatgggttcagttgggaagtccgggtctgtattttagatttgtgaactagacaaatgtaggtttccaacccaggaactggaaaatcctgcatagatttctcaagatgaagaaggcgctgagctagtcccagccagacactggtccaaaccaaccaccccactctcttttgtgaaccccctgatatgcaccaagaccctttcagg

SEQ ID NO: 132176 - DNA, 1059 bp, Homo sapiens
ttaatttcccattttgtttaagccaaaagtagcagggttgtgattttctttttaaagttagaagagagcaggaagtaatttagtttgaaattgcattctgccatgcctttttctgggttaattgcatttttttttttttttttttttttttttttttttttttttttagatggagtcgcactctgtcgcccaggctggagtgcagtggtgcaatttcagctcactgcaacctctgcctcctgggttcaagcgattctcctgcctcagcctcccaagtagctgggattataggcgcctgccaccacacccagctaattgtttgtatttagtagagacggagattcaccatgttggtcaggctggtcttgaactcctgacctcaggtgatccactcaccacagccttccaaaatgttgggactgcaggcgtgagccaccgcgcccatccatgaattgcagttttaacatcctgtttatattgctacacatgcacttagaaacacatagaactgtccttttcttcttatgagcaagttgtcacgtggatgggttgtttgtggattctttgaggtggatgtagctgaagtgactgatgacctcagtaagttcatgtactagtctgttctcacactgctgtaaagatactacccaagactgggtaatttataaataaaaaaagaggtctaattaactcacaggtccgcatggctggggaggcgtcaggaaacttgcagtcatgtcagaaggcgaagaagaagcaggcaccttctcttcttcacaaggcagcaggagagaggagaaagagaacaggggaaactgccaaacacttttaaagcatcagatctcaagagaactccctccatatcatgagaacagattggggcaaccgcccccatgatccaatcaccaccgcctaccacgttccttctttgacacgtggagattacggtgtgagatgagatttgagtgaggacacagagccaaaccatatcagttcacattctagtaacctcaaatggagtctgaccctttgtatctttttcttcttttactggaattc

SEQ ID NO: 132177 - DNA, 1115 bp, Homo sapiens
aactacacagaggttttcattttggctaaagattgcagcctagagaagacacaggtagagagagagagagagagagagagagagagaagctctggaaaccacagtttaggaatgcctaaatgctctgacatagccaggttgaacatacttactagaaaacattgcctgtctgttttcaatgctgatgttatcttcatgggattcaggtgtggcagtgagttccatccctgcctgctcagtagagggacccagctctcttgtgggtacatcacaaatcatcaagttggccagtttctgttactcatttagagaccatttgtatttgaacatcccagagaactgacgtctgtctgttgggccctccttggatgtgacactagccagttgggttagagcttccagcatcctcactcatgagatttcctcatttgaatctgacctgaatccacagggccctagcgatttttttcagggatggcgtggagtacttctggagtttattttccctgcttgcctcttcagaggcacggcccaggccaagtacaacttgaataaccttcaggaaaggtgtgctgtccttctttcggccggccgctgtctttgaaaattgcctccagagttagtgagcaggaacagttaagatttacaaacaatgatgaagcttgtcatgcatctttcaccattcatcatccaggtgccgtgcctgggcggtgaagtgttcttcataaaaaccagctcagtgtgaaatacacctcgctgcaatgtttactgctttgaagctcgtcagcggccctttatagtaaatccagattgcgatgtgacattacagtatatcattgcccggcgcggtggcgtttacactaggaatgagtgcagtgcacaccagatgaggtgtccaaattgagttatgtcagaatttggctgttatatggggatagcttttgttttctgaacactgaaagttagctttatatgtatttatatttatatataggcatatacttcccatcttgcccgtatacacggggtatacaatagatgctgaggtcaggttccaaatgcgcttcctggtgtaaagaatggtgaccagattttatgtgccttccaaattgttg

SEQ ID NO: 132178 - DNA, 1024 bp, Homo sapiens
cattcagtcactaacactactgaagggttttatgtctctaaatgtctcttcttgatgagatttggtgggtcggtgtgtgtaaaatgaacggagtatgttgtgtgttttcaggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacgggaacacttttccagattgttgctcttcttttcctcatttaactccctagaatttcatttcatttcatttctacctctgaatttcagaaaatttctaatccatgccatctttgccttttaacaaatgctctgcataaccttaaacagtttaactctgatgtactgctaaagtgagagactttgccagttttcctggcagatacagcagaatttgggcctccacacgcagggacatgaatgagagagcagtgcgttatttcttgatgttataatgagccaatgcaatggtaacttcagagtgaactggctaacattcatgaactatctaatgtctatatagaccatccatatatgaaaaataaacttttacttttggaagcactttgacatagatcattttgttcagtcctaacaacaatcttactaagtaatgagaggtttttttccttctgacacaaactgggtgtcctacaattcaattcaattctgacactaactttctgaagttggcccagatgccacaggttaagggctcagtcccacaaaactgcccccattttaggctccagctgaaaatggggtgcccaggttatccacatttctacccagctggctacaaattaggggttcctacaatcccccttttggtccagtaaatctctataatgactcacagaactcagaaagtgctttacttactctaagcagttttttttaaataaaggatacaactcaggagcagccaaatgg

SEQ ID NO: 132179 - DNA, 1067 bp, Homo sapiens
ttgatataaaattgcaatgatgatctctcaaatttttaaaaacactatacctgtggttctggaggtacatctcaagtttattgcttttctttttgtttattttcttgtgttcatagtcagattttccagaggttcgttggttttattggtgatttcgtagcaacatcatgagtttatttgtgcatgtgtaaattttggttgatataatttatagttgtttctaaagagacttttgaacttctttatttatttctatttttttttcaatcctcacaaaaaacactggggtgttatttaagccatctgtcgcaaagaattactcccttaaggaatgtggcaaataaatcgcagagcaggaattcaaaaccagatctgactttaaacctctgcacacccctccccccaaccctatatgatgctgcttagtgaagtatacaggatatctgtgtcttagtttgggtttcacataaaagcagaaccgaagacaataaggatttgcgttttgatagcatatcaggttgttattccaaggagtaagagtgaaggatcaggaggaggaagaaaagccaacataaaattgtgaaggcaacaggtgttagattcagggctttctgcagagttcctagagagccttccagaatcattcatctgaggataaaacagagtatttaccttcccatcggcccttatctctcaatgaggtgttgaaccccctcacttctgagttgcacctgtgtacttgaaaaacagtaacaggagccctggggcaggaagtgactcatagtctcatctccatgcaggttgctgtcacagggaggtgaggtgatgctttcacagaggcattggctggagaatgagagttggcaccaggggcaacgaggacactctctcaacaggcatgtcactggaactcacacttgacagtacatttacccaaatattttctgtgcaagtaatacacagttgtctaacacttacatcctgaatttggggtgctgataattatttttatttccttaaattctgaaggtcatggggatggtggggatatgtatgtggtccatagc

SEQ ID NO: 132180 - DNA, 1002 bp, Homo sapiens
acacaataagcacattcaataaacacatatacaattttcagcagctcactcccctcttgctcctccctcctttgagagaaaatgatttgataaataacatggtaaaataaaactgattttgtgtcttagtcctcctgattgtttgcattttaaaaggagatggatatttaattctgaagaaacggatctttaatggtggaatttcagatattttggtccttgcttggcaggcacattttgagaacagaatccgttgccctcatttataagtagcaacctcttttgggtaaatggtaccaagcctgattcttgctttttgaagtgctttaagttgtgtttgattccaaatactatatttgtgcacccattatgatatcaaatgcttataataaaaggttatgttgtcataaaatattactattctatggtgtttcaaacataggcactatcgtgtattttagttctgttagttacttgctttggaaagcacatgaccacctacaaagttaacaagataatttggtaaatctagttgcctaaaattaatgtcccccaaacaaccgacttaatctggggaattgtccagacctctgtcagataaagcagctgtataaaaacacattgacaataattatgaaatctactacaagttttatccacaaattagatcctttgcaaaatagcattttcaaaaagtgaaaataaagtgcttcatcttaacagtatagctagctagactctaatgtttttgtctttctttctttctttcttttttttgacatggagtcttgctctgttgcccaggctggagtccaatggctcaatctcagctcactgcaacctctgcctcccaggttcaaacgattctcctgcttcagccttttgagtagctgggattacaggtgcctgccatcacgcctggctaatttttttgtatttttagtagagacagggtttcaccatggtggccaggccggtcttgaactcgtgacctcaggtgat

SEQ ID NO: 132181 - DNA, 1040 bp, Homo sapiens
cacttaaaagaaatggagattggcgaaatcataacaaaatgatagaatttaaattctggaagttggaggtcacggagctcaaccccttcactttatttttattttatttttttgagacagagtctgactctgttgctcaggctggaatgcagtggcgcgatctcggctcactgcagcctccgcctcccgaccaaccccttcactttagatgtggaaactgaggccccagagatgacttgcccaaggggacggtatagcccttcaagacaaatactgtctgaagtcaagttttattattgtactactaaccatttcctgtcgctggagtcatagatctcagccggagctggattctatgttagcttctttgatgaatggatttctcccaacagtgggcctggggtcagccatgctgtgtttctgttagatgttccaggagcccttgctgctgctgactgggaggtgctggagctcactggggtgaatcagttcatttttcattttctccaccttgacttcatggaaggtcacatgaggtggaattgggtaattacttatctactctgaaaacacacctgtatggatttgcacagaatgtgggcctcctgtgctgctgctttgtgctttgggaacacagtggggagcttgaggcctgtggggtggagcctgccttggttgcaacccagccccggcctgctcaggcccgcccctcctcccctctgttgaaagtgtgctttaatgaacagtttttctcatcgttatcttaaatgagatgaagggaaaagcaaagtttttatattaggaagattatttggcccattttttctcctctcctctccacagggacatgaactactgggaaaaacgagatttcttgaaaactctttgacatctgggtgtctggtagctttcaaattcccagaccctatgattccatttcagactctaccattagatgccctagagtctgtggaagtcagtatcctctccacagcctgttggaagcctctctgctggcccgggacagaccatccttcccc

SEQ ID NO: 132182 - DNA, 1013 bp, Homo sapiens
tgagttttagttagttgtggaggtagattaagaaataaaaaggactaacagtagtcattgttttccttagagtactcggctcccaaagaggctcttccaacaccttggacgtgagataaaacatgttctaaaatttatacttttaaaattacggtgtaatcaaaaggccaggcagcccgtaaacctgagaatttgtgcaattggactaacatttctgattcccaggaagcttgcgcctaacagtggaaagcatttttacatgtaaattggtcagttttgagatgagctgataatttctgaaattagcagattacttatgcttgaaggagctgaggtcgccatttgttatctgactgctctttgccctgagcttcgaagccagccaataatgcagtgagtgctggacttccactctttttttcaaattaaagatttaattacagtcttcactgaagatgaaccaagtgtgaaaatacctgatctacttggaatgtgggatcagggaggagtgtgtgggttggagtcagtgcctgggcatttaaatactttcaacagtaacattaagggtgaaattaattatattgtgaccaaatgttggcgtgttggttaggcagagtcagtgaaatttatattctttttttgttgatcattttttaaagccgaaagggtttttttccttaggagatattctcatagcctatagacttaaatctttaagacttcaaaggttttgaaagatacacatctttgaaatgtgtagagactttctttgtggactgctacatggttattttgcatacatgctttgtgtgtccctgtgaagaatgcggatttgttcattgttggatgcagaattttatatacgtggagtcaagcttacttatcttgtttacattttcagtcaattaataatgaaagtgatctatctaaaacgtatctgacggccaccccttatctatttttctaaggtagtagctttaataagcctcctttattatggagaaaaaaaaaag

SEQ ID NO: 132183 - DNA, 1049 bp, Homo sapiens
acttgagaaatggcttgggaactttctctcatatccacttaattgcaaagtgtcagaatatttttatttttggagatggagtcttgctctgtcactgaggctggagtgcaatggcgtgatctcagcttactgcaacctccacctcctggcttcaagtgattctcctgcctcagcctcccaagtagctgggattacaggcgcacaccaccacacccagctgatttttgtatttttagtagagacagggtttcaccatgttggacaggctggtctcaaactcctgacctcaggtgatccacccgcctggacctcctaactctccgggggttacaggcgtgagccaccacgcctggtccagaatatttttaaatgaaaaactttctaaaaaccatatagctaaagatgcacatcctaagtgtaaatattttgttaaacattgtgttttattagagattatataaatctaaagtgaaaggctaactgcagtttgtggattagataggaaaccaagctcattggcgctctggatgagaaggcagtgttgacattattgtgaccagctcctctggcagtggtgttgactccaaaactgtaatcctttttcttagccttaacgagatgcccatcaaggttgggatttccatcacaccttaccctttcagactggagcatctgtgattcttctgcaaggctgctttaaaattttctcatactgcaaaatatctggacagccaacctagtttgtagagtggcaaatgtcacagcctactttatgggtttgattacttttgtatctgagaaaacagctttcccagaatcaaatgataagtctatttcagagacgactcgtagagcatcttctttgcccagcctgccttcgttactgagatgatcacgtatatatttaagtctgttttcaaatgcacttgtggtgtgtgtggccaacccagtcatggcacctatatgtggatctgagcactcatttgcattgcacagagtccctgaggaactcattaaaagctgggggcctttggcctgggctgacaggg

SEQ ID NO: 132184 - DNA, 1077 bp, Homo sapiens
cttttcagtcccaagttggctaaatgaggagagggcatctcccggggcatctcccagtcagctgctaactggaaacaggcccagggctctgaacatgttgggagaacacatacctattcctttacaagcctctgcatcagcttggcaaaggtccgttgctttgcctccttaaactcacacagggattgggaaggttcagctgccagttctgaaatgtggggcccaggagaaggttggtgcaggggccagagcacgccagagtcagcctaatcagtacagtgctgcccttgacagcttgcacaggatccctgtgttaaacggggagagtaattctctcagtgaatggtttgagggtgaaatacctcactaaagtatgtgtgtggcatacaggtagtagtcagtaatgtttactgttcttctccatagcttctatacagagaaacttctgtcactggttgggggtggggacattaacgcacggactccaggaagctcttagtcggctctccagatctgtatagtaacaagatctcaaagcagtctgctgcctttggaaaacatttctctgtacatatatatgacaaccaggtgcatgtatacaattaataaatcaccttggatttgcatggaatttaaatgcatataacaatacaaatttagtaagatacttttatgaactgtaataagatgaaggcttcatatttcctagattcctagttttggttgctatatttatatatgcatatgcgtgcttttttgttatgaaatactacttaatgactccctttaaattaaaaaaaaatattttcctatattttaaagcttacaaacttatcctttgctttttatttaccttattaaagactaaacaaatctatcaatataaaaagtaaccacttgtcaggaaattgcctaaattgtttttcaaatttattcacttactgaattttcagatcatctctttccttcttggatattgaggtagctgtacaaaactatccatttgtctatctgtctacccatatgtcacactggaagaagggggccttctgaaagaatgtggtccagtggagtggt

SEQ ID NO: 132185 - DNA, 1066 bp, Homo sapiens
ccttgcccagctcttgggccaccactccctctctgctcttcctgagcttcactaccctctccttcccaaggcaggagtcccgaggtgagttgacaccttctgcaaaaatcatgcaaacaaaaaataggatgccaatattgcatgggacatactttctctagaaagccttctttgtttatttgatggtcccacttaactggacatcctgttattttatctggcaaccataggcctaggccttcctcacccagccccagtacccacgcagggcaccccttggcggtggggtcgcctgtgctcatctcctagttctttctctgcagagcccgagctgcctgggactggcgtcagggaggtgctggggtccatcctgtggatctgggacggtttggcaggaaaaacgagagtgtgttccacgtctaggaaccagagttctactgccatctgggaaagaacctctctccacctccaaatcactccttggtgttataaatctggaggatagccgtgctctcgacttacacaaccaacttttctttttccctgatggatgaactcccgggtttaaaagattacagtaatcacaggaggacagtgtgaatcgaatctgatagcaataactttcggagaaggtcaggctcaagtgaaatgttaccaagcaacaggcattttgtttgcaaaatacaatcaaagagcattgatgagaaattctttgctgcagccagtcagcactttctgctaacagctttacagagagaaaaggaataaatcttcataaatcaaagtccctggaggactcggagcccttttctggaaatgttgcacttcttcctgacgggaaggaggactaagcccagcaaaaaaccatgggcctgcctgccctgcctgcccgcctcctctttctttctcttcctttcttcctcgcctcttgcttttttcctttcttcccgcctttaaacctgttgcagccccttagccattagctgctcaggtccttggacctccttgtctagtcctgtgtggctctgatggcttgtgcacgggtgctcatggcagaggtggagga

SEQ ID NO: 132186 - DNA, 1033 bp, Homo sapiens
ctatacattagcaataaaaacataacttatttaacttcttgcacttcactggaaaatgccaaatagctctgttctgtggctttagtgctgaatgtttattgtaaaagagagtctaatgttaagaatagtcttgggaaggctgggtccgtggaagatttatttggggatgtaaagctgaaggtcagccttgcacctaaacccaacctggaatgttaaatgaaataatatacttgaatgcaattttgtaaaagtggattcctcaggatatgtgaaacctaaaggaagtggttctgttgcaaatggactataaacagggacattatattcttacactaaaaatccttgcattttaaagagagatgcacttaagaatagagtgaactgctcatatgcttatttaagcttggacagttttcagagacaaaccccattaagaattactcttttcacatggctgaatcgaaacatgtgtaatgtcaatgtaaaaccaatcacagctgtgaactgcatgaaatgtattgtgaaacgaacacaagattaagctttgtcaggttaatgtagcatgttaaggactctagaaaaaaataaactaaggagacgagcgtggtttatgtcatttctacttgtggaaagaggatctctaaaaatagaaacttgatgtaaaaatgacttttactaacgcatgggccaggaatcaaattatcagttaaatgagacattcctgagaaatatgaatggcaaagttttagggttgcattcagaaagataatttgttcaaaatggagttaattctctccatccattcacttattcaacagatacttactgagtgcctactatgtgtaagagaatgtgctttccatgtattgtccaagttacctacccgtgagtcctagataagcagatattttagtggagaatcccattgaaaacaaagtaaaaatggaaaactcccaacaatgtatagttgagtgtgggaagcaaggaaagtgcttagcccagtacctgacataggaagtatgcagtccatgaa

SEQ ID NO: 132187 - DNA, 1070 bp, Homo sapiens
gatggcctgcaggaatgccctccgctcgtggcttgaagacttttggtcaaacatgcccgcctggatcactttctgatccacgttcagcttgtattttgcggccgcgaggatcttttcctccacgctgttcacggtacagagcctcagtacccggacctcgttctgctgcccgatgcggtgagctcggtcttgggcctgcagatcctgtttggggggtcaatatgctatgaggactgagatgcctggcataggcatccaaaaccggaccccaccccagagggaaatatggaagggttctgtatttcaccttcactaaggtaagattttgcctacattttaaaaacacacaagctacgtttggaaaaattcagtgtcattcctagttgaagaaacctgggttgaaattaaccaagccaactgaaatacatctcaggttttgaaatccaggtatcatattgtttttatctgtctctaggttccccatcagatttagtccatatctaaaacattaaacaagacaccaatgtccaatgtcagaattatgacttacataacacctacaactaaccttaagttgcaagaaacgccttttctttggcgtgatgtgttgaagattattttaaaaatatcactgagttgtacattcaggtattatacatacatacatcttaccacacacacacatacacacacactgactgctcaggtagtcaatttcctcgaacctaaccttatcaaagactcggtcttcaatctgggaaatcaaaaggattgctagttgggtagtcaactggtaaacttttggggacagaaatttgtcactacctattagaagtgttaaaactgtctatgtctccgacttagaaatattacttcggaaatgtatcctaaacaaataatcatagatatgcacaaagatttagaaataaggatgtaccttctcagaataatttactctctctaatggctttttttttaaaaaaagaaacattcaacaatactgaattagttaaatgaattatagtatcctactatatgtatgtatcaacaaagtatcataaaaattatat

SEQ ID NO: 132188 - DNA, 1072 bp, Homo sapiens
atgtttagctctgcctggcccaacttcccacaatacaagtaagtcccctgtaccacctctggcatgtggtcatccacctccatgtggacactgcagtgtgagctccctgcttcagagcagttcttgacaccaaaggacagttctaaacacatcaccgtttcctacattaaaagggatgcagccatctgacccctagctatttgttctacttggaacctcagagaataaatctgctctcattctgagaaatatcctttaaaatgtatcaacaagcatatctacctcaggacattgtccttcaggtaggaacacttcactttgctctctgagtgatgcctagacattggccacattccagtctcctagtgtcccatttaaaacatggcgcccagaactccaatggggtattctgatcattaattacagggtggttagcttccttattctggacaccagaattctgttagcataactcaagggtgtgtttactttttccagcaaccttgacacagagttaactcattgaatatgtgacttcttgaaataacccccactccccaccccagaacacacatacactgctctgatttcacatgaatactgccaaggttagctttcagataagcataatttttttgaacctatgcctactgattgtattcttatccctgtgtagttccagccttactacttttcatcccatcatccttgcatgatgctgtacctctaaatttttatctatgcaaaaattatgtttactatgtttatgtatctaagttttttcatccaaagatttgatataagctattgcttagaaacttagacaaaggacaggtctctgtgacatacccctgaaaatcacttcaggttgacatgaatatattaaccagtaatccttaaggttggctacccatcagtgaactcatatagccatgctctcatgtcacccacatttatcctttctcagcattttcaagaaaggctaaaaccatgatacaccatggctagcctttccaatctatcaccctagaaaccctgccgaaaaagtgaaatgaggttagcttgccatggc

SEQ ID NO: 132189 - DNA, 1028 bp, Homo sapiens
agactacacagggagggaaggatggattttagaagaacctctgcctagtaagacacccaaataaattttttctgcaaaatagttttgagggctttactcacatgttactatcatgtgtattgtaaaagaggcatttatctcctgtgtccctcctgtgatgaacattaggccttatgagggtgttattggtatatgctacaaccctgaaaatgaaagagccacttacattatgggtagaagctgtagcttcttaaccttagtgcagtggttctcaaagtgtggaccgaaattggcaacattaattcaatgttaattgagttcatgtgtcaacattgactcattagaaatgcaaacttaggccctgttctagacctgctgaatcagaatccaggctggggcccagcattctgtgttttaacaagccttcctggggattctgatgcacacgggagcttgagaacgactgacttagtttaccactcacagaagctaacgattttcaaggtatatccgatggagggcctttcctctgacttgaaccctagacaagaaaaccaagagctataatccttttagaagacttgctgaggaattctagaaacatttttaaaaacttagaatgaggaaggaaagcaggcctccatctcaacaacaaggctaaatctaagttgatgcttagtaacacagtatctagagccagtgcctgggttcaactcctagctctgcccagggcaatctgggacaagtgactgtactttccttctctaccaggtttcctgatctgtaaaagaggaataatagggccaactgtgcaggattaagaattttaaaagctaagagatgtgaagtcttagagcagtgtttgaccaacaacaaaaacgatttgattatgtccatgattcttaagatcaatttgatgtaaatggaaattgaatgtaactgacaattgaactgtaaaattcacttatttccatgactcagaagaattagcctacatattcaccactttttagtggcccccgaactag

SEQ ID NO: 132190 - DNA, 1049 bp, Homo sapiens
ttgttgtgagtattacgttgcatgatattctcaactagtgataagatctgacaagcagtatgttgattcaaggacaactcaatctctgccttccaaattgaaatcccttgttacagtttgttatttatgatggccacttttagaatcaattgtggttctcatctcaaattaatttccagtcttcaactattttcttggttctttatttctgttcttcttatttattgtgtgccttcattttttgtacaatgagactgtacaaaagttcttgatttaactccattgtagcctttaagttgggctagtaagttaggattaatgaataaagatcaatgtattagattttgggacaagaatcttgaacggaccaatcttgatgcattttcagtggggcatcctctctcttaataggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtcgtaagtagctttctagcatggcatgttcagttctcttccctgtatcaactgggacaatttgctggcttcattccatggtgtttcctccctttgtagcctctcgaacttgccgacctgaccaatttgaatgtgaggatggcagctgcatccatggcagcaggcagtgtaatggtatccgagactgtgtcgatggttccgatgaagtcaactgcaaaaatggtaagggtttcttcttgttggttaagcaatggattgctctgaccaga

SEQ ID NO: 132191 - DNA, 1029 bp, Homo sapiens
aataactactttaagggaagcagcatgacacagaacctgctggatgtcagtagctcttggcaactcagttttctttaaaagggaacttttgccctcctgtaccctaccttaaacatttcacatgttatttttttatttctgctgcctcagagaaatggcttctcaacttcagctcctggctttcctcccaagcctcagtgtcagagcttttatttctgtttcattcatgtccccttggccttcagcccctcttgccaagactattgcagtagcctccaaagtagcttttgtgctacaagctttctctactgttagtttgctaggatttttgcaatgaagtaccacagactatcttaaacaacagaaatttattgtctcaaaactctggaggccagaagtttgaaatcaaggtgccaggagggttggtgcctcttgagggctgtgagggaagggtctgttccaggcctcttcttggtctgttgatggtgctcttccccctttgtctcttcacatcatcgtccctctgtatatgctcgtgtccagctttcttgctttctttctttttctgttttttggagactgactcttgctctgtcacccaggctggagtgcagtggcacaatctcggctcactgcaacctccgcctcctgtgttcaagcaattctcctgcctcagcctcccgagtagctgggactacaggagtgagccaccacgtccagctaaactttgtatctttagtagagatggggtttcaccatgttggccagactggtctcgaactcctgacccaaagtaatctgcctgcctcggcctcctaaagtgccggaattacaggcgtgagctgtaataacagtcatattggattagagcccaccttaatgacctcattttaacttgattacctctgtaaatatcctatcctcaatatctccaaataagatcacattctgaggtactaggacttcattatatgaattttagggaggaacaccattcaactcataacacctactttccccctgtgacac

SEQ ID NO: 132192 - DNA, 1044 bp, Homo sapiens
gtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatggtttgtgcctgttcctctaggatgaactcctatcctgagtagtaccaagtgttctaactaaatgtgtgagctgtagttcttgatgttgtataactaagcctgtaattgggctggtttctcttacaccctagcacagttaaaaaatgaagtactgtttaacatttgctcccgaaatatttcttactgtgtaaaagaagctagcttagtctgtacctagaattcctcttggttagaggagtgagtttcttttttttccattaacttgtttcctgatcgagaaacacgtgctaagatttctatgaattctgcttctttatagttaagtctctgttttccatgttctgtcatttatataggtcaaggacaagtgccttctaaggcatggataagggctttcttcttatgaaagtctagactgtcttactgtgaaga

SEQ ID NO: 132193 - DNA, 1010 bp, Homo sapiens
gttattactcatttttcatctccaccaaaactttttatcagagtagcatatcttagaggctaagaatgcatgctttgcagataaaccacttgggttgaaattctgctttatcacttcctggttagtgacatcaagcacattaaccagtctctaaaaacccgtttttgtttgtttgttttctgtttgtttttttagtctacaagatgagaaaaacaattccccatagagttatgaaggttatataagatactatcataaggaatgtaacacaatacctggacatattagcactaagttttagttttctttattaccactgttgagtaataatttaaggcagaaacaactagattactgtcttagcacctcatgaatagaaccttaatttttaggggtgtggtcatgtgcccagctaaaagataacattttctggtgttcttcacagagaagtttttgtgccaatgagatctaagaggacaagaagtcctttcaggaagtcatgtgaaagaagagtgagtgctcttctctaggtttttctccatccttctcctttgagcttgaatgtgatggctgaaactccagcagccatatcatatcatgtggacaaggtttgtgccttaggggtgaaggaatggtgagcagagagtccaggtcccaacttcatggaattgctatactaatcttgcactacctccctctcaaattcttctatggcagtggttcttaaatcacctggagggcttattaaacagatttctgtgccacaccccacagtttctattttagtaggtctggtttggagcccaagagtttacatttctaacaatttcccaggtgatatggatcatcctggttcaaggaccatattttgaaagccagcattttatgtgttagagaaataaacttctcttttgtttaagctactgctattttgtgctattctgttattaaagatgaatttaatacattatttaaaatttgtaactcatatgttactcattttgccaccc

SEQ ID NO: 132194 - DNA, 1065 bp, Homo sapiens
ctgacctcgtgatccccccgcctcagcctcccaaagtgctgggattacagccgtgagccaccgcgcctggccgcattagtaaattttttaatgaatggccttaactaggagatacagtatgccctttggattgtgtgtcttttatgaatagtaactaaatggctgctctgccttccacagtgtgcagacagacactgattgctatgtatgtttgtaccgatgatgatgccctggatgataccacagataacagcctatgaaagaacagtgtttggaatatttttcatcagaatgttttatccagtttttaaacatgggctcatgcccgtggctgaatgtaagtggacagacagagctgcaaaaatgtgggaatgagaaattttggtctgtgctctttttcttagggagttaattgtaccttgggaggaaatgattagctcttagttgtgcttgatatgtgataactacttgagggaaaggtgagaggagtctggtaaggtcatgggaatcatctgactttgagctcttgatgactataattaaacataatgactaattcagatatcttaaaatgacttccagatgcttgacaacagactttccttttagatgaaaatcctcttgcatttaaaacttaggttcttattgatatatctaccagtaagcacatactgacttaatgttatcacattcagcagtaggcagtgatagagaaactgtgaatcttaaagatctgtaacagcagtaatatccttttgaagaaacagacaagacatgggttcatttgttcttaccagatcaactatttggccccattgtataactcgatatctaagtctagttctaaatatctgttggaatccgctcttttggtaataataccctgcccggcacctttctggaggttcccctccccctacattttagtcgcctttttgggtggagtcgaattatgatttgccttgaccagtggcatgtgactctggcctctgaaccacaacactcccttggccaccgtgattagttaatcaagtatacatgtcccgtggtaagttgaagagaatt

SEQ ID NO: 132195 - DNA, 1512 bp, Homo sapiens
gatgatctaggaatgcttatgaaatttaatttttttcctctcttcagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggtcttttttaaaaatctcagctgtctcctctgttacactgagtagtaagcatatcagtgtgaggcaattaatgtggaaggtttaccaatcatatatggtgggaccaaccagatatataaagtgtagttgaatgagttgattcaggggagaagacatcttcagtgagcatagtctgagaaggcttcctggagaaggtgggacttgagaggactttcatcctgtcaaaggaaggcaggatgtggaaaagaagagccagggggagtcgtgggcacagtaaagtggaatttaatgagtaccggggcagtggggggttcacagctgcctacctagctgttttatggattaggttccatgctagattttgtttgaaagccactcaggtaagttaagctcataggaggaaatgtgctaaatgaattaggggatcactgtggattgcggtgttaaagtcagggtcactgggaagttctccttgtctctgattttgggccttccaagtaaatagctccttgtgattagactttctcccttgagactgtccctaaaatgtcaaagcctatggagtttgaataagaaggaagaaggtggaaatttgttacgtgcagaagtttaactacagctaggatgtttgaattttaaaactgcagttgtttgagcaaacaaagcttagaaggattggtagctcagtcaggctcatgtagtcatgcctatgagtatctggctgctttctcaaagtagtctaacggggtactcactcaggtctgtcactgcagttacacctgctgaggaattggctgtgcctttcctttccagaccatggggtcccaggactactccagcctaccgactaccaggacccctcctgccacggtgtattgaatccttcccagactgcaaaagcgctgatggctgtaacttttgacatggattctcacatcacccaatataagggtgtgggtggagagctggaggaactgggatgggataaggaggtgaatggggaaaaggcaacagtagagcttgcatttgtttggctaatacattgtgatttgtgttctctgtataaagaagccattcagagaaagggggaaagaacccctgctctttgtttcatctttgaaactaagataatgtgtacataatttgaggagtacttttataaagctt

SEQ ID NO: 132196 - DNA, 1117 bp, Homo sapiens
caggctggagtgcagtggtgcgatctcagctcactgcaagctctgcctcctgggttcatgccattctcctgcctcagcctcctgagtagctggaacggcaggtgcccgccaccacgcccagctaattttttttatttttagtagagacctggtttcaccgtgttagccaggatggtctcgatctcctgacctcgtgatctgcccacctcgggctcccaaagtgctgggattacaggcatgagccactgtgcccagcctgtattttttttaatgaataacttacatccctgtgaaaactgtgacaatgttgacttttaaatcatgcctaattctacatgtaatttccttcattgttttaaaagattgtaaaaggattggaagagcatttgctactgaagtgtgtgtgctatttgttgatatctgacttaaaatgagaaaaaaacagtgatgagctatggcctcttttgtattattctctgaacttagttgagtttataatcaatccacaaatcattgaaattttccatacattctctgtgcagatgaaaaccttctgttaagagcattcatttaaaaaaagatttgtatgttgctttgaagcaattactgttgatttttcccctgctgtgttattaaggtttgggaaaacagataccaaccctagtttgaatttctcaagatactttacttgcaacatgctatgcaacttaatctatgttgtttgtaaatgttattttaagtgtttcttcaacatatacgtgatctggtacacataatactcacacaggagcattcatagcttcaggtatgtcagtgtctccaaatatataagtgttacagatcattttgttcatttctgcttaaaattagttaattttccagttgatgttaaacagtcagaattcgttagctgatacatgaactttttcattacaaatttttttaccaggcatttggagtgttaacacctactgacacattctttcattacactcaattaactggaaatttcagcaatgccatgaaattaatttataaaggttgttcatcaatcagaactcccattaggtggatttcaaacataggaaggatactataggtttattatggagcacta

SEQ ID NO: 132197 - DNA, 1019 bp, Homo sapiens
tgtaaagagaaatgccaagtttaagctagaacagtcatttatcaaccactgttgaacacgtgaacactgtgttatgttcatggcaccttgtgagtgagcatttctccatgaggaagaacttgatttcaaccaagcatgaggtgctactgtgaaacatttatttcctgaatagctttcaggtcaaagttaaatcattaaataatacaaagaagtgcagacataaccaagtgagtgttttattagaattcatagtttatcttgagtaattactgctaaacatagcttaggttttggatcagagttaaaagaaatggctcttttagaaatgcattagataaacctgcactggaattttttgtgttaaaagggagattgggtgaaagctacttttgttagcttttttgtttaaaaatatttgcagatttaagggcagtagagaagggggtagggagtatatatcttattatgtgatgttcactaagcttcagtatattttacaggttgttttgcaaaaacacttgtagagcatgttggtatgaagaacctgaagtcctgggctagtgtaaatcgaggtgccattattctttctaggtatgtataacatgtgcccttctctgagcagggcctggtcatgcaaaagacacacttccttcacgttgatttctcagttctaatatttgttctcagtagtctaatattactcccagtcactcatggtctagacaaacataccaaatattagaaagcaaatgtaactctttcagtcagtccttaggaatcttttttttttttttttttttttttgagatggagtctcactgtcacccaggctggagtgcagtgtcacgatctcagctcactgcagcctcaacctcctgggctcaagttttcctcccatctcagcctcctgtgtagctgagactacagacgcatgccaccacacccaactaatttttatttttttattttttgtagagatgggggtctccctgtgttggccaggctgatctcagactctt

SEQ ID NO: 132198 - DNA, 3636 bp, Homo sapiens
tctgtaaacctggccagttggacagaactctttccgaggcccagccagttctgaagaatatggggtgctcaaacatgcattgaatatttataaagtttgttacaagaaataggagtgttagaggtggggaaataaattgatgactcttctgttgcatcttctctattaagaataaaggaatttttaaaaattttcaagtgacttttctatctttgaaaacagcagatttacacaggagtttagttagggtggggatgacgttgcttttgtcccttaaattcgaacaactagaaaaggaggttactgttcttgggtatgttgattggaaatgtcatatagtgtaatttgtaactgcttagtcgaggctttctggatttggtttcccctcctcttctgtttttgtttttcattgcggtagctaaacagccttcatttgccatgaataagcaacctaactttaaaagcctttatccacttgttcgatttaacagagtttctttatctcctttcacatacatctcagcagggaaattctaatagaagtgttcttcattcatgccggtgctacatttaaatgcagctgcaagttaactgcctctactcagtgacctcagcaagtgatgtccctagtaatagtggcccaagaaatactggccataatgaatgaagataacacctttaaatattttttaagtccttgggcttggtcagttaatacaaatgagttgttcagtaatgctagtcacaaaagagaattgattctgtgttctaaatgtaaatctctgtgtgctttaatgacacaatttcagaactagctccacattttccatgaagtacgctgggaaaaatagtagttaagtatgtattcttcaccattgaaattctaggcatactttattttaagaatgtagatatcaattcatttttttgttgttgtttataattttataggacattgtgctcactttggcagcacatatactataattttataggaaattatcagttccttgcttagcatagtaaatggcaaatatggaagaaaggtcctgtggtactttgttttgagaatgcagatattgattctttttttttgtttataattttataggaaattatcagttcattgcctagcatagtaaatgacaaatatggaaggaaggtcctattgtacttactaagccccagagatcctgcacatacagtacgagaaatcattgaagttctgcaaaaaggagatggaaatgcacacaggtaaaaccaagtagaatggcttgacttctttattcctctgttaatgttgagtagtgcattcttccagaagtccacttacccatccataccctctctaaaactgctgaaaaggtgaattccattttcaagcctatatttttgacagattctaaagtttttatcttgacaaggaaataaaagtgtcgtgccaaaagaacacctgagcacctggcacatagtaggcattcaagtgcgtggtttggcttttattttgctttattttcaaagctaccgataccacatatttgagtaccctagagtatggtgtccatacagcagtgtaaatgtgttgttttctgggtatgttatttggtttttggatttttttttttttttttttggtattacacaagtcagactccctttattgagcccttgttctgtgccaggcactattcagatcgtgggacacaaacatttttaaaaacagaacacatactcgtatcacttattgtctacatgcttaacagaaagatagacaataataatagagtgcgatacagtctgtgataagctcttagaggtttttgtgataatatcaccacatttcctttgcgatttatcttaccttaataccccgttcaacatactcaacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagaggtaatgtgccattaaagcacaggcaggaaagctgcaaaggccacaaaaacttcgtttttggacgatgtggggtgtcagtaagaaagctggggagggagatacctgttgaataaacaaccaagaacctctcacagcagcaattacattcatctttaattttctctaaccatctgggtcaaagcctggtacttgggaatgttttacagatgtgaatttgcttatgaatgaaatcattgccaagtattgagtgcccaaggtgcttctgacacctgcgattggggaagagaagtgggccatggatcttagagaagccctggctcctgaccatattaacaaatgggaaagatgaatgtaccttgaaagtttctctataaggagactgagccggttgcctcccatacttgctaaggagtagcccaaataactgggaacgcttggtattgctcttgaagaggagtaaggttgagctgaaaagatgctttcttgattcgctcatcagataatccccttcggtggtcatgtgtacttaaacagcatgcagcattgggttttgatgtttgtgctatagtgttctgtcctgtaggtttatttgtgtctgagaatgacatatttcaatccaagacgtgattagcattaagatgagccttgtgctgctactgttcagagcagattaaatgaagcggagactgaagcgctgtgccgtggctgtgttatctggcataactgtctttcagtctggggatcagaatagatctgtggtccccccaagtatgatggttgtcctagataaagacctcttaagcctgtggaactttaaaagtggctgagtccttatctgtatgtggtggcataaatagtatgtattcattcaaatgtatttgtatgaatgaaaacaacttttaaaattaactgttcttgacccttcatagcttcacattgcagaacatcctgcaggacatctagttctgaagtggttaatagagcaagataaaaagatgaaagaaaatgggagagaaggtaggctatgaaatttgaccttttcttgtatctcatgtggaattccagtaattcctggcatccctgaactttataccagccatttaagctcaaatgaagtttgccaagtgtctagaaatggtgtctgtgaataagaaatgattcagtggttgctggtaatgctttttcccctagaaatatttgtgcctgagaactcttttaattttcttttttccaaaccccccccgccagccccccccaccgccccctcactctctctgttttccttcctgtgctgctgcaggcttctaacctggcttggtcaatgccttaaaatgccattctaatgaggatggtgagagggggtagggggccccaattgttgagtatcattacctcagtagaaaggcatgacatttatctctatgtttgaagaaagaataagcagaagaagattatcctcgtaagagagttttggactagtgcctgtttatttggcattgaaatacatgtgaccaaagagtaag

SEQ ID NO: 132199 - DNA, 2626 bp, Homo sapiens
cttcagtttgtctttttgactttacagttagcaacttcgttattgtttctaattgaaattgtattatctgtgatatttatcagatctggctctgaatgattgtgggctattatcaaaaatcaaattcctatcagagtttgaaacaattatatcaacatccaggatactcatgccacaagctctggaaacaggtttttgttttcttttgtttttgttcttaacataaagtaggtgttctttaaatgtttggaacagtattagcatcatggaaataattttatttcaaaagatgagtgttgtgaaagccacatgtgtatttctgtgatctcatgcagctatactttttttaaagtaatgatttttatatcattctcattcagtgtataattatactcttctagtttattttttcatatttatattctaattttgtgagatcactttaaagaaattgagcaatatagaaaagaaaattaaaaatcatttgtataacccagagatgactattacaatgccttgccttccaggattttctgtgtacatgtattatgtatatcgtgtgtgtgtgtgtatgtgtgtaaaattgtatgagtttatattttctttttcatgattggagtatcatatatgtgtttatatatgtaggttttttgaagttaatcttataacttgaacttttaagtataattttcaagtagctattcattaacagtaacctatgtaaataggtattagttttagactatttggtaatgaataatgtgctttaaaaaaaaatcaaccttacctctagaatataattaatgaggtcgtgataagagaggaagttcattaaaatggcttttattcatcttgttatgttagacaagttgtcaatgtaggtaatctttttttttttttttttttgagcggagtctcgctctacctttatgaagatattccatgtgtgaaataagagggaagatctatgcacttgtttttaacctttgctggcttccaattcttgcagggccaatactcccatttggttttactggcggcatttgattgtattgatgatactaagcttgtgaagcagataatcatatcagtaagtaatcctgatggtcttgaatttaagttacatcgataaaccagttgtggatgtgtaagcttgatttcaccatgcatgtgtaaagacttgcagctgtgccttctatcagtatttttgcttacttttaagttaattatgttttattttggaggtttgttttattcctgtgtaaatcttaaccttgtaacttgatattaatactgttttaaatatttaagactggtcaaattaagatttaacacttttattttggattaggataacatggtactttagaacatacgtgattctaaactatggaaaattagcaaagtgatatttagatatgatcagaaactagcatagtaattccttagttattccagaactcaaatacaagcagagagtatctgtgacctattaaattatctctctccctgtggagaaataattacctctgcacagttacccagttaatcaatgcatctgtgctggattgagctgatggagaagagaaatgtacaaaactcactcagttgtgatgcttcttagagcttttgtagggtcagattaaaagttattactaaaattaaaactctagcttccttttgacatttcagaaattccttctagtccagtgtagtggccataaagtggtaatacttgaatgtagtgtatttatcgctaacgttgccttcagaaaaaccaattgtcctcttaggggaagtactccaaagtaaaaattgcattctaaactatgtgttttcttcattctgcatcaatagtctctttttctgattctacaattgtcttttcttttgtttttagtgtatgagtggtgttgagtatatggtagaggttgcagcagggtggggataagaaaatactagtttgatagtagtgaccaaacttggaaacgtctggaaaaccacataatctgtatagacataggttattcatctgaaaattacacaagcctttctgtttgatatacataaatgggacccttggagaaatcttagtgatgacatgtggtactttcacatctgcaagaaagaagaatatgatgattcaaaaagagaatttacctgttgtcaggtggtggtgttgtggtctctctttgtagcctcctgggatcagtagagctgagtgtagtagaaaaagtataccagctagtggaggggaagattgttttcttagatgccagccgtaggtcccagtgtgtgtgaatttctcatgcccttgctgtcattttccaactttacccttgactgttttaagattgtgatgactttctttgggataggattgtgggaagaaacaagttggcaagactttcatgttacaaactgagtattttgacatgttccttgtgactttattacccttttgactccaatcaataatgattgtttttcattcttgtgacagagatgtgaggccatagaattggctgatgaataaagttgtttcacagaaatggaaacaggctgggatattgaaagtttgcttttgtttaatattttcacgacaactaaaatgtgcatagctgtt

SEQ ID NO: 132200 - DNA, 3039 bp, Homo sapiens
actgtggcaggggaaaatgggaagagataacaaacagctggccacacacatttgctcccataggtgttatgtacttgagggaaaaggtaaagatccttattaatcacagaagtttaacagaaattatcattatttccttggtcagcataattctgcctttaaaagatagttgtactatatctactttttttaatgcaaatttaattttattcaacaaatgcagatgagtactaactgtttgctagactctgcatttgaggacagtttagaccttggaagaaggatctgtctggtctcactgtgaaaggtggcttgcaaaccctaaccctaaccctaaccctaaccctaaccctatcacatacacatctaagcttgtaatagctctaagccaacttctttggtatattacagtttttttgttctggctgtataactattatttttactaatgaaaacatatgccactcaaatgaaaacttaataaatattatattaaaatgtttaactacaaaatacccttaatacataactgaaaattcagtgagacaatctttcctttttaaggacaggaaagtgattgtgaaaacaatgaagacttatgttgaaaaggtggctaatgtaagtataataaaactacatattctaattatttttgatagtaagatgaattcatgtctattatagaaaatttggaaaaattcagaaaattaccaagcagaaaattattgttttattatatttttctttgcatctacatgtattttcatattttatctacacaaaatggaaatcatgtcacatgcattcttttctccttttttaatttaacattgtattgtgatagttctctacttttattagatattctttgaaaacctgatatttactagcttttttggtgaatttgtccagtcatgttaattaaatatgggaattactgcctggatacagtatgtacatattttagtctctgggtaaatgatgccagattgcacttcagaaacttgatagtagttttccttatgaccaaaaccataaaagaaattaaaatgtatcttttttttaagaataaatttgcagtgtggttatggaaatttttagttgttaaattttatagctctttagaaatgcagtaacaattttcctaatgaaattcataggtacaaaagttttttctgggggatttgttgcttcaaaaatagtgtttatatgtttttagttattaaataatttttcatgctgttgctatggtgtactgtaactagaatatatgtagtgaatacaattttaatttttgagttatactttatatatttgatggataacaaatttctaatttattgatgaactaaaattatgtagtaatcaactactttatcctttgaaaacatccagtgagaactactagcatctggggaatacttcaacttgtttgaaatactaaatcaaacaagttaaaattaatgctgtgtgattgtgtacttgactattgtcttctgttgggctagaaattagaagaattcagaaggcagctaacgttcctataataaagtgaaatatggaattctcatattttttataattcataattcaatattcatatatatttcataattcataattataatatgaattataatgttatatattatataacattatattattatgttataaatataaatataattcataattataattcataattcaatattaagtaaatttttttgcgtgacattctaatttgaataccttacattaaaatgagtaaaaactagaatgttaatagaaaattcacaaaggtattaagagtataacattttaaaataataaaattatattgttttagttctacagtttgtttatgtcaggtaatttaacactaagtacatatctttttaaatctcgaagagttacttctaaaggggtgataagctaacgttacccatggatttgatccatggattatttggaattattaatttccaaatattgggggtttctggatatattctatattcttttgttccttttaaatttactgagacctgttttatggcctaacatatggtctaagtattttgaaaataatatattgtagagttgtttggtggggtattctatatttgtcaattagatcaaagtagttgacagtgttcataccatcagtgtttttactgacttattattttctagttctatcagttgctgagagaaacatgttaaaatttccaactatacttgtggatttgtctgtttctcacttacattcaattctgtaccaccttctgttgtattcacctagaaatattttatgcttggttatgcttatgtgtgtccgagttaagagaactgaaaccagtgattttgtactaggcacgttgttctatattttgtctccttcacttaattcatattatgggtcattttatttcaatatacatacatctgtctacctcacttttcttagtgactgtaatatttcatcgtgtgcctataccataatttatttaaccagtccccactgttgggcattttggtagtttctagagtttttaaaattacaattagtaccccagtgaatatattcatatgtaagtctttgtacttacatggaaacacgtctgcaagataaatccctagaactagaatcactggatcagctcatacctgcattttaaatttgtataggtgttgtcaattgctcttcaaagaagttgaaccactttacattctcatcaacataaaagcgtgcctgcttttccctaaacctttgataaattagtctattgtcagaggttttcaccatcacccataggataaatggcatttcattgttttaattattgtccttaattagttcataaagcattatttcatacatttaaagacatttgtacttctgttttagtgtgatctgactcttcatgttctttttttttttttttttttgagacagagtcttgctctgtcgcccaggctggagtgccgtggcgcgatctgggctcactgcaagctccgcctcccaggttcacg

SEQ ID NO: 132201 - DNA, 1867 bp, Homo sapiens
gggtttggattaagtaggtgttgttgcaattgctgacaatgtttggttcattcaagttttaattctgctaaaattattttgtgaaacagatggattgtgaagggtgttaacagaaataaaacaactattaaaaaaatacatccacatgtggatttctaatcattatgtccagtgctgggggaaaaaatgtagatgtccttatttaatagagcagagcatatttcaaatgttgattttatgtttgccgattaaatactagaagtttatactctggtcttggttgtagatggcactaaatcaattttaccatctaaatttttgtttaagttttagtatttctgaaaaatacagtctattttatgacaaattgtattcagtaaaaccatttcacttgtttagattactttaggactttgagattacctgtctttgtatgactgtagtgccagatctgttgtgtctttttgctttttttttctgttttcagggaagctgtgattaagcactcattggtgcataaagtattcttggacttttttacctatgcaccccccaaactcagatcagtaagttcttggtttttgtttttaaactaaaacatggaggaggagcggtgtagaaatttgaaaaactgctttgatgtacgttgtcttgtggaaattttagagttgcttccttatttagggaagataatttactcaactccctttgaacacgtttgctaattccatttaggttttattccagtaaacaatagaattgaccctagttttactaatcatattaaatttttatatcttaattataatccagagagtatccgctggctaacctaatctgaaaattaactaactcgtggaggaatattcaagcattcggatagttttaaattcaactgtgctaatacaaaaaaaaaattagcttggcattaaaaggttagaggaggatatgtttgtaaaactaagtggacgatgaaaacctggactttatatcatagaagaacagagtgaaggtaaattgcactgcccttcaagtcagtcatgggaatacaaatgagaattcatcatttagttccctgaactttgcttgcctcatcatacagtgagctcattgtccatttgtcctcattttccaatcacaagggataatgaaaataatgagactgacttaacaaataacgccagactatacattcattggagttttgaccctcttaaaattggcatgcaaaataatttcctgatggtagccacccacgtaagcttatggtttgatgaccatagcagcaccttctgttttggagatttttcttacttcctgaaaaatacagtatcccacggttctgaggcaggactatatgctcagaaatgacacaatgattatttgaatatattcagtggtagaaagtatctttttagtgttgaatgtttcagtaacagcaaaaaatcatttggaacttagcatgcgtgtaaagtaatgagacaaattgtcttttctggtattgggggcattttcaaaagagacttaaaaaaaaaaaaaccttcggggaaaatggaagcataattggaatatatgcatggctttccatctggatagctctgaagagattcctaagttcagatatgttagttgaaactgctcttgagagtcatcttgggaagggattgttagatacttgaggctgaaattgtttgttccttattgatgaaattaggcacctaccctctctttcgtggcatgaggctttgtatttatttaatgtacatttttaaattgggaatagactaaaatggagctctgcacttgttagttgccagaactcatttacatcctacatgccttagactttgaaaatatagggccaggc

SEQ ID NO: 132202 - DNA, 1185 bp, Homo sapiens
acaaagccattttggagcagaggaacatgctgacggaagagctctatgggaacacatttcagctttacaaggtgacatctccagaagtctttttctagtatttttacttttcgatatgctcttccttaacttccggtgccctatatatcttttgaatgtatttttactgtggctggttctttaagagaccatcttatgcccttgattttccctcatgctttattttgtttctggtatagtgagcaagtttctctttctccagagcattggctttaaatccccttcaattcaaactttgttcctctcctgagtgctctgtgtgtagcacttcaatacttctatttttacagtcatactgaaggacaagactcccaatagttagcaaagttgtgtgaccacccccaaccagctctggctgaagtgtattgggctctctgttgctagcttctcctgtgttttttcatgtgcatgcattgcccttcttcagattgtgtctggagatgaaggggaacagagagacctaaccttggatagagtacagggattgaatctgagaatagttagcagtgggactagctggttaaagaatctatttcaaaccttggaacataaatgcacacatgtgtctgaagggatatggattgattcccgggttgcctccattagccaggttcaattcttgggttgaatttgttgctgtactaattttgttaacagttcgttatatttaataggaatagccaactaattataaaacatatggtggcaagaatttgtgaagtgactacttgatctcataattgggcaagagctaggtgcttggcaagtaactgttagctggttaacttggttggcctggctctttaaatgcactgatagatacacagactgagaatcagctaatcaggttactccacaaggatatacagcagagctttcattatgtaaatatgggaaatcttaaatttgttaaaacttattttaaaatgactaattacttttctttttcctgaagtgaaaaaattgattaaatttagaggggtttgattgttttgttttgttgcagtcagcagatcaccgaactctggacaaagtgttagaggtacagccagaaaaattagaacttattatggatgaaatgaaacagattctaactccaatggcccaaaagtaagaaagttgttt

SEQ ID NO: 132203 - DNA, 1714 bp, Homo sapiens
atacaacagcactcagaacagtgaattttcgaagttgtttttcttgttttcatttggactaatttttgttttcattggaagttaattatacctaaagtccaatgatcttaatcttaaaaagtagaattttatttcacaattgaaaaagatatttaaaatattctagttacttttgtaattcttttagtgtccttttctcttaataggtatcctgttagaagaattaatgaagatttaaatttaaccaaatgtaaaatgtacaaactgctcagaaagcaaagtgaagtatatatgggggatggtatgttcccctttttagcttccagaatgagcattgatcctgattagtgattgccctttttacctaatttgtattggtgtatgacacttagaatgttaaatgtaattgaaaataatttctataataactagaatcagcagccaagaagcccaaatgggatgacttcaaaaagaagaagaaagaactgaagcaaagcagacaactcagtgataaaaccaactatgacattgttgttcgggcaaagcagatgtgggagattttaagaaggtaattctacctaaagatgcctttgttagtccctttgcaacagtggagaagtcagtgtaccttgtaaatagtgagatgtcctaaaataaatgacatagcacttgggttattgagggggtcctcatgacaccccattagagacatcagtacttggaagtctgcccgtcacagaagtgtgtagaatcattatgatggcatcggatatgcttatgaaaatgtatgaggttgaaataaatttgacattcttcctgagagatttctgagaaaatgaaggacaatttcttatcagctagattttgagatacttcagtatttgttatcttagatttgttttattattttttttacttctgaagttctggctgttaagatttggattgatacctaaaattataccttttgagatgagtttctgcctttgagaaaattacttttgtctggctgctctggaatagtaattttaatggcagaggtttgctgccttagaaaagaaaatcatgctgaacttggagaacatatactggtacagtttttaattttgtgtgtttaaaataacttctttatttcaactgtgtttccttcctctcctcatttgtagaaaagactgtgacaaagaaaaaagagtaaagttaatgagtgatttgcagaagttgattcaagggaaaattaaaactgtaagtagcatatactcattgttgcaatttttaacagttgaagttgcctcactctcaggagtagctgaccattcatgacagatgatcttatcattgtttccggtgtatttggccaaaagttttaaatatcttccataacactgaactacataaaaatttaaaagtgagggaccttactgctagggagttttgaaaagattatcagtcttttcagtcattttttaataattcttaaaataagccagtgtttccttaaagttatcttgagaagtttattagttcagtagtattttataaatgtgttgttctaaactccatataatttagtatgttctcaattgccaacttctttatatttgtgatgtgaacatattacttcattcttttcctccatgcttttgtaaacatcatgcgaagatctttaactaaaatataatcatttcagaattctaaagtagttttcattgttgct

SEQ ID NO: 132204 - DNA, 1108 bp, Homo sapiens
aaaattaacattttagatgtccttatgatatactttccaaatttcaagaatgttcaagaagtcatttcttaagacttcttttgttattgaactcttgaaaattctgtgtagaccatcattaaagcagaatacaaaggtatataaataatagctctgctatatgcttaaaactagagaaacataccaaactgacaccagtgtttatctttagtggtagaatcatgggtagcttttattttacatttctctactctctaggtggttttataatcaaggaaagaattttttatttttgttttgattgtttaaatccagttctactcaaaaggctatatgttgcatatttgagagtaagacatggtattgggattaaaaagtataattttctgtaatggatataatccaatagataaaagagatttgggcccagaatcattgaacttataattattattgtcactagattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatggtaagtactggttcgttcatgcctgaactagtgcctgaacgattgtgcacagggactctggaggtgcgttagaaacctcacattcttattccttggcaggtaacattttgggacaggtaggtggcttaaataaacaacaaagcatctttcatgctcacaattttcctctggtgcttagagtttcttatttcttagcccttttctgaattaccttagccatggagttaagttaaattataatggctttatacagtggaacctcaataaaacatttctttttataagctaaaatttattcgttcatcgaacgagtatttgagttttctatgcattgtaccaggagatagggcaaaacacacacacacacacgcacacacacaaaaataatcagtaaggatacaggccccaactaatcatagaatc

SEQ ID NO: 132205 - DNA, 1012 bp, Homo sapiens
tggtgtctcagtagcctataaagcgcctattagacagattcctttcaatgaaatattaactatttcaacatcttattttggagttcactgccaattgcttggctgcgtctaaaacaatcacagattaaacactggatgctaatctttgttttagctgtgttggattgcataggaatctttcagataatcctttattttcttatattaaatgcatgtagtggtacatgcagcctattgtttgttcctggctttttaggctccaagaaatcaagcgataattttgtcagttattcatcccctagtcttcccaggttacaaaatgcaaactctgatgcttattatacttagtgtcaatagtggtctatttttagccagtactattgtggaagtgaagtgatgcctccagagatatcaaacactggccagggtgtgtgttgttcttagtttttttattgataccttgttcattttcagttttaaaatttgagtcagtgattgcaaaattgctggatttaagtacttgtccattctatatctggctgatttgtattgtatttgtagactgaaggactaaatgtggcaatgactatgaaacagctcttatttgatgaagagaactgcagtgattgtttttggttttggttttggttttccagagttgctacgatggaagttaaagggaaaaagcaattcacaggaaagagtacaaagacagcacaagaaaaaaacagatttcataaaaatagtggtaagatatgcttcccatgtgggtgtttggctgttataattgggggatgggagggcatgtagtaaatttcaatctgtattcattggctaggattaggattaaaatagtaggaagaagtatgtgttattgtgtatgagttaacatgttgctcatgacatttagacacttaagaaattgcaagaatgattgaggaatgccttattcatgaaagactccttatctcagttgttgctgctgttgcctcattttattcacactagttca

SEQ ID NO: 132206 - DNA, 1066 bp, Homo sapiens
acgtgtgcggtgagtgtggcaggctcagcggtcgctcttgggaggggttcgcaccctgccgggcgctggaagtcgggaaggtctctcggggctgttgtccactgggcagtctcctctggcctctttctgggctaggagtttgggactgactggagcctggcaagaagggcgggactggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcgcctgtggtcccagctacttgggaggctgaggcaggagaatggcgtgaacccgggaggcggagcttgcagtgagccaagatcgtgccactacactccagcctgggagacagagcaagactccgtctcaaaaaaaaaaaaaaaaaaaaaaagaagggcgggactccgacctctctcccaccacgttgccctgcgtgccgggttagagtggactagcttcactccggaatcccagcccgtgctcggcctgatcagcctgtctgtgctacttcacaaaccccaactccagtgctaggcggtttgcctgaatgtacgcagattctaagtgctgggaggaaacgaactggatgctgagttggcagatagtggagtctgaagaagtgatctttaaacggagatttggaagctcagggagtacttcaagcagaggcgataatgggctaagttcctgagatgggagctaggaaggagtatagttagagtacaagataaagttagccggatagagtggaactaggttctgtagggccttgaaggtcatgatggggaatttttttttctgtacaataggaaaacatttccgttcctattaccatgtgtagaaaacattgaagacttgtaagcaagtgagaatcatgaataggccctggttctctttagaaaatgtattacatttggaagctcaagagattgtattggtaatagtttgcattagggtggtgacgtaagggacattta

SEQ ID NO: 132207 - DNA, 1001 bp, Homo sapiens
ggggtatcttgtgagtcgatttgaattgtaatcccgtttttttcacttgctagctgtgtggctctgggaaaattacagtttttatgagctttggcttcctgatcaataaaatagaaataattaagtgatacgtgcaaagcgcttagcatggaacgctctcaataaatgtttgccatttttagtgtctgctcgtgcctggaaactgctgttattccattttatacttcaggaaataagattgtggttaggatatatgccccattttccagatgaagaaactgacaccacaaacttgctcgtgtcaagcaacagaattttattctttaactgttctagaggcaagaattccaaaatcaagctgttggcagagccctgcaccttttgaaggctctaggggagaatgctttgcttcttcagcttctaacggttccaggcggtccgtggcctcttgttgcatgactccaatctcggcctgtcttctaatggccttctcctgtgcctgtgccacttctctgtgtgtttttaggacactgaacattgaatttagagtccacggggataatccaagatcatctcatctggaggtccttaatcacatctgcaaaggcccttttcccaaataaggtcactttcacatgtcctgggagttaggacatagacatatcttttggagactattcaacccactgcatctgtaaagttgaggaactggcacttgatccctggtgccagacttcagattttactgtcttccaacttactccgttttctggccactaaggagttagagttgaaactggtaatttagtagactgtatgcttcttgatgacaggggccatcattactttccaggcacttatctcactatgcagcacatagatacttgataagttcttgtcgtctaccttaactgttactagtttacatttcagctcatttaaatctcataagaacgttttaaataggtcttttctcattttacagagaaaggcaaaacata

SEQ ID NO: 132208 - DNA, 1273 bp, Homo sapiens
tctggctggaacttaaccacttcagtgtcatagaatcactttctctgttttaggtttgcttagaagacagtaacaagtcaagcaataagtaaaatgaaggcctgtgaagtttatcagcatccaagttcatacttcatgatctatgcattctaaactttacaagggtgtttcggtttatttaattttttttctaactctaaaatttgcatactaacttttttgaaaagtctattggtgattcttagactagctctttataattttctgcatgggcctgaagattaaatttcttttaattttgggtttctctttattactattatagcaaaacaaacagcattactttaattttagaagtatttttaaagaaatttaggctgtggaccgtgggcagccagggttggtgaaggatcccaagatggttgggcgaaaacttgctctaaaaaccactgactgtgtagcttttgtggagatcataccccagaactaaaaggccattgctaattccctgaaatcctggaatgagaccctcacctccaggttggctactttacctgagaatccaccagctattgactaggcttactacaaggcccatgtagccaaggcaggcttggtggatgactttgagaagaagcttaatgccctgaagtttctgtgccagaggataaatatactgcccagctggatgctgaagacaaagaagatgtgaaatcttgtgctgagtgggtgtctctctcaaaggccgggattgtagaatatgagaaacagaaggagaagatgaagaacttaattccatttgatcagatgaccattgaggacttgaaaaaaactttcccagaaaccaaattagacaagaaaaagtatccctaatgacctcaccaaccaatcaaggatttataaaattgagtccaggaggaagatctggcccttatattacacattctggacattaaaaataaaataattatacagttaaaaaaaaagaaatttgggtggagccaagatggcttaataggaacagctcccgcctacagctcccagcatgaaagacgcagaagatgggtgatttctgcatttccatctaaggtaccgggttcatgtcactaaggagtgccagacagtgggtgcaggacagtgggtgcagcgcaccgtgcacgagccaaagcagggtgaagcattgcctcactcgggaagtgcaaggggtcagggagttccctttcctagtcaaagaaaggggtgacagacggcacctggaaaattgggtcactcc

SEQ ID NO: 132209 - DNA, 1864 bp, Homo sapiens
gtgcaagtatgccgtaaacgttgctttttaggcagtttaggaagtcagaccatgcaaattactcatgtgttaacatgcaatactcaaagggttttaatttaactctcttcttttgaattcttcatgatgatttactgtaaatgcttctcagtttgcatgccttgatcattgctgctagtgattttatgtgccagtagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgaggacaacaaatattctttagaagaattttgattctggggaggaaagaaaatataaaaactcccattgactgttgataaccaagtaaatttttccttcagtaaattagtatttttgaagaaacgatcgccttgttttaacttgctaaacaacaattttaaatgacccaataaagaatctattgaactttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttacaaatacattggaaatggcttgggttttttccccctcaaatcactgcctggaggctaataatacagtacctcatctggagggtagtatctgccattcattaacttagaaacaaaattaagttgttttccttttttgtgtcagatgaaattggcaatatttacacatgaacagcacaaaaagagaaaattataagcccagcagggtacaaatcttaccctcaaagaaaattaatgattgagtgcgatttaatttcagaagctgtcacatttccattgtaaatccagatttttggatgttcatagtgtgtttgtttcatgtcacttc

SEQ ID NO: 132210 - DNA, 1763 bp, Homo sapiens
aaaaacaatttatacatttgagcaaattgagcaatcacatttattgcatttatttccctttttcccttttttcactcattgaaagtgtgggttttctaaataatattagacactaacactcaacagatttattcacaaatgacacaagtacacattttaagacttctttgtatttcttgcaattataaccaatcactagtcatgaaatatacctacataaaccaagtcctacactttcagtgaggaagaatgtaaggaaggtatgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagggcccaattttcaattttttctttggctatcaagttgctagtcacttattcaggattttcatccaaactgtgtttggactgactgtataagtcttactgccttttcagaaatctgctttcctttgtgtgatttttcttgtactgtatagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaaaggaaaaaaaaaatagtgtcactgtgatgttggtcctccctgtgtggacacaagtagaaagaaaaaacttggcaagtcacctttgtgtacaatttgaggcagtggttatatacaataaattgacctttattatatcccccagacacacacattcttggtgagaaaagaacaaccatccagaaattgagatgagaacttttgtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaaatcaacttttctagtatcacaccatagtctctagaaaaggaggacaaatacatgggcctggatagacctatgtcataactgatttctgcacattgaaggtacctagattgcctttaaaaggtataaagaaagggttaagtttcttttttttttgtc

SEQ ID NO: 132211 - DNA, 1042 bp, Homo sapiens
tccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatgattaaaacacaagaaaggcacatctgttcatttaaatagttgtaaaaaactaatcagcaaaaataaatagataataaagccaaaaaaaaggaaagcacaaaatgattgacagattatcaaatgaggcctatattaaacccaagatgtttatctttccagtggtattggggtaaggggggtggggggttggaaagacgaggtgagccagtctgtaaagttagaaataccaaatggcttatcgggtaatacacagtgtatttaagctgttgttgcttaattgcctca

SEQ ID NO: 132212 - DNA, 1352 bp, Homo sapiens
cctttttttttaaaaaagttaacaaagtatcaatcacaagttgccaaaagtaaattaatctcactatgtttgaaagaattatagatgcatcagtacagcattgatatgaataaaatctgatgaaaagaaaacctctaagctttgtttcctgagaagagctaagctgttgctttcgtaatgtcctatattaaagtgtttctaaagcacctgttgattgctattttctaatttgtcttcgatgatagtcttggtattatttgtttgtgcagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtatggagagagaatacagagcatttttattatagtgctagagggtttggaaggtcatctatttttctctgaggaaaaaatgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagca

SEQ ID NO: 132213 - DNA, 1048 bp, Homo sapiens
tatttgctggcttgaatcataaatggcttgatcagtgcataaaccgacttccagctccagtcctagtttgagtttacagtgtcaacctgacgtcaaagcccactttacccttccattcttagactgtgcttcctggaatcccacttagctagaggcatttatttcattttaaaatcaccatcttatgaccttattattaaatggaattttactgttttatcgatagtatttgaaaattgagttttaaagataatgtgacacggtagaagcactgttctaggtccctctgcaaacacgaacaaattcagtcctcacgttgtgaactgtctgttcatatattgggaagtctaaggctcaaagagtttaacttgtctgggagcacacaattttttttttttttttttgagacagggtcttgctctgtcacccaagctggagtgcagtggcacaatcacagctcactgcagccttgacctcatgggctcaggcgtgggatagtggtagagttgtgattcaaacccaggtcaggctggctccacttcttatgttgttccgcccatgctgtgctccactcctgtatttaaattctatatttcccatttaatatctttgcaccctgggaaagttatatataatatccttgcttgagtcttagttttctcctcaacaaaataagcataaggacattttttcatagggcttttgtgaagattaatttaggtaggtaagtagagtagataggcaggcagacaggcacatagtaggttcctgatctttgttagttccatctccttcccctttccataaatatgtaaatatctgataagtatttgattgccttctactctggattagatttttaaataccaattctgcattgactatccaagtaataatgtatataattagatcatcattttttggaccatacaaagataaagttgaaattgataaaacagataaaaaaagacatatgaaggcattgataatactgtactgctactggaagaatactctgcaaacaatttttgaatgttgagtcaaatga

SEQ ID NO: 132214 - DNA, 1937 bp, Homo sapiens
tctgaattaatttgcattcatagccttgccttgatagcccttgagatttctgttcccaatccatataactcacagcagcatatgcttctacctagtatcatttagtgtttgtttctgttttaatcttgaggggacctcttttggccaattttatctatttatctgtctgacttaccctaaatcttctcaaataaattggttttaaagttttatctgatggggaacaaaaagacaacttctgaaagcagtatgaaagctgaataggatgaaagaccctgcctactgtaggttcagacttctattttttgaagtcatcatgtattttagtcttttacacagactagttaatgtagaaaaaccaaatgatacttacatgtgtcatcacttttctgtgtaccagagtgagcaacgagaaatactcatcccttaaaactgataaagattgtgttaccctaacaattgacaagtagttttttattttctggattcatttaactgtgtgaagcttttattataattttctgttcttgcatctagtgtgtgtgctggcattcaatgaaaggatgctgaattgaacttttccttttctttctgtgttactgtctcaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacaggtatcatctaggtttttcctaggctttcttcttcatattctgcaaatatgtgtgtgtatgtgtttgtatatgcttctgtgacaaaagaaaagaaagtaataaagactttagtttgtggaaactccctgttacaactaccttcaacccaactcagtgattacaacaccatggaaatgtaccaggaaacttagagaaataaactttctgctaggaaaagaaatctcttgctcaaagccctacatgtcctcagatgggaacgtctgagattccagtctagataatgtgttcagcagtaatcagaaaagggcaactgtcctccctcttgcaacatacattatttaggcttctttcttgaggcctaacactagtctcctttttgttctctgtttagtgatgttcagaatgtggtccctaaaccagtagcaccactatcaattggaaacatgttagaaatgcaaattcttagcacctcctccaaatctacctgtatcagaacctgtagaggtaaggcccagcaatttatgttttaaaaagtacttaagttgattctgatgcatacccagaaccatctatttaacttcttaattttatcaattataactgttttcaaacctggctgcacatcagaattaatgtaaaaaaaaaaaaaaagaaacaaatcctaggtgcctcccaagacctactaaatcaaaatcttggtggtcaagagatagtgattagtggctgggcacggtggcttacgcctgtaatcccagcactttgggaggctgaggtgggcggatcacgaggtcaggagatcgagaccatcctcgctaacacggtaaaaccccgtctctactaaaaatacaaaaacaaaattagcggggcatggttggggttgcctgtagtcccagctactctggaagctaagccaggagaatggcgtgaacccggaaggcggagcttgcagtgagccgagatcatgccactgcactccagcctaggcgacagagcgagactccgtctcagaaaaaaaaaaagagagagataatgattaggaatgaggataatcaggatttttttcacaaagctctcctggtgattctaatgatcatcagtaatctcgtagacagtaacatag

SEQ ID NO: 132215 - DNA, 1044 bp, Homo sapiens
aaagtctcttaagaagagttgaagaagtaaggcagcttctagtttcagaaagtaatttaaactcagtaacagaaaacattttaaagaattatttataataatatccgaaaaagtttttcagtgttctgttagcattattatatgtataaatacatatatatatatttgtgtatctgcattccaatgaagtatttctacaaatgagttcttccctggttataagcattaaccttgggaacatttttgcatattaatgatcagtgatatgtctactgtacgacttatcctctacctgccaactttaagaataccctttcttttcctctatttttgactatcatgtttttctgggtccaccatgatagccattactcctgaaacccatatgattcggcatctgccctccaaaaccttcttcctttcttcagagtaccatgacacagtagtgagcccttcatttccccctacattttacttttcacagctctgtacatattaatgagtaatctctttctcaaggtagcacttttcctctttaacacccttatttctttccttttcttttcctagttttgccagattttcccagagtcccttgcctcccattttacctttatccccatctccagttcatttggaagtcgtcccagcttctataacatgaacctcaataatctgacaatataagaatgatgctcttgtaataaggagacttctatttaaaacaatgaaattacatgtgtgtcaatattataatacacttaagagcttgaaagtgctaaaaagttcctttcaggatatccatatatcacttttcactacttcattctcctctaattaaattttcttttctttatgcatttaagataatttttctattgcagtataactggtttcctgtttcatttaattgatagtattacgatggcataattctctaattttttgtgtaaatggtggtttttgagatctacattatgggctaaatagctttcggtgggctgacctgataacttagctattgcatatagttgtgtttctgta

SEQ ID NO: 132216 - DNA, 1078 bp, Homo sapiens
ttctggtataccatctgagtaaagaatgtatggtcactcaattatttctctatatgcagccttcagtttaagagtaaataactctttttttcctctaaacaatctcatcttttaaaaagatcttgccaagagtgactttgtttttctcctggtattttagaatggtactttagatttggttttacagaattctattagtctaataattttttatttaaatatttttgtttctaatttttttatatatgaagatgctacagtatgagatgtatagtctgcctaaatgaaattaaaatatttaattcttttcattgcagacaagattattttatactttttcttggtgttaattaatatgaattagtatttaatggttgtggtgtgttcacttatttacaaactacttattttacattgtaaatttgaattcagaaatgttgttaattgttcccaataatcgcatgaaatttaaggttgtacatttctttaaaattccatttaaagtttatgaaaagctctagccgtctattttatgtacttctcacaatctagcaaataattatttcctgttgtttgctggttttagctaccaaaatacatttagctcaaagcaaaaccttgttttttactcacttttccttgactttgctgtattgtaaatataagttattacagaaataaggcctgtcaaaatgcatatcgttagtaaactgaacttaaaatgaatcctgatgggtaataatccatctgggaaaaaatgacaaatgttacatttagatgttaattgggcaatgcaatatttatttctttttatttgtcaatcaggatttccctttgggaaaaacaggaaccattcatctttagtctatcttgattaatacagattaaatgcaaaggttgaaagatgcaattatcttcgtttccaccattaaatgagtgtatattagttcataagtagagtaatcaagttttaaagataaaggttaaaagttcctatgttattttatgggcttttgaaatcattcctatggtattttatgggcttttgaagtcagcatacattttacaagacatttta

SEQ ID NO: 132217 - DNA, 1031 bp, Homo sapiens
atcctttatgtgcccagtattaatattgtctgtgaggtgtcacagttcacattaaaccctgatcctaggtttcagataaagtcctcatttattagactgttgaaagtttagacagtgaaaactggcatttaattcatttgaaatttttagagccattcttactgttcaacattttggaatgaaagttgatgtttgtatttgtatttatgtattgagaatctgagtttttttttttttttcggtcactgactttctcaaacatttattgaggtattactgttgaccaggcactgtgcttctgtgaatttgaagacttaacagtatgggctaatggagctagttcctgcactgaaaggtacctaatcctgtaaggcaaaaatacaaattcacaaatagcctccagacttctttttagggttagtttcaactactttcttgccacattattttttaaatcacaaatgttcatatgttatcaattgattaattttagatttatcaaaattgtgcttaccttctgataatattgcttatacaagttcaaaattgcctaaagattgggcaggattggatagcaagagagtgaaagagaatcatgaatgcaaataatacttaagattgcagaatcaccctttaattagagttaactggcaccattgtgggaatgtccgttacctacctatttatattcccttaagtagtcattgcagtctgactctggcaatgaaaaaaaaaaagatcatgttttagtgaaactgttttcaaacttgagtgtgcatcctctggagcattgattaaaacacatctctggatctcaccccaatgactttcgattcagtcagtgtgggcaagggccccttgcatttccaacaagtgcccaggggatactgaaaatgctggtccaagaccacactttaaaagcctgttttagtgattacggagactaactacaaagtgaaaatgttcttatactcagaataaactgcaaaatgcagagaccatttgaaaatgtaagatggagtttaaatcct

SEQ ID NO: 132218 - DNA, 1039 bp, Homo sapiens
tcaaagcaaatatttagtgctaacatgtattttctatggcccactagctcagctggttagatcatgactaatgaggtctaggtcatgaggtcatttgtcacaaagtccaattagctttgatctggtctgtgtggactcaaattgtatcctcaactctagccaataatgtcacaaatgtgcacttttggtcaagagggagaagatgcatcttcaaaaacctttcattactatcaaggataatttttgactaaaggttctgtagcatcatttttatacttaataaggaaatgtcattgtgttgccatgaagtatactcaaaattttagcaactagcgaccataagtattttttctcaaataggactagaaaatttttttcagcataagctattttggtctttctgtaattttgtagtgctgacatttgactattataatttttgtctctaatgttcattttagggtctttctatgacttctttttatttggcacacttccatgtacgttaggaaagaatattccatattattctgttctaccacactgaattaacagcaagttagtgtttgatccctgacttggatcacagtcggagtcccacttctgtgtgataataaatgctttttgctaatgatacttccagaagatagggactctgatctttatcatgaacttttgagcacccagtacatggccctacaacctgtgcatgcttagtaagctcgctaatgctcttgtcaccagcgtccccatgtcatgtagccataatgcatggggtctcactcaagaagtgatgacagctctcacagatatgtgtcgtcacttatgaatatgtgtaatcattataatttgatgatactaaaatgtttacccgattctccctgtgaatatggacaattactgccagcataacaggcttaacagtgtgggttagtgagtgagtgtacatttcaattaaacaactgagactgctttacagcactgtgtgttggaatagagtacctttttgctcaagggagaaggtaatttaattactttt

SEQ ID NO: 132219 - DNA, 2366 bp, Homo sapiens
taataccggataaacctttgagatagatctaatgctctgtattcttcctatcatacctacctcttaccaaggtcctaatacttgtttttcaggtacagcaggtacagactgtgcagcaggtacaacatgtctatcccgctcaggtgcagtatgtggaaggaagcgatactgtctataccaatggagcaatgtaagtttatatgtggaagtctttttaattcccccactcagagaaaaataatgtacttttgaacacctcccactattcccagattgtttccttgttttcaaagtaattttctactagaacagttattgaaattaagctgatgtttagagcttttgtctatatttattaagaatatgcactcattttcctttcacttaaccccataggatattttaaattatttaaagtcttatgccctttaatagttcttcctatgtagagaaaaaatgtatataccccttgttagtgatatctgtattttaatgatagcttctaaactctatgctttttgttttattatacgaggtcaatttttatgtgatgtatttgcatgtaaatgaatataaaactagtatattaggagtttgggatttttgaacattttcagaatgagatattccacataaaaatgtctgataataaatgttactttcctatctaaacctgccccctgcccgaaaccagcttatctcttttgcatcaacaataatataaatttgtaaatttattttatttgggcttcttggctactttgcaataagatgcagaatgttgttataaataaaggaactaagaattattgtaagtcgcaaggattgtttccaaattgggttttttgtttgcaacctgttggcttcctcggttaacttaaaatgaattcaggttctctcactgactcttctgcccacctcccatcagtgttggtatactccaggatgataacctctgctgtctttattcttactacatctactctttccttgagtgatttcatttatttccgtgatgtcaacctataagttccatggaggcaggactttttttgtttttattcactactgtaataactcaacaccagaagtgtgcatgacatgtgagttcagttgttgttatctattattattataactaaaaacagaattctggttaattttgtattcgttttataattgtgaccaatgtacttaaatattctgagctttttgttattgttaccatggaaggggaaggagaataatttcactcttattgggtttttgcaaggatacaaggaaatatatttaaagtacctaatacagagcctggtacaataatagatgatacaaaactggaagcttttcattgactctggcttctttcttttcttactatatttggtcactgaatctacccacatcactactgcctaacactacctccattacctataaaataaaatctaactttccacactggcattctccgcattcctacctccgccttattttctaccttctaggcataaccaattttgtgcatttttccccaaatattcccctttcatacttctatgtttttggacatgccgttttctctgctgaaatagcattctctgtcttctctcctttcctcccagtctccctaaacccagtctagtgtgatctttatagacagacatgtcactcccttctttgtgacatggaccctgactctccttctctgcagttagcttatccttcccttataaagggcaacattatcccctgacttttacttacagcattgtactgtgaatgcttgtttatgtttcccatagtaggaagaactctccctgaatgcgaacttggcattttgttttatttacatttgcttaggtgattggcacataataaagtcagtaaatttctgttaccgtattaaatctatacctctttacatattttagacacactgtgaatgtttttcactctacttatttgttgtataggtccagggccccctggagcatgattttggaatcttcaccataaacttaaactactgttggcatttataccaaatgaaaaagacgcctgccacttcgacctttatgctctcagggaaaataaatggctttgtagacactgctagaggtcacccagttgtcagttgtcatttcatctttgtctgtgacaagtagtaatgggcacctgcaggggaatgtgagaatgggagtttgtagctttcgtgtctgttgtggtagaatgtgacaagggaaaagggcagttgaaatgggtattgagagagttaattgtatagtacctatcacagttatttctcattttgtactggtcccagctaaggtggagagattagtctgttatgtatgaaatgaagt

SEQ ID NO: 132220 - DNA, 1006 bp, Homo sapiens
tgtgtacacctggaccacactttggaaaaaacattgtactgtgccatatggctcactcccaacaggcatatttttcatttcctcaagttagctttttcttctgggacattcaaggcaggtgataccttatattcctttacaccgagcaaagaaggtgagaacactcattttctttttgtcaacaaagtgttttatttcacgcagttttttgttgtgatatttgcctggagacccttgttatgttgtcctcccagacttatttagaagcatgtttttcttctttgtcgttatttttctttttttttcttaagtagaatagtgtcatgtttgaagctccccagtatattccagtggtgtccccgtggatataaattgtctataactgataagattcatgctataattcctattcctctgacatgcctataatgtttgaattgttaatgtgctgctattatcttgggtttgcaaactatagtaaaatgcctttaaaagtttccagcttttgttactgacccataatggatatagaaatcatgatattgatgtcaaaggtagttacttctgttgattcaacttttcattgtaactttgctttgttgattttgacataaagagaaagtttatagctaatttttaaaattttgaggcattcaatattatatataggttggtgcaaaagtaattgcggtttttgccattaatttaatttttgcaccaacctaatatactagaatgatgagtgtattagtccattttcatgctagtaataaagacatacatgagactgggtaatttatacaggaaaaagcatttaagggacttacagttcatgtggctggggaggcctcacaatcatggcagaaggcaagggggaacaagtcatgtcttacacgggtggcagcaggtaaagagagagagcttgtgcagggaaactcccatttttaaaaccatcagatctcataagaattactgactatcacgagaccagcacagaaaagacctg

SEQ ID NO: 132221 - DNA, 1034 bp, Homo sapiens
tttgatctacaaaaagtgttacatgtttcaatctattgcttatgttccttttatttcttttaagcatattctctcttttttagaattgtagatccagagcatacatatgcaggtttgctttatggctaaattacataatggtggggtttgggcttctagggtacccattacccaaatagtgaacattgtacccaataggtaatttttcaacacttatccccttcccaccctctctccttttagagtccccagtatctcttattgtcatctttatgttcatgtgtaccaattgtttagcgcccactttattggttatgtttttatctttttatatatattttttaaccattaaaaatgaatcttcacaatggtgatttaaaaggctctgttattattaatgccatcaccaattttaagactctgaaccttattgagaaagggatagcttttgtcatgtcatctgaagagcaagtaaagaacaattcagacattgttataactaactttaaaaagataacagttatctttttaaaggcaatgttgaacatttaactcactctggttttcatctctgtagaagaatggttttgagagagtgcctatcactaacaagagtgtgatggaaatagtgttcctatctctggaaggtgccttctgtaaacatgaaaaaaaagttttctttttattgaatttacatattatcaaatatttacaccaggtcttaatagggtatataatagtataaagactcaaaaaacttagcaaggtctgttattttaaaaaaatggcctttaacctcccccattctcccacaaaccactcctcataggcaactacattgacctctttaaacctgttattctgatatttacctccatttatttaaatatagtatacttattttactgcaccttgattttttagttttaagcattttaaacattaccttagcatgcccttcttttggtccctaacacaacacacacacaccctggcccacccacccgcccacccacccttcctgtcccttatgt

SEQ ID NO: 132222 - DNA, 1039 bp, Homo sapiens
ttgctgcaagtgaaaattcagaatttgttccctgtttattttggttgcatttactgttgtgttgaattttgctttttccctcttccaggaaaactagaaattagtctttttggtttatttatttcagtataaatagagtcagtttgtatattataagtggcatccagagatgatgtaataataaaattctgagcctgagacactcagaaactctgtataataataaaatactgagcatggaacaccaagatactctatgtaaagtattttggtagatagagaaaaacaagttggcaagatggttcagaattcctatagaatataaagtgctgtgaaccattttagttgatagcgccacacacacacacacacacacacacacacacacacacacacacacacagtttatctcacttgaaatcgtgttaaacaccctgaaacagagccttactcatgtgagaaagagacttggaaacgtctaagagaagctcttattttaagattgcattctccatgttatatgagtatttctttccttgtgtagtaagcactttgcgcgtctgtcaggccttgctacctctgagtgccttcctcctttcttctcctattaaccatagcctattagaaagagcttttgactgggaattgggagtcttgagttctaatactagatcttatactaatggatccatttggttgatttttctcagtttctctgtgaaatgggagcctgcactggatgatctgaatacttttaagctttaaagggctgtgattttgggaagcaggccaattatctgaaaaccgattactccttcaccaaaagaaaatttactgggtgatcaattcactgaatagatagtttttttaaaatcagtttgctgaaacataaatttgctgaatggccattttgttaaatttaccaaatactctgatttatcattttgtctaatgaccagttttctaaattgtcaactgcctgaactgtgtttgtattaactacatacaaagtttatcacaaatgatgctgcatagaata

SEQ ID NO: 132223 - DNA, 1055 bp, Homo sapiens
aatgagatcatgtcctttacagggacatgaatggagttggaagccgttatcctcagcaaactaacacaggaacagaaaaccaaacaccacatcttttcccttgtaagtgggagctgaatgatgagaacgcatggacacatggaggggaacaacattcactggggcctgttggagagggttggtggtaggaggcagggcatcaggaagaatagctaatggatgctgggcttaatatctaggtgatgggatgatctgtgcaccaaaccatcatgacacacatttacctatgtaacaaacctgcacatcctgcacatataccgctgaacttaaaagttgaagaaaataaaatgttagccattctaatggatgtgtagtggtttctttctgtggtattaatttgtaccttcttaatgattaatgatgttgagtatctttttttgtgcttatttgtcactttatatcttcttgagtgactgtccaaatcttttgctcacttttaatcaggttgtttattattgagttttgagagttctttacatttatggatgtaagacgtttattggatatatgtttgcagagcctagcctgctttttttcttcattcctgtacagtgtctttcaaagagcagaaaattttaattttgattaagtctaatttattaattttatcttttatggattgtgctattagcattataactaataaattttgccaaaataaatgccaaaaatatgtttatgtcttcttccagaagctttatgttttacacttaggtctataatccatttttataataaactttttactttggaataattttagattggcagagaagttgcagaggtagtacagaggttcccatatacccccattccttttctccttttgtgaacgttttaaataagcatgatatatttgttacaactaggcaaccagggggtatattactattggctatacttcagactttatttggatttcatcagtttttccactaatatctgtttctgttccaggattctacattttgtttagtttttgtgtctccttagct

SEQ ID NO: 132224 - DNA, 1333 bp, Homo sapiens
gctttttctttcttaacaaagaaagcaaatggagctgcaagacattcattgccttttctgtcatcaaaataataatgtatgtatttaactcctgcagttccttaaattgatttagtgctaagctgcctacattacatataataggaatgacaagtgaaagctgcagcacatatttgcgtggcaaaagggagcagtgattgacagcaaagtttctctctacaagaaatagcagtgttgtggagctcaaaaagggccagatacataattcttaaaattgtagagcagattcatgaaatgaattttaaaaagtgattgccacttggtgtacttgagtgtctttgtgtttttggctctgggtgaggggcacagatggacagaatctcacctgactgccaaatatcaataaattccttttaagtatgttagtatttgttatttaagaatgatacttacaaattttagatcaaattgtgtctctgtactcagtaactgagtcctttagctgtaacaattcactgtatttgaagaagccgagtaatacatctattcaaataaagattttgaaggccctaaattgagttatctttcatggaaaatacccattttcacatgtctgtaaaacttgaggcatcgtttctggaaaggtaatcacataggattggtagtttcttttggtcagacagtggttaaatgcgatcatctttcagaagtactcaaaaaatattctggctttcttttgttcccatgacacatacccagaagccatggttgcaaggacacttggtgattgctgctgcatgatgctctgtgatgagcctagagtgctgggcttcatattataccatggaaatgtttcttattttgttgacaactctgtgtctgtgggaggcggggaggggaagccctatgtgtgcttgtacactggcagcctctactggccattgcaaagagcagcattgtcctctgttctttccattccaggttgcatatgcttttacttgggtttagctctttcttctttggtcctcaccctctttgttgtcctcttttgaagactagttattctgttggatgtcttgatttataattaataaagagctactagtccagtattttcattaataaattaatatcataagtgaatggaattcttcaggaccttagaagaagttatgaatataacctttccttgagaaataattttcatgtaagagggaagatagatttatctttatgtaggttttaaaatactttctcagttgcaagccttaatgtatgatatagagattagtcttttacttatgactgacaaaaaaccctgatgccttgaaag

SEQ ID NO: 132225 - DNA, 1043 bp, Homo sapiens
atagcatgcaaattctttggttttactccagacctactgaatcagaaactatggaaggtggggctcagtattctatgcttggcttccatgctacattttcagaaacattatattctatattttattatttttcccaggtttaaaaatatttctcttatctttgcctatttcaacagcagtattttgcagtgacttgcctttatcaagtcttttcaatgcgtttgacttagtttttaaagatacaagaccttttatttttgcttttatggtttatgtgatatttaattaaattagctaattacaataacaataaaactcccctgttgaggttttggaacaaatattgttctgagtgaatatacagctcagcagttgggagcagaagtgttgaggggcatgctagagagactcctgcaggctgtgagttttcagtattctgtgggcatctgtcagtatggttaaagaggaaatgaacaatgtgggtttacatagcaagctgggtaagtgaagcttgatcaagagagcttctcatgtgtattattctatgtaggcttatatatttcttggatccatttatctttataacccctaattcagtacgcatgttttagacttttgttagtctgtaggtagtcttcttggctagaccccagagttagaaatatgtttttagtgattttcagatctctcagttcagtattgtggagaaataagagaacccagtagttcatatgaaaaatatgtgcctgttattatgacaccaaaggggaaactctgtagcagctaatacttgaagtagaaaacagatggaaatcttcttctctagcctaagactgcagcttttgccctggcttatagtgcctactttgatttgggaaatccaattatgtgtggagataattccacaggtgaagtgtttgcctaccattgagattcttaagggatatataagtcgatccagactctggcatgctgaatcgaaactgttgctcctcagcaacattctagatggagttttgattgagctattttttaatgagtgt

SEQ ID NO: 132226 - DNA, 1918 bp, Homo sapiens
gattttcagaattgtttgctctctcatcttcacagtttaaaagcacatattcttttaaagaatgctttttctgagatttcccctaatttatatttcttattattacaatactatgattattctttgaattatagttctttgaaaactaaaaattctctcatgtaaaatcaaaaacagtatcttttttggctaaatcagaaacatctaaaaatatcagtgcattcatgtgaagaaatacttctaaaataattcagttatgtaattaatataattaatacttatctataaacttaataattttaaatagtcacatggcttctacatatcaaaaaattcatttttaatgtgaactaattgttcttgcttttaatattttaggccacttggtcattctggcattttatggtagagaatacgttgagtttggctctggaaggaatatgaggtaatttgaacacatgttctttataaataatgaactgtgtgtacataatacagagtattttcagatgtcatatatggagtctcatgtctgaattttttcaatagtaattttcttttttcatattttgatgtttttcctttcttgatggttggcaatagttaatatggtgaagaactttattttctatcactactatatatgttttcaagaaaacagtattatttacatagttatgtgttttcagtttatatttttaaatgcttcagttaacctagctttcggtggtgctgtaaaaaccagaagagaattccttcctttccacctaccaacttcccatcccaaccaatcctgccccaggtaggattaaggtcatgctgcatttaaaagtcataactgccacacagagttttatagaggaacaataaagaaagagcactggaactccaataatgtaaaattttcaggcactactcagagtgctttgagagcacaaatatgagactcataggttagtcttttcctgtcctttgatacccatatgtgaccctgtgtgatgtatgggtttgtcattctaaaatggcagtcaaataagtgtatatgccacatatattttcatagtggtttcatagactaaacattaagcctatatcaaaggaagtttcaattaaaggtagaaaaataatagttgactttatgaaattaagccaatgatacagtagcaggcttatcagtagatattaagtatttggtagagtaattggttaatatactgctgatgtcataattcccctactctactactcaataatagttttgttatgtaggaagatgcagcagcttgtttgtgtgaacttctgcttccactacaaacagtactttaaagacaggccttccactgccattcagaaaggtgaaaaaagcaggagtcagggtggggtggataggtgggaagggtgtcagagggataggcatagtgtctgtgagtacttgtaagctgtcatcattggtctttgaggttatgtttgcatccaaattacttccttacctttccaaagagttgaaatgcaattgccagcccattgaggatgatcaaacattgctattttaatgtttcttaatttttaataaatgaagcttatattattaaaattggtattatttaaaaataatcatgtgatttacttttttttaagcatgtataatctggtaaatttttgaaaagtattaataatttatctttaaatactacactttaatttctaagttctaaaaattgtgttcatgttgtttcaatcaaagatgtgatgatgaaatagaatccatcagtcttcacagggaacaaggtactccttatttcaatttgatatatggtctttgttttagcagccatggaggatactctagtttctttgggaagataaacactcaatctgctagttaagagacaaagctcaagagaaataagctgaagct

SEQ ID NO: 132227 - DNA, 1112 bp, Homo sapiens
atggccctgggctgtgcagacttcttgcctcccaaggaggtacctggccagagggccaaagcaagctctctaaagtgagtggcccaagggcaatgggccctctcgcctgagtctcacggttgtgctggaagggacatctgacatgagtgtcaaatgagcagggcttatttactcttagttatggggtatgagaaaatgtgagtgaaaaaagatgaaagatcactgggtttcaggagaattatggagccactgagaaagtaggacagtatttgggagttggtagaatgggacctgaatgtagaatagccatgttttgctcaccgttatatcctccagcacctaattaccttctagcacattgccaagcatctagtactgattcaataaattttgaagggcagagtagatattttgaatagttgtgccagagatgaaaataaagtcattgtagaatatagaaagaaacaaggaaaataaggtcttgtgggtgaggccaatgtagcactttggattgtaggtagatagcatcgattagcatggtcatctgtaaactattagtatggggagactgtattatatatttaatttttgtatgtgtgataccaaacaactagtctttcttaaatgaataattgaataatatacaagaaggaacttttaagaaatgaattggattttaaagttaagatgagtgacagaaatttgtatcatcagtaaactggtatacctgaggaagttgtaatcataaaaaacaaagagatcctaagcaactgtggtttttgctcacaatgagatatgaaacagtgaaagatatgttcaaagaataggttttatttgtaacctatttggaaagaagaacacagatgactgtagactggcctaaaattttcacttgatatttgcaaggtgtatatagggaaaggtagtaggagaaaaggattagaagtaatggagtagggtgaattataaacatttataactgcagatatgtttgactcatgttgctcaaaattgttaagaagtattgtgtagtcgtttagttaataacatataaggcctcatgtcagaaaatatactgagagtaaagtaagaaaatgtaataatatggttaa

SEQ ID NO: 132228 - DNA, 4010 bp, Homo sapiens
caacccggagcctgggcaacagagggaaaccctgtctcaaaaaaacaaagcaaaacaaaacaaaacaaaacaaaacacaacttggttaaaaaaattacttttcaattagagtgtagtagatatattaagaaaaatggagtttaacttaatgtgttttgtgtatgtgtatgtagatatttagaaagtcattttaatttacattttgcttggtgttgtagaacaatcaatactgtttttgtgcactgatttttgcattatccatctcttggaggatcattaggaacatttagtatttccaccttagtgctattttcttgaggcaaagaaagattaggggaactgtctgatgaagttctttgaatgaccttcgtgtagttttgtgagcaatttttaatagtgtctcacattgtatgatgatttttagaggctactttcagttaataaaggccatgaatgctgaaattgaattaaattgtagttaaagacaaaaattgtaattcattccaattataggaggttaaaatattgtgctgttggatcaacatttgatctccttatttttagaagtctgccaagttttgaattgtaaaaccttttaaataatattgaatgagtagagctgtatagtagttgtgggtttatatttcagcaaagatttgagtgccatatgtcttggaagtaaggtgggattcttttatcttggaacttggaaagagatttattttaatattttgattgggttaggtttgcttgagcatttttgggggttgatagaaatgcaaatgactatggactggagatacagatcagagtaatttgtgagaggaggtaattgtagcgatcctgatgcaacactcacttccagtcctactgcccgtgataaactttgaagtaaagacttccttctttaatgatgtaagcctctctattaaaatgtgttttgttaattttcattgctgcctggaatttcccaaatgtacattatctgggagctttggaagttccagtttaccttctggattataaaccttagaaagaatgccaatagatggcaccccatgcccagaacaacaccttaatctgaaggaatggggtaaaaaatgaagtgcaggatcatataatttgaaaaactagagtatgaacagtgactagtacaatgtagagaaaaagaaatatcatttcagggactaaatatgaatcccagttcaccatattctgcatattctgcatatctagtaataatatcactgctatgactgatgacatttctaatatttgattcaaaaacattctagcagagacctaagataattggataaattagtctctaagcttttggttttttattttgtcttttagctttaattttgaatgaggaattaaaggatttatatcaatgtatatttagtgcagtactattttggttaatgtaggaatcccgaaatgacttagatttccattgagttttaaggagcataaagaaatgagagaaatgggttattagatacaaaattgcatattctcagctatgtggacatattttttaaggtttccaattgtagagggttacaaaaaggacataacgatatttgggaatcaagaaggataaaaaagtgttggaagagatactgaaaagtggagttgaatgaaattagtagagaatttggaaataaagataaaaataagatggaaaaattacattatgaatggtgaaataatttattgaatgaacaatttctttttaaaatctttactgtgatttttacctaatgggaggacccaaggaaaaagattgtacttagcctctttttgagcaccacatttgtttttttgtttgttggaaatttttataacaaggtgctgggatctttgactagtattgtatgaggtttgactatttctagacattgtatatagaaaagattaaattgaggtgttgcctcagagttttcttgtaattattttattattacaaggtaatatattaatatataaaaaacacaaaattagcatatccagttgggatatctgattagtttatctgatatctaaagcagcctacagttgtaaagtcagtatatagtaaaaaactgtgtaccataaatgtatatattcctaaaacattttatattttggaacatttaaaacttacactggagtagtataataaactcccatatgcccattatatggatttaacaaagtagtaccttctattgctctaaagctatataatttgaaatatttgcatattgaaataaccttgaatcattctttactttgtgttgctttgaaaatatttaaatcttatgctaacaacagattcaatgtatacttgaaaaaatgcttatgtttaaaacaaaatatttaaaaatgatcttgttttttctctcagcacagcatttctcttattatttattatttttgtttttatgggtacatgttaagggtatatatttaagggatatttcgatacatgcatacaaagcatagtagtcacgtaagagtaaatggggtgtctgtcaccttaagcatttaccatttccttgtgttacacacattctaattatacttttagttattttaaagtgtacaataaattactgttgactgtagttaccctacaagcacagcatttctaaatcaggaagtttgttcttggtttccggtcatatcttttgtttagtaattgaattcaagtctcctttacttgaatcctgacccattgttaagaaagggagaaagtccagggacagtagcccatatttgaagaaacctgtgttgaagactaactctcccaagggtgaaatggggttatcttttgtctgccattcttttaactttgtttgtgggtatatttgagtaaacagttgagtcattttgtaagttgatgagggaagagaaccaactatcttctgcttcttctggaatatttccttcaaagtttgctactcattttgtttctaatagaacataaaggaagagacatctaagagctaatgtactgatagtttatgatatcactcaaagcagtttaatattttgtggtttagtatcttcagggaatgaggaggttccttctcttagtttttttatttgactgaggccagactggtatgaaagaagtttattttacaattctaaaatctatagccaaaaaaaaatcgttattcatgtaataatggtcttactacatgaaactattctataatgagcagactagtattataacaaatagtgattaatggcattttaataaacaacacaaaatttatacctaaatctttttaaaagctgatgtttccttgtttgaacctaattaaatgattaagatatgaagaggtaaatacagtgcattaaataagcttgcattttttgtttgtataataactttaattgccaaacttcattatgatccaaagggttcagtggaattgtgtatgacttaatatattttgtggcggtctttaaaaatatttctgtacagagtcactagacaaactgagtagtaaagtgatacaaaataaccaaagtgatacactaattaaatgatcttattttagaactaaactgtttcttttctcaaagggttatatataattctaactgacattaggaaacatcttcattatgtaattctgcctattagatttttatacttttcaaaagtaaatagaagatacagtgtatgaagaaaacaccagtataaagtttaatgagccaaacaatatgtgaataaaacgtaaatgtaaccctgcaaaacagaagattatagaatgtacatgttattttcagaaatatttatagatttccttatgaatttaatgcaagatgagtttcaacatttacagtagtaactttttctgtgcttttagataccttgtacttaaaatcaaagtataattttatttggctttttattattttacattctgtttagtatcaatgaaagcacaggcagttttattctagtgtttcaaagttgtttagttttaaatttgaccagtact

SEQ ID NO: 132229 - DNA, 1054 bp, Homo sapiens
ttgctaaaataggttaggcatttttctttaaaaatatagtcctacagtttaccagttagtttttgccactaagatttttccttttttgaaacagggttttgctctgtcactcaggctggagtgcagtggcatagtcatagctcactgcagcctcaatctcctgggctcacgtggtcctcctgccacagcctcctgagtagctaggactacaggctgttgccatcattttaaaatttaaaacatttcaattttttttttttttgtagagacagggtcttgctacattgcccaggctagatttttgaaagtatactttatagcaagttgtattgcttcaaaatctttatatttgtagtttttatttcgtatcaaatgcagagtgttcttagtgaaaacaaatcagttaaaaatggaaacgtgtttagagtatcaataaataggtataaataggttttgttctttaaatagatggatagaataagtatactggtgaataacaggctttggagtcagatttcagataatctcattagttgtgtgactttggacaagttattaccttcacttaacctcagttttctcatttgaaaaataggatcaatcttccctgccttatggggttttgtgaggattaaaggagataatttatgtaacgtactttgctcagtatttgacacaatatgtgttcaatacgcgttggctttatttttagggaaggctgagaaaatacctattctaatctttttgctacctaagaatcctttgaccatcccttttttaatgagcccaaaaagttttgaaagactttgcttaccaatttatactcattaaataataattattctttttcctccactttaaaaaataaggcacagacaagctgccaatcacaggcttggattatcatttgataaccagtcttatcacactgaattaatagaatgctagcccaaagttatgttttagttttactctgcagccttataatgggctccttttactaggtttgcataactctcctggtcaaaggattttagattaagaactaatgatg

SEQ ID NO: 132230 - DNA, 1335 bp, Homo sapiens
tgggctgctcttctttcaccatcatcagcttcatggttttcttttttctttttaaaactgtattttctttgtgcggcaaacagtcttaacatccattcagcactcttccctccccctctttctccccccccccacacaccccttgcacacatattgaaacctggggcctgttcgttgggccctctttgctgtactgggaaagatgtttttcttttttaaagtctgtctcctctctcttctttggtgtgtgtgtgtgtgtgtgtgtgtgtgtgtgtgtgtgtgtgtgtgtgtgtgcttgtgatttaaaccggatgcagggcatctgtgatacttgggttagtagttattgacagtgctttatccttcatgtggaggtgggagggggagtagtgaggttccgtttcactttgatgatcctccttccccgcagtagagtgttaacaattttcattgtgattatgagactttgtgatgaacagggaagggacacaaggaagctttgtgagaactcagttcacagtgttatttgtgacagttatggtactttaagagtttttttttttttaatctcctcattttcctttgagagttgaaattcaagtcaagttcataaagaatgtatgaaggttctcaacttgaaacgtgtgtatatttcactttctttctggttaagatctaggcatgtgtgtacttaacatattctttttatttactttttgattttctttggacagtgacttgaacctgctcaggagagagaactttttcctttttaagtatttcttttaaaaattatttttctctgtagatttgaatacttattagtccttatatagtaggttcttggttaacgttaacccagttttacagatcccctaaatttgttcatttttttcagcttaacttttagttaatagatttatcagtagagttttgataatgaatgtgtgctaaaacaaatataatgtactattgtagttgcacatattgaagttttaaatttacagttttaaaatgcttattcaaatagtcttctttctaacagcaaacatatattgatttaactgacacagcagcttgtgaataatgtgacagtactaattattcttgagattgtcaacgagcagggtgggtaattataatgctattaaggctaatattttgtaaaataagagttgggattttaaaaaaactttttcaattcatttccttgtgattgctattttaaatgaagacgatattttgttctgaaagaagtctttctcagagcactcagatttgtttataattattcctcctctccccaaactgggttccatgcaaatctctaatact

SEQ ID NO: 132231 - DNA, 1037 bp, Homo sapiens
tattgtttaatactgtaattagttacaaaagaacccagaaaccttttaacccatagttattgcttgtaggattttttttagccattttttaaagctgcatagatgcatcttcacatatgttgcatgtatgtttcagaaataaattatttgctaagaagtcacagaaaagacccagtattggaccactctaacagttatcacctattatagtgcaaaacacactgtgtgatcaataaaaaaaggtacataaccaagctaaaattgggcagacatagttcctgaatgtaaaatgttcaacattatctattaatttagaatgttgtgttttaacttggattgtttttttctctccgatcagaatgattggaagagacatggaataacacatttgtatctgaactacttgaagaaaaatctgaagccctgatgatatatatagattgtgtatttcataagttactttaacacattcgtagtggtagatttctgtattatctattagagtgtttttgcctattcatatctactccatattcaaggactaataagttatttcattattatactttaaaaaagaaaggatgcatatgaaaagataaaatagtgctatgtgataggcttgcttctgaaaaatagtatgagagtttgaaaagtaatgtatgctgtggcaccttattgttgaatttgtggtgaatctttttatgagagaaatcacacctgttttaaattttttcatttgattatatcctattttcttcaattgagagagagatgtagagtcttgggttctcttatataaaatgaatggtttcatttgtaccaatatttattgagcacttatgtggaatactggataattttattactcgattgctaattccctttactagatctgaaattctgtggatatgtgataattatttaaaaatgataagagagtgataggggccaaggtaattcaaaactgaacataatttgccactattctctggagcaccctcaagcctccctatccccacctaaagtatgatttggtt

SEQ ID NO: 132232 - DNA, 1032 bp, Homo sapiens
gcctagctccctaattggcaaacctagggatttttcacccctgatggcgcgcccgttggctactcacacttacgggagagaatgagactgaattcacatggcatgggtgtatggccctctttgcgtctccagcctgcgataacattactagtttcgaaaataatggttattcatgagtcctgggtcattgactggatattagcttggactaaatcctcttcggcagatctccctggttgtttcatgtgcttgagtttgtgtattgtatatgattctgttattaaagctgccaagagtgtagaatttttggtaaaaataacctcaattacatgaagtttaagccaagaaaaagaggacatctggtccaagctcatcaattttcagaggaggcaacagattatttcattcattcactcatcattcatttgttcctttgctcactcattcaccattgtttcatgcctactatgtgttaaataaacaggggtagaattggctcttatcctcacagagctaaaggggatcaccagaatcatctgcctgagaatattgcctgaggcttgttaaaaatgcacattctggagctgctactgaatgcacaccacaaagttactgagttggaatttcagtgagatggagtcatctgcatctttaataaactctccaggtgattatttatatgaactaaaattgcaaactaaggctgaccacctttgatatagcggaggaagcaggcaatttaacagggccacactgtataataagggctcagcagaagaggagctcccaattcctgcctagggagttaggagagcagggtcagagttccctgaaggaaggggaatgaggatgcctgagcttgtcctgaaacgtaagtagaacttcaagaagcaaagaagcagaggaaaggtataacaggcagagaacacaacatgggcagagctgcctagagaaggaaagccacccaacaggctagctggagggttggaggtaatcccatctctgtctcctctgagtaatacttccatgacc

SEQ ID NO: 132233 - DNA, 1020 bp, Homo sapiens
aaatattagaatggttggatgaattttgcacttttattgacatgatatcatataaacaaagtattggttataaaggcaaggcactcaacatttcctctgcttccatctcattgtctaaaatgggaacatttgtttgaagtacctgcttacaggacaaaaatgtcagaaggctacttaagaagaaatttttatggtattctaatattaaggtaccatgtaggtagtgagtgtatgattccctgggcctttctctgatttcaaagtttgaatgtatagaattaggctgagtagatgcgaccccaaagactatattcttatgccctctaggagctttttcagcaacgttatctgtgtgttctttttttctcattgggtctgtcgtggattacagaaggttttccaaggcagcaggtcaagggtccccagagagcaagggctccacaaatatcccgagtgttggagaagaaatgaagggagccaaggggagtgaggacatttatcttctttctcctctgtcccttttcctttcccatcaaaatttgtattttcaaagactgtttagtgtagttggttgggggaattcataactaccattagtgattgagagctttaacctagacagggagtgtttgaatccctgggaagcacctaactgacccaagtaaacctcccactcctaggctgtgtggaagcgtatttttagcagggattcttcttatacttgctgttgtctttgtcatctgctttcccatgcccattccattcaccaggaagcagaatccctggattcagcaaaccttcctttattctaccctctgactttgcactccaaggctaagtgaaaccaaagaatcttctcagcaggaagaaagtgtgggttggccagggatgagccagtcccacagagagctgaggactgtaggtctctcttaagtactggggtgtatggaaataagaaagatatcacctcagtaaaagggctgtattttaattcttattaaagtaactaagatttcctta

SEQ ID NO: 132234 - DNA, 1043 bp, Homo sapiens
gtagaagtgatacttgaagagggttttgaagataaataccttattgggcaggccaagtgagtaaaggcattccaggcagaggggaagcaaagagcacaggtgagaacggaaatgacaccgtggcgtgtgtgtgcacagagggaagagtcaaagggatggctggagtacacaggttaaggtgtggagtagaggaggaagagaatggagaactcacaaggccagctcacgaagggttttgtgccatgctaactgtaacctatcgaatgaagaagtcagcccagtattttaggaaagtcaagtagagtgctgtgtagagactggaatgggagaggtaggaacattaagctctaactgttgggattatgttgggccacatgtacagaacaccacaacagtgacttattaaagagttcagttcactcaggtgcaactggttaataggggaatgatgtcaggataatgtgcaattgtgtttgttcacatacagtctttcctagacaaaagctggaatagcaagagaagagaacaaaaacgtcctcagcctagctgctgtccagacaggagccctttcagctctattttaataacatttgaaatgagcacagtcccagggggctccctcccagaggtgcacatccagccttgcgtggccttcagctcatggcagatcacacgccttcctgtgcactgggccctgctatcacttgttgtttcagtacctgtaagccagcctttccagtctattttgtgtgatttttaataaccacccaggagcctatagccacactgaactgcctgcctaaatttcctcttgatattttattactgctgtaattagaaggtatcaaagattttcagtggtctgacccaattttagatttctcaaagaccttatttttaatacacatttgtgcagaggacaagatttttcggggttcatttatcacgttacagcaaccgcaccaacaaccccagtgtgcagtttactcttctctcatgacaagatgtcttttttttttttgagatggagtctcactctgtca

SEQ ID NO: 132235 - DNA, 1728 bp, Homo sapiens
cacacgggaaagagccctacccgaaagaagttatctagttagaaagactaaaggtatatactatgttgtgcatgaagaactccagttcagggctgagcaagttcaccaaagcacactgagcaacacttgccattgctagatttcttaaaggtagtatgttgctgacacgctctcccactagcccatgataaagatgaacatttcagatgccctcaggaatcttcttcattcccccctcaccccaccactcatgattgctttccatctccgctagagaagtccttcttacctttgtgactttaagcaaattattttacctcgttgggcatttgtttttttcatccaaataagatggtgctccagtgccctttccaactaaaacattctataattgtatgaatttgtggactcaggatactccactggaaaacccagcaccaagatatgagacctatacacaagaccaacattaactacttctagaactagaaaatcagccacatgagtaaatgcttcactttcttttttaaatttaatttaagttaagtttaagttctgggatacatttgcaggatgtgccggtttgttacagaagtaaacatgtgccatggcggtttgctgtgcctatcaacccatcacctaagtattaagccccgcatgcattagctatttttcctgatgctctccctcccctgcacccactaacaggccccagtgtgtgctgttcccctccctgtgtccatgtgttctcattgttcagctcccacttataagtgagaacattcagtgtttggttttatgttcctgcattagtttgctgaggataatggcttccagctccatccatgtccctgcaaattacatgatctcattcctttttatgggtgcatagtatttcatggtgtatatgtaccacattttctttatccggtctatcttgatgggcatttggattgattccctgtttttgctattgtgaatagtgctgcaatgaacgtacacatgcatgtatctttatatgatttatattcatttgggtatataatggaattatatacccaaagtaatgggatttgggtacataatgggatttctgggtcaaatggtatttctggttctaggtctttgaggaatcaccacacggcttctacaattgtgtaactaatttacattccctccaataatataaaaaatgcctcactttctgttgagccttagtgtttatatctgaatagtcaaagaaggaaggagtcttaagattttctaagaactctatagacgttctaatacattgctgggaccacagtcttacacagctctcgaacacagggatacatgttaatgtcagggatgccttaaatgtacattcaatcgatcattccataaacatgtgttgatcacccggaaggcatcagactttcattgtattaagtactttgatattcctgacttctcaatttaaaattattcctaatccaccccgccctttgctgtctccatgtttttctccatagcattcatttcctctagcccagtagatacattgcttactaaatttcttcactgcctgtctccccttactaaaatatacgttccacaaagacagagatatgtgtcttttgttgctctatccctagtgcttagaacaatgccacacatttagtgctcaacaaagaccccttgaatgaataaatgtcaccatggactttagaaccttcagtgaaagtt

SEQ ID NO: 132236 - DNA, 1130 bp, Homo sapiens
catatcaaaaaccaactattaggatgcctataaaggaaaccatgttttaagtgccaaggaagtcatttggcctccaaaagccaaatcaaccatctttattttgtttccatattccaaacaaatccacctcatgttaagcccaagatgatgtcttcttagtccccttggattttcagtcaggaaagtgagtcatgacagtaacaagaaaggcttaagtgaaatagcatttctcttcttgcaacctctactttattacaatagcatgaagcaacaatggaagtcacactaactcatggtattattccaacttgttagtatgttcttgtcatatgctgtttctgaaacagcgagtcatatatagtcagaattctcaaagcaaaagcccacaagccattctagcctgagtcaagacatccacatattccaaagtgcttcctctctgacatagaataggctggtcaaaggattgcctctacttagtcttttaaaggcgcgatctagaaatcttcatggtcttttcctttcccacgtagcgacagtcaggagacttagctgctaagagattatctttctgcacgtgaagaactgtgttgattgctggtaaggagagtatggaggtgagcagaaacccagaggcaaagttcattggatgaaccttttgtgtttgtgtccttttctgagaaatagtctttggttgcttttctgtttagttagaaggagaaaaaatttctgttttactcatccttcccctcagagaacatcattaggctcattctcttgaatacatattctcccctcggagccagaagctgtgcaaatataatatccagctggacatttgcaccaagtgggcaaatgtatcatctacctgggcacaggaattggcaccaagttgagaaccaggtctgtggaaccatgttcagcagagtaattcttcagcagcaatgacctacatttgttcaatacttaccttctcgtagaactagataaggtgctggagatacgcaacagtagcaagtatctgagggtttttgccctttccatctataagagccaaacgcccttcactaattgtgtatttttaaaatatatgctgtttccttccattcatttctctagtcaaatgttga

SEQ ID NO: 132237 - DNA, 1386 bp, Homo sapiens
aaacataggtggttatgtctctttcctgtgaagagtaaagaaaaaaaaaactgttcctattcagggtgtttgtagccacagtgaaatttcatcttttttatacttgtatgggtactgaaaatcttaagaatagcaaagactctaaattaagggacattaatgaattataacttggatattacttgccatattttacagtaataagagagcatattgcaggcactgaatagagggtattgtggaatttattcattccacgcagctatcagcactgtcccagaatactggcttttatgctgtcttcctcaatattgtcatgggctgatctgccctgctcaggtgccccggccgtgactcaaaccattaacactgcctttacagcaggcattgattcatcagaagttgcagctgccttcttggagtcttattggagtcttagtttttctacctaaatttccaggctgctttttttttgccttgcttctagaactccctatttctagctgtgacctgggtttgctcctgagactccagtcccgttctctctagtgaacttagctgctcatgtcctgcttctactctcactacccatcagccctggatttcagagttgagtcttaccctggcgtttctactaacacctagtcctaccttaagaagtgaggggtctgtaagcttcactggaaccttttccttggggacgtagagaaagtccttttttctaccttctaggagtgagtggctgcagaaaggggaactcttcacgattaaaaagaaaatgtgataaagtctcatcaacgtgcataggaatttgctcctcaggctggttcacagggatgcctatgaagcatttctgagaagtggatgtacttcatgaaagatgcgatgcatcagctaccctacaagattttgcagttgggaaagtaatgatctaggattcatagttctggaggactaaggcagttcggagtcatagctatacaaaaagcaagaatggacaatattttgtgtcttttcttttgagacaggatcttgctttgccactcacgctagagtgcagtggcatgatcatagctcactgtaaccttgaacccctgggctcaagtcatcctcctgcctcagccttctgagtagctgagacttcaggtatgtgccaccacacctggctaatttatttttaaaattattttgtgtagagacaaggtcttgcccaggcttacgtcaaactcctggactcaagtgatcctcctgccttggtctcccaaagttctgagattacaagcatgaaccatggcagcggctcttttttcttaaattacgttactgaccacgttttgtacaatccctgtgatcatcgctttagccaatctatgctcaaatgtaaca

SEQ ID NO: 132238 - DNA, 1058 bp, Homo sapiens
acaaaaattacaagttgcatgcctttctgatttcaacatccttttgaacctcagctccccaactctgtccagcatagctagatagtgggacagattttggtaaaaggacatctaaatgaagtattaacattcccggagtgttctaaaaagttttgttgtgggttctggtttctaatatgttttagtctcttccaagagggtgaacactggctacattctcctgagatagaataattccagggcgctatgcatcctggaaaactgtgctcatatcttgattaggagactgccccgggacgctagttctgaggctaataagcaagagcccagtgagttactaagaaaggtctcactcttaacgtacgcaatagcctcttcttgagtaaaaaagaaaattaattttatgcaacaagagccattgtccttaggtcacctcatgtaattctgttacaagcctacggagttaatgttatcactccattttacagaggaaggttctgaagtcttgagaggttatcttaccaaaggccacatagcagtaggggcagagctgagatatgaacctgtatctatttgaccccgaagtctccatccttttcctcttgccatgtcgccacactatggtacacaaaaggaaaaagttgataaagagaaaatatatcccaaaaagtgggttggagaaaaaggaaaacaggagtgcatgttacggagtgataacagtgcttctacactgaatgttaataaaaataataatagaaatggcagcatgtgtttaacattgattatatatcaggtattggtgaaatgctttcttatctcatgttatccctaacaacagccttataaattaggtgccattattatccacatcttacaaagaaaactaaggtaaagaaatgttaaacaactttctcacagttgtctaatatttcatcagtaaggatacaaaaattcaactccacgtagtctgggtcttatattttatgatccatattgtggataggctattataagtggttactaatgttgtagtgtaattcatagggtagagacaattt

SEQ ID NO: 132239 - DNA, 1048 bp, Homo sapiens
cttaaatatcaatgttgcactgtgaatgttcttttcccagttatgatataatgcccatgatgaggttccatttgtccccagaacctttcgattgttacaaaccagacacttgataatttccataaaaatttaatatggttcaaatgttgccacagaaataacatatttctctctacattgtcttgtggcttcttgaaaaatttttttcattttcattttttaagccgaactctcatgaaatttgctacctcatttcaaggacctttttaagaatcagctgcttcctcatgacccaaatgttaaaaagcaacatattcctttaaaccaataagaaacgtgtatgtactgtccatttcagtaacccttgttttatacagatttcttcatcaaaaataagcagcgcaacaagccaggaagttgtatttatgagctagttaataggccgattttgtacaccagaataataaggaaaaacacagtaacttgaatctctttattatagtttaggaaaacatgacagaaagagtctgatattaattctacaaaaattttagtagttccagataatctggataaatgaggactgtaggccacttcagaatgccagatgaccggcacgcactcagtgagtgattgactcattgagaccaaagtgtcatagccttttctcccctcctactgccccagctaaacccagggtcggggaaactttgaagattgttgtaggaaatgcaagtgcaaatctatttagatacttggaacctttggaaactcagtttgggttacactgatttccctgaagttaagaggactctcaaattaaccagggacaaccctaaataattttccaatgaggctgttattactctgggtagaacctttgaaatgttataaaatcagatattaccttttagcaaaccaaaaggaaacacagtaactcctgagttcagtgccctgttaaggacaagcgggtgatttgactgcaacatgagtaaaattgcaaagcaagaatatatagagacatgttctctgttcccattgtggagtt

SEQ ID NO: 132240 - DNA, 1068 bp, Homo sapiens
tacaaataatgcatttgtttgcccagattgtctaggaaagaaattacattttggacttcctgttccatgaattatcaagagtcttctgtcaaaaaataatcaacacgattcatcttctcataatataaggactgtaatattacattgcttttgagtttttccaccattaaaaaatcttgtttatgactattttaatccctttactagcatcagtgaaacagagagggtcttgtttactgtcctctttaggaaatctctgagctaaagtagaaggatctgtgccagatatttgctggttatatgtgtgtaccagctctgaaaaccacccttaataattgttttcaaattatcttatgtgccagacttttgcatttaggcagagacgaaagctaacactaaattactgacttcctggttgtgtgtgaatgcagtgaacgttactcacttggaacatgaaatgactgtacaattctaaataaaatattttatcataggtagcatttgtccaccaagttgcaagatttgcccctgaaacaggaaataacagaattgatctaaagcccctcacctagcttccttccctgaaagtatactgtgaaaatgccactttttgaattttgctcagtttctggacagaggtgctggattgcctagctttcctgtcattaggagtgactgaaagcaaccatctggggcttctgacaagcttggtcatggaactcagaaacaagggacccaagttattttggtagcttcatacacagcaagctgagttcttcacagtggctgtatttggttgggaaaagaagatctccagaagaatcaaagagctatcctgggcttttggaatcttgagcccagctgaaggtgctgattactataaacaacaatcacttcatggtccatattcctgagatctctgctttcatgaaattgatcttgattacttcgtatcagttctgatcaagtcaccaagtggctatgtatctgatatgtgcaagaccaaaagaaggtctactttgagtggaaacattgggccttagtaaatcctttccgcagacctcttct

SEQ ID NO: 132241 - DNA, 1110 bp, Homo sapiens
aaatgcagaaacacaataaagtaccctatccagaggtcagctaggttccagaaaagtgccagaggtttgtattccaaaaagtcaaatcgcccaaggttactttgacagatacagcagtaatggctcttactaaacagggttctgaaggtgttagtaatacttttaggatgactttggacagtgttattcaatttttaaaacaccatgccctcttccaataagcacaaagcaaatctcagtcctttccctattcctgtgcccccctgggagtgtacttgttttgtacattactcttccaactgcccactccctctcctgttgagaatcttcttggctgctagtttagaatgggcttgtctccatcagccaagaagatttcatagggctagactcaccaaggtttgtgttacaaaaatgaaaggtatgtttctatattcacaatataagattatattgtttaatgtcctttttcaaactacattgcaaccccagaaattctaatcttttcccattccagctgcaaatccctgatttaggaggcttctctcccctcttcgcatgcctcttcctccaaatcccacacatcctccatgtgccttatcacgtttctagtcctatcacctttctttttctttttaatgttaacatttctggtgctttttgattcctgaatattcaccttttcttagctgatgacattaaaggacattttctcctacactaagacaatgaaattgcctgagcgaactgcatacttttacaactgagttcatttctttttcagctttgcaggcacagtgaaatgtgtaaatagggactttaattctccctcagctgcaattcatagtctttaacacttcctaggtggaaaaaaaaatatgaatgctgttcttttaaacttgtaatagtttcattgtatattccccatgtactctcagccctctgcattagggagcgattggtttttctgcgggcacaaatggtgctgattgacttttagaaaatagcagagtcctcatatgtctgtcattgggatagttttctgctcccagtcagttccccaattgcattaaaagcactaagcaatagagatttcaaatggggacagag

SEQ ID NO: 132242 - DNA, 1049 bp, Homo sapiens
ttcaataaatcttttcttttcttaccgagcagctctcattagtctttttaataatagcactagtggatatcaacctcagttctccaaaataaattaaatgtgtccattagggttgtaattatagcatcagatatgagtttattctgctacaaagagatggcaaggctgatagagccaagagctttcctctcggtccttacattttaaacattgcttggtgtataaaatgtggatctaatatctgggtggaggaggggtggcctagcaaggtcttttgtcatctgaactgacaatatttctcccggcttgggagttgtaagcattcggtatcgagtggtgtgaattctgcagatcctaagtgaaaactggtcatcaactagcagtatgcagttcagagcctgctgaacaaactgcataaacctcagagtaggagaacatgacagaaggctgcgttatctgaaattttagctaatttttttttaactagcaggagccatctgtcatgattattctgattcaagggctaaattgaacggaaggcattgctgggcgattaaacaagttctctcaaaatattttcatacctttctgtcttgtcagaagcttttttttttttccaccaaagatgtcatccgattgtggattttttttttttttttttttttttttttttttttttttttttttttttgcagggggaggatttctgtctcccatgccatagagaaaccttgtcactgtgttggcactaaggaatggggtgagatgcaagtaaatgggtgtgtcctatttgaagcttattcttcacttctggctcttgcagccttatggtgatgttactcttgggcctgattgagatgttctgaattcatccagatgttctaaattaattcattagaggtttcttcagagggtgtcagaggggagcatttcaagagtccttttcctactcatacttagaaaggggaaggagttactgagccggaaaaaaaaaataggcaatgggacagaagactgcatttggtggcaagaatctgccatcgctttct

SEQ ID NO: 132243 - DNA, 1041 bp, Homo sapiens
atgactatgactagattgcaagctgtttgagggtaggaagtagggcttactcgtggtaaatttagtgcctggcacagtgcatgacataaaattaacacacgggaaatgttggtttaactgagctgaaaacacagctcctggctacaaaaatctcacaggcaaaggaggggagacaatataaatagaaaaattggcatatagctttgtgaaagtacagaggagagagtgaccatcagaataatcagggaagactccactgaggagctggcattttgctgattttggaagtgtaggaactggccagattgagacaggaggagcacatgcctggcagaggaagctgcaggtacatagctcagctatgggcttgggcatctgataattcagtgtgtcactagaatgcaggtgagcggcagggaggaagctgcaaaggtaactggagggctgatggggaagattctagtttgccttgctggaagttagattttgtcctgtaagcagcagggggccactagaagcttttaggcagaggactaagaaaataaccttttctttttctttaaacgagctttgggtgtagatattttctaccctctggtagataaatgtattttacctaccagagtgaatataacatatattttttaagtaagaataataaataaaataacactgatgaatccaacatccaatttcagagacagatgattcttgatctgttagaatctctgtgtctctttcctctccctcctctccttagaagacattactactttaattttcattttgtattaagaattttcttgcttttccttaaagttttaccacacatataggcatccttaaaaatacattgtttggttttgcctgcttttgaagtgtatataataggatcctactaaatatatttcttctgtgatttcctttcatcactcagcattgttttcaagagttatccatgttgatgtgtgaatctacgtatggatcattgattttttacagctttggaatatttgtcaagtaattataccaaattttatt

SEQ ID NO: 132244 - DNA, 1118 bp, Homo sapiens
attgctgctgtaacaaattatcacacatttagtggcttcaaataacacaaatttattgtcttaacatatctggagatcaggagtcggaaatgaattttactggacttactggatgaaagtcagaaggttccttctggaggctctgaaggaagaatctgtttccttgactttttcagcttctagaggccgcctgcattccttggcttgtgacctcttactcatgtcactccaacctcttgcttccattgtcacatctcctactactcaatgatcttcctatctttgtcttataaagacccttgtggttgaattgggctcacccaaataatctgggataatgataatctgtccatatcagaaatccttaatttaatcacagctgccacgtactttttaccatgtaatgcaacatatccacagagtctgggcataggaagtggacgttattagaggggccactgtttatagtatcacagtgggactagtgagaaccacccaggcaggccagaataagatgtatatgggagaatgctagtattaatacatttgtcccaccaaaggatagagaccagtttgggaacaatgaagatgtatccagatggcataaccacattgtacagatgatcattacttgctgtcctgtatttggtttattgaaagctggtatctgcaaaatgcatcattgaaagtattccttggcatgtcatattcataaatggcagatatgatgactgactgcttacttagatgcctgaagctacttagaaattaaaaattttaagagaaggcttaatttgaaatcttccttgggaatttttttccttttaaagaaaatgaacagtaagtaaacacgtttacaaacacagctttacgtgggagagaccaaaaaggaatactttcattaacattttccattaatacaacttgtcttgtgttattgtttgatattgtgtggtataatgaacctgaattttaattggttgcctaaatttatttgtctctggaaattctatgagaataattaaaatacacccattaagataaacatttggtgctttttccttaggtaaactttagtctttgacaggcatatacaatttatagccttaaaaaataat

SEQ ID NO: 132245 - DNA, 1987 bp, Homo sapiens
tcagggccactaaacaaatataattttagggcctactctgagctaagcaggatgtattgctgggactgtggaaatgaacctcagggatcttatagcatccctctgagctgtgtaaaaactaggccaagcccactctcagccactctcaggccttttatggtcaacaaatatttcaggtactgggaacatttgttagataagtttagatagaatctaagaaactgtggaattaaggcctttcttcaggccagggggagcttaggtgcagagggagtgtggatatgcaaccctggtgtacacagagaagcacactgacagaagactggcttttgggctcaagggcccaagctatctggagtgataagagactggagtaaccccccccccccaacgcccacccacccccgcccgacctgccatgggtatttggaggtaagcaatagtcttacgaatgtctgtgattgctacccaagtcctgatccttccaaagcaagagagcacatatgtacttcttgatttatgtgctccagatacactttcttttgtaattacatttgtgtgtgtgatctttcctttatgtatttcttatgtgtgtatgtgtgcccatgtgtgcctacaaaaattggtatatttcatcagtttctttttcagagtatctgaaattctaccatcagatgtggattattttggtgtctttaggcttttttcttaaattgttgatgaatccccattgaaattccagctatccctgagatggttagtaccatatttcttttttagctgacattttagcaaagattgatacatctcttccctgtggcagaaaatggagaggaagacattcagaaagagggatgtatctggtaccagggtaaggaaggggaccttgaaccaggaagagggagagggataaagagagctttggacttcatttccctcttcagcctgaggtgtgggggcagagaaagatggggtaaaagctcagatctctactgtccaatcagaaggaaggcagccagggctttttgctacttttcctaatcctgatgtcccccctattttaggggcttctgaggctgggcagcaccaagcaggctcaagcacggctgaaccaagcactgtgaccctgttgggtgtttggatgtgcagtgggtatcctgggcttctctcctattagtcttttcttctagaaagatgagttgaattcttggtctccaggcttattccttgtaaacaagaatttccgtgtcagtctcagtaatgcttagatcaccaatatatcatcacttcattttggccaacagcaaaatacctcaatgacattgtgccttggctgtaatctttgcttcttccctagacagcttgcatccaggactttatgaaacatctgtcaccttgtagcattgctgagtacagcagcaccgtaggagtttttgatagaaccgttccttcatccttacatttagcttttaccattacggaaatctaataataaactcttagctgtacatattggtctttagaagaaagagcagggtagttttagaacaagccagcttggattttaaatctaagctgtatccatttcctgttaaataaacttaggcaagtctttaagacccctaaacctcagtgttttcatctagtgcatggagatgacagtgctctgttcataagattggtctgagtacttaatgcatataaagggctaggtgtttggtcgtcaaggaacatacctgcattccctgtccttcctgcacccctcaccagcaaaccatcctaggtcctcaagtgttcctcaactcagtgatgtgctcggggcacgacttcaattaaataatggcatgtttttatcatctggcctgcagctaaattatattcttgactagtttacccatttactctattttttaaaaatttcatatgtatggttgtttgcgatttagaaatactctagtttttttttttttttttttttttttgagac

SEQ ID NO: 132246 - DNA, 1008 bp, Homo sapiens
cagcctggccaacatggcaaaaccccgtctctacttaaaatacaaaaattagctgggcgtggtggcgggcacctgtaatcccagctactctggaaaccgaggcaggagaattacttgaacccagaaggttgaggttgcagtgagctgagattgtgccgttgcactccagcctggatgataagagcaaaacactgtctcaaaaaaaaaaaaaaaaaaaaaaaagaaaaagaaaaaaaagaaaccagagatatgtgaagatctaagatgtgaacaaatagaaggcaaagatcaagagagatggtggctagggtccaccggtccccacatttcctggcagctcataaaagaacatagtggttttcacaaaaatgtatggaagaatgtttttacacactagtccaacagaaacatgaatcacagtgtcctcaagaaattgcttgaatatctaaaaagcaccaaggaaaagtttatgtgcccagtgtcctttacaaaattattggaaggaagttagaaatgatcattgactgttttttttgtgtgtgtgggtctatttttttcccctgatacaggtaaaaaaagacatataaccatcaccgaaaagaatctggtttgctagatgttctatattggttcttcaaaatgtacattgactacttttaaccacactcttccaatacctaatagaaattcatcggtttgtttattcaccaggcatttattgatgttgctcatgccaggcattttggtgcctgctgtagagacatctgagctatggaaaacactgccccatacttgcattgtttgcagcctaatgagtaggtatgaagaggtaatgggatggtggtttagcccctatacttaagaaatttctctgaatagcacatagaaaagttagaaggggttttgttgtatgttttacatttttttctttcttcccatgatgtttgttttacgggaaggctttctgcaaacggaagaaagatctcagtgcctctaatacctccccct

SEQ ID NO: 132247 - DNA, 1902 bp, Homo sapiens
aacacaggatctttcttttctagtcagggaaaactggtctcattagcttgtccccatttatattctttccctccattgcagtgattcccaaggggcatggatcagaatcactggggaaactttctttttccaagtgtgtatacctgccttccaggggattgggcatcactgacaaagctgttcctaagggactatcatatctcagagtttaggtggaacgcagttgagaaccattgctcctttgatttggaaactactctgtgtcaccctccgcagcttttcccttcttgaaacccactaaccccagtcaagatcccagtgatagccaagaacctgtgaagccccttaccttttcttctgtttaacagggttaatttaattccaaagatgataaacaatgacttgaaaagtacaccccaagtgttcctttagtttatgggaaacaaccagcaagagaagtaattcatcttgctttcttccttagtgacttctctttcagctgtgggttctggggacagatatgtgcatccctgccccgaggctgccagagccagtcctgtgtaaccaaggagagaggataaagaagcagagcctagaagttatttctaaacctcaccctaattgctcattttatattcagttctcctcctgtgaggatgtgacaaaggcctagcaagcagtcaagttgatttcagttttcctacctcctttcctttcttcctgccttccttttcagatgactttataattgtgattcctttatcggaagagttttgtctctctttcaatccaagattcgaaaatgcacgtgtttatgaggattatcacagcactgagatgtagttgtgttttattagaagtaggttccccagtaaggggctgggccttgggacaaggcctgcccccttggctggtagggaagttgccatattaaaaagacattagtttcaatcagcgtggtcaattcatctcacagtcctgctgcccatattccaattacatactgaactgactgacctttgcaatcacacagcttctgctgaattcttttcatcagagacttagtgcccgtccttcaatattgttgaaaaactaccactttggaagcatgtatttttaggaggggtatatcccctgcacattcttggatttctctaccaacactctgataccaggctatgcatcctgggttctatctttgtctgtgactcttctcctcctgaaaatccccacaaacttaactgtgtgtctaaaccctcgccacctttcacagcctctctctgatcatctctactctgggaagacttctaagactacttctgctcaaagagagatgtctcccttctccagttgcttatgtttgcctggtttctatccctcatgtgacatttgtatactgccttgtattacgcgcgctcatgtgtgtgtgtgtgtgcacgcaagcttccacagattgccaacttcttggacagtgtatcttttgtctactttgtatcttttgcattcagcacccaaattacatcttgtgttggttgaagaaggacatgctgcttgctattcctgctgcagagtatagactagtcaatgaacagttaaaccactctgactaattatagttatttgtctagaactaaaccagcatctctcttcacctaagaaaatgcctagccaacgtacagagtcatatacaaagccagtctgtagtaagaactgacctttgcagatatctgggtggcagtgtggtgggaagaagtctagaaaaatgtagtggtttctgaaagagaaaggtttgcagagaataaaggccaaactgcccttctcagaagcactcaggaccagatgacaggcacatgatggccgattgaatggttgttcctggacattgaaagcattttgcaatgt

SEQ ID NO: 132248 - DNA, 1020 bp, Homo sapiens
tcaaatgttagagatatgttgtgcccgataaactgaaaaaactattgctttgtgaattcccctggtgaagcccagctggtcacatgctggaaaaatttcaggaagcttggcaagtgtttttgcagcttgtttctgacagaatacctggatacttcttagagctagctcaaggaaagtctctaagccccaaggtatcccaggaggaacggtggcagtaacctcattctgttaagtgcaatgttatattaattgaaaatgaggttctaccagtgttcaactgttgaataggaaagctgactaatgtacaatggatgcttatatttgtaaagcacaaaataaagagaatttacccaagccttgaagttaccacatatcaagcagatatgaagctacagattgccgtattctgtgatgatttgctgtgtataggatacaatcttgtctctacctgatggtggcattaacttattaaactaaacattagttagctaagtttgattaggataggttttgcaaaggaccatgagaaatctcttattcagttgcatcaaaaccacatataaaatgttataaatcatttaaaaatgaatatgaattattgattcaggtttgttctttgatagcccacattatgtggtttgaaccatcctccaaagttggtttttatctctaatgtagtgtcatatagtgtgtatacacatatacatatacatatacatatacatgtacagatattatagcatactatagtatatacactttgtatgatgtagtaaaatgctgaggtgacagtttcagagactttctgagctctttgagggacttatccaagaactgcagatgctcagttcctgttagtcttgaacaagtcctgcatctgaactgtgtctttttcaatccctaagaccgactactttctctagcgcatagaagtctctgtgctgctctatttttggaactgtgtgcaggtggaagttgatttgtggtgagtgttactgtggctgtgatcaggagatacac

SEQ ID NO: 132249 - DNA, 1072 bp, Homo sapiens
ggacttaaactaaaaaggaaaatttgttcttgagtaccaggaacttagaatctaaaacagataatgcagatagctcaaaccatgtgtagcactgggtaaggactggccacttaaaaaaatttttaagtatatttttaaaaaagatttgatcactggagttcaatatgtaaatgcgtacaaacctatataatttgttttcaaatatgttgaagttttatctgtgtatagtaaattacattcttttagagagagaatgcaatgggatttgcagctgtgtacctccgtgaaatcaccaccataaacaagacaacagagagagcatttttatcacctccaaagttgcctcatgtctcttttttatccagtcttctttcagcccctggccccagacagccgctgatctgggttttgtcactgtagattagtttgcattttctagaataaatggtatcatatagtgtatactttcttgtgtctggtttctttcactaccgtaatcaccttgggatattcatccatgttgttgcatgtatcagtagctcatttctttaccttgtggaatactgtttcactgggtggatgcatactgtattttgtttatccacttccctgtgggaccgtttccagtttttgactattgtgaataagaagtccatgaacacttgtttacaagtctcactgtggacagatgtttgcatttctctggggcaaattactaggaatgagatggctgggtcatagggtaggcttatgtttaactttttagggaatcaggacagggcatttttgctaaatccagccaccaagcagtgcatacatatttgcattttagaaagtttaatattttttgcataaatggatagaaccaggttggggactggataaggatttttccattaaaaacgcatgctgaaaatgtgcttttataaaatatgctcttaaaaagggggaaaacctaaaatatgaatggagtgaattataatcatcaaggtatcaaaccaagcgcaggacctgagatgtaagctgtagcatttcctagccatgcagtgtgcatcagctgcttaatctctct

SEQ ID NO: 132250 - DNA, 1402 bp, Homo sapiens
accatgatttaaatactgttagtatatttcttacccctgaattcttatgaatattttcttttgagttgataataagacctctgtggcctatcctctgtccttaaaatttttaataattatgtgagactcatgattaattctatcatgtgatctaaaacatgggccaggccaggcacagtggctcacacctgtaatcccagcattttgggaggctgagacgggcggatcacaaggtcaggagacgcagaccctcctggcaaacatggtgaaaccccgtctctactaaaaatacaaaaattagccaggcatggtggtgggtgcctgtaatcccagctactcgggaggctgaggcaggagaatcgcttgcaccagggagtcggaggttgcggtgagccaagatcacgccaccccactccagcctggccacagagggagactcagtctcaaaaaacaaacaagcaaacaaataaaccaaccaagggtcaaagcgttgtatatatggtctgatatctagaggctttatttttccgtccatccatttgctcatcctttatttcagcacatgtttatttgagtacgttcttttcttttcttttttttttgagacggagtctcactgttgcctaggttggagtgcagtgccgccatcttggctcactgcaacgtctgcctcctggattcaagtgattctcctgcctcagcctcccgagtagcgaggattacaggtgtgcaccaccacgcttggctaattttttgtatttttagtagagatgggggtctcgccattttgaccaggctggtctcgaactcctgacctcaaggtgatctgcccgcttcggcctcccaaagtgctgggattacaggcatgagccaccgtgcctagccttgagtatgttctattactcctcactgtgcttaagtgctagggatcgagtgatgaacacgacaggcatgattactgccctgtggagattactgaactgtaggggagatggataccaatctaagaatcacagatctaaattggtcatatctgtgataaacaggaggaagcaatctaatcggtgaagttgggaaagattgtgacaattgagctgttatacagaagaagaagaattaagtaaatcttgcctgtaatcttaaaagtcctggcctctgtctttgccctgtgaatcggtacagttttatcagcaatcaggaagagcagacctcctcccatgcactccctatgttatgcgaggcaacctatctatcatacactctgagcttcccaccagtaaatcattgtgaaaaacaggagaaatgaagagactgagtttcctgggcttcatttagttctgccctaattagatttaagcagtggccacatggagcagccccatctgtgtctgctaccttggct

SEQ ID NO: 132251 - DNA, 1039 bp, Homo sapiens
atgagtcctccaaacggctttcctgaagttcctcctggtatatcacccacagttcttctcacacctctgttctatgaacaactagtaatcactatggtgggaattaatttgggagtcaaagttcaaggaaaaaattctcaggtaatgcgccgtttgctgggcacctatttagtaggtgagtctcagggcttaaggctgcaggtcttcacagtagcctctctgtttttcctctagcactcttggagtctcagggagaaaactgttttctggtttgagtcttatatcctcccattttggctactgatagaaaccgttaccaatttgggctgagttctctacttctttcacaacaggagtcttgctttcaattcaagttgtcaatcatttttcaaaaacccactctttatttatacatctgtttatttatatcctatcttgttctacagaaattaaggggagcagagaatagtaaaactacaagtataaagtagaaaataaagattagagaggattgaaattagagtagggcaaggcctgagagaaaaaaaaaagagatttgatttctgtgttcttagccagaaaaaataaaacaaacaacaaaaacaaaatgtaaaacgcagtgcatcccagaatttttgttgctggtgaggagttaaaaaagtcttcaaacggtaaaggaaaatcctcacttggggcttttttcagatggtaattccctgtgaaaagcactgaggtcttaaagatgaccttgaatctttcagcctagcaaggaatcaggcaaactgaaacctacagagtaaactccaggcggctcaaggccaagtcatctggtataggagcatgtaggaaagaaggattcattgtgacagagggatgtgggcaggcagcaggaggttccacctgagtgagccttgagtaaatggatagattttgactgcaagagtgaagacgggagcattccagtcccaggagatgaaggagcaatggtcagtgtcgtgggcttgcatttgagtggggcagggatacaatcgtttgggtc

SEQ ID NO: 132252 - DNA, 1198 bp, Homo sapiens
tttattctccctcctcaagtttgtaagagacggatgattcctattgttgtggcaagctgctcagctttacccaacggttcatagtgagagaagacatggggagggcagttagttcctcagttggggaaattagactgccttggaggtcactgggggcaaaggtgatcagagttatgcggagcccagtctgtcatcttcatgatgtttctacagacagggatacttgaatgcacagtgttgaatgcatttaaaggctggatccacacatttaagaaatcaggattaaggaagctgtacagatgtaaactttgaagaaaacaatgaaaaaaagaatagtggagagctgaatacgtgtggccaaactatgtcacttaccaaagggccagtcatcatcttttataacatgctagcacagtggtttgcagaatgtattctcatgcctgctttcaggataaaaacgttaaagagacatgcctgggaaattccttttccttttaatcaggataaagtggcctgttgaggcctgggaaagtgtattggatttcacctttgatctcccatacgtcagtctctttacaagtggtcatttctctgaaaggtacaagctgggactatttggcattgagttccagaatggcctttatcatcttgatgacaatttttccaatttctttaacagtttattcagttgtaaaactacagtgactcatgtaattagaggtttccctctgtgtcaacagagaggatttttggaaccaacaagttggacaagtttcctaccacacttcaaaagaagtagttaatcatgggataatatttttaggatgtcgaaactggaatatggctggctgctaatcatccccaaataaaactcttgattaattacaaataaattaatccaagagtgacaaaatttacttgggcctcattgaagttttaccaggttgcttcctccaagccaggtgaacaggaagaggggaaagatgttcttctccctcattaaagttccacttaaataaataaaaacaaaaacactctgaactcacaaagacagatgggctatcttgtaaaacattttatccaatgaagtgattttttttttcctttcctggattttgtatctcccctgaatgtgggcagctgaaaagtgtgtataaaatattcccaggaaaacaccaaagtgaaatttctccacagc

SEQ ID NO: 132253 - DNA, 1107 bp, Homo sapiens
tggccaaaatgcctgccttgcagatgtcctgtgtaatgaacaccttcttgatggtactcactccacataactatccttcactttcaaagtttagcatgcattagaatcacgaggtgggacaggattagaatgttgagaaagaaatctttctccttccctgggtctggagtgggtcctgatgttttgtatttcaaacaagtttccaagcagtgctgatgctgctggaccaggagaccacctttgagaaccactgttgatgaccttcacttcaactcttacctaaagaacaatgacccagttgacccagttgacagcaccacttgaagactgtggtagaacgatctactgaacacctcattccatcacctcttttcatctttttatagtgttttctccttttctccatcttttataactcactatccacttagttccactgaagaaactctgtctttatcgtccacattaatagttctccaaagtgctgggagttcccgttcagattttttccattccttctatatccttattgattgaatatttttcttcacttgcttgcattaaagattttaggaaaagacctaaaatctggttttgttgttcagattgtccttatttgtgatatactatcagcggggatgtcttccttttctatcgtaaatgtagcacgctgtaatagtttgttattgaaagagactttgggagttaatttaaaaacctaacagccattttcaaacaatgaattaataatttttgacagaaaacctttgtaactaggggactatatattcaatgtagcaggttttttgttttttgttttttttaccttgtgaagtaaaatgttttgtaattcagacatattatttaaaatgctttgaagtttgcaaaaccctttgaagaccaaggctgtgatttacatgtccccatttatatttttattaaaatcaccacccctccataaataaaggtattaatgggtaaatatttggccagttaagtaccaggactgtgtagggggctttcctgcagatgggcagaggatgtaatttcattaaacaggaggtctcagttaccctctgtttggaatccactgaagtaggacttctc

SEQ ID NO: 132254 - DNA, 1065 bp, Homo sapiens
tcaggaacagggatggacggaggcacccttgatttaaatgcacctggaatttagagtaatctgaggccagattctgcttagtcagactcgacatctgtagctacatttctcagaatagcccaggaaagagaaaatagaggctcttgccaactctattgatgtcaagaatgacaactccatatgctgagaagcaaggagccccagttgcactgttcattcttggttcaggatgcagaagtaatggaaaggagaaagatgaaaaaggcattgccttctttcattctccccttacccactggacaaggaaaagaggaaaatacaattttaaaaatcaagtaccataatcatgattttttaaaagctctagatatcaacgttagccagatccttgttaaatcccaggaaggctcatttgtagctgctgtgggaagacttgggagaccattatttggaccaatatcttccttttaacaaatggaatcttctgagccttgaaaacccaatgtggtaaagcatctcaaggggcaaaatgtggaaaactgacagtttctcaagtgttttgctcaagaacacacacatacacacacagagagagaccataaaatgaaacataacaaaaaaaaatccactctggattcaaaatgttctagtttgaccaacagcaatgtgctattactttttttttgttgagaaacagcacagttttataggagaaataattaggtcaagtttcaggaagaatgacaattagatctttaagctctgaatgtcaaggaggcagctttgtgactggtgtgacttgtgacctgctccgcactgatcagatctgtgtttgcctccttctctgtagactgccatttctgtacctgcagaacccgtaggccctgactgaagaattcactccagagcacatcctcctgtgactctcgccaaagtgtttgtaaccaaccgttaaattcagatggttcctctgagcttgggaaaatacgttttattgctctgtgccttttgagagcttggaaaggtggaggtcttgtggagttgtggaaacatctgtagagtacg

SEQ ID NO: 132255 - DNA, 1062 bp, Homo sapiens
tatgcgctaccagggctaccaaatgggctcacatgagttgaccaggttggccaggaaccttgggttccaggaggaaggatgcattcggaattcaacatgccttaaaagtaggggtaaggttctgattcaacatgtgtagaaagttgcaaggaaccttcacacctgccttaaaaatgagagtaaaaaacaaaatcatagatttttttattttttgagctagtaggagagccagtctctctctttctctctctctctctctctctctctctctctctctctcacacacacacacacacacacacacaaataaagctgagtaagtgacaagccctttcaggagagaacaagctgaggcctgctttcatccctggcaaagtgctggcaagaggaggaatctatcattgtcagagtgagaagaaagtagcccaacttaactaatttggaatggccacatgttggctgtttagaataataaggatctccaaccacaaagcaatccctgcaccagtctccaggttattcccatggatgttcaagtgcagaaggatggtaggcagaaggccaagaataggctagaaaagccaatagtacttctctctaaggtatttgtggtttttccacaaagcaaggcaatggcctgttacaggctgagaacagggcaggagagctgagagaaatcccatcatggcactctggcagttttctgtagtcactgtctgaaggatgaaagcagagcagcagtgcagagatctccagaggtgccaaaaaccaggagtgtagtggagaacaaagagaatattttaatgacttaaaaagcagcctcctgtgctttaaagctgagagaaatattccctagtttggaaaactgacagcttagcataaagcatagagaaaaaatgtctgaaatctcgtctgtgctcagatctcaagacttgccaaaaggtcaaggcctgatcccaccctcaaaatatttaagccagtggtgatttgaatctgattaaagctgcagtaacactcagacctagatcaactatagattagatgactcagggtccccttcgt

SEQ ID NO: 132256 - DNA, 1055 bp, Homo sapiens
gtaagtgccttaacctagatcatacagcaaatatgtgatatggttgacactagtccctcaagcctcttaatcctaaacccagtattcattctatctctgccttggatattttgtatgattaaagctaagccttatatgtagcagcaactggggtacagaagcaaaacgagtttagaaccccttctttccttttctttccacctctctcccaatcccaccagtattttcaatatgggaaactgacagtcggtcctcaaggaacaccttatacaacatcatgaagattttcattatgaaatgcctttctctcctaaattagtcgctaaggcacaggggtaatgtatcattttaatatgactgtgcatttgttgagctcctttgcgtcaaagaacgcacagtcctttacagacattaactttcacaacctatgtacttagtgtgatttggcaaggaagtaattcagtcttcatattgtggtaatgaaattgtgtccaggaaagatgctgggacagcctgaaatcttgggtaaatgaagtgaggacaaggaggatgaggagtcctgccaccttccccattttttatgctcccttttgccatgtgacttaaagaagctcagatctcctaggcagaggaagctgtctcaggacaccctgaacactgataaaccaggaggagcacggtaacatgtgcattgacagttctcatttctcacttgtggcattcttgcataattcttcagggagtatgtgcagtacaagcttgcagaaagaatatcatactgctttttttctttagaaacatttcaggacgtcatgttgttggctatcatgaagcttttgataattcagatattttgctgaactttcatttgtacccgagactctaaaaaagtatcaacatctcatttttacactaaactgtgttaatatatatcctttgtagttcagtctttataagtgtccaattaaaccattttatggctatttatatgaggttccaagtctagaatggaaagtcctcctttttattctcttcttatgttgtgatgtaatgtt

SEQ ID NO: 132257 - DNA, 1028 bp, Homo sapiens
tacttttataatttttcttcacctatctttattccttgtagaatttatttttatgtactgtataatacaaggtatgaatctagattttttcctcagtaaataggttttctcagcataattaaatacggtctatcattttcctattgagacaatatgatacctttagcataaactatattttaatgttgccttattctattacttgattctttcctctgtttcagtggtctacttgtcaactattgagcttctacatttcagagttgaaaaaaaaagtctttgaaatatatttgacatctggaacaggaccttttctgtttcgctaaacaggaaattttgtgatctgttcttctttacttatgatttcacttttttcagtaggtgtattattgaatattgggaactcacacacgtacactgaatgagatgagatcccattataccttcactttttaattagttggtagtgtgtagaggttatttttctatgatgattttgtgtctgaccaacctactgaactctcatctgccttaatttttctcaatttattttctaagatgttctaggtaatcctttctaatatttgtctcattcgttttcttgtttgtcttatttaggaccttttatacattattgagttctagtagtgagttaatagcaaatatgcagtacttctgattttagtgaatatgcttttaatacaacaccatttttttttttttaaatcatgaacttgcatggctcttaccaagggctttaaaagctctattgagacaatcacctggttggttttcttattctgttaatgcgctaaattacatgaatagatttttcagatgtttaataatcattcattcctagggtaagccactcttggtggtaggatgtggtttcaatcttgttatgctttcctgaactgacaggccaagcatatcatcccctttgcagtatggtttgttacatacccataaaaagtctcttccatattgagttatccatcatattacatgttttataaaaggtaaat

SEQ ID NO: 132258 - DNA, 1096 bp, Homo sapiens
aggctggagtgcagaggcttgagctcagctcacggcaacctccacctccctggctcaagccatcctcccacctcaacctcccaagtagctaggactacaggcatgtgcttccatgcatggctaatttttatattttcttgatagagacagggttttgccatgttgcccaagctcgtctcaaactcctgggttcaagccattccctcgccttgacctcccaaaatgctgagattgcaggtgtgagcccctgtgcccagccaaaaaatttaacattatgaaaagaaagtcacattatatttttaggaaaaataagacaggctatgaagtggcatcacagaaacattcattttttagtacatatttaaattcacatttttaaagaaagactggaggatgtgtactacagataaatatccaacatatggttggtggctattttgaggtggagagataatggtcaatgttcttttttatctacttatttgtattttaaatatagtttacaatttacagttcattagaatatactaattatagtacattttccttttgtaagaaagaaaaattaatgtggtactcagaacaaaactttaggtatgggagcataggaatcggtcataggagataacactacaggtatgcgttgatgaatgcatagtataataggatcacagtttcccttcctctgagaaacatagttttagtaagacaacctaagatggcattctttttcttttgcaattatgttactccgtggtaaatttataatcatttaaaatttaatatttttttcacatggagattatagttcttatgggatagtagatggaactcattaatcaagtcttcctacactctacagatttaaaatgtattgtttaatcaacttgttgggctataatttacattaaatagagtgtaaatattttacattttaaatataaagttccatgaaatttgaccaatgtgtacccttgtgaaaccaccaccacagtcaatatatggaacatttccatcacctcacaaagtactaattttttcttcgtgaggtgttcctttgcagtcaatccttctgttggctctgggcctaaggagc

SEQ ID NO: 132259 - DNA, 1014 bp, Homo sapiens
tgttctggaagtgaaacctagttcattcttctgattggaataagttgtggaaagggtgcacttttggtgcaagatggcatgagatacagtgactcattaacaggaaagagttatctttccatcatgacccaactttgataagaaaagccaaaaagaagcttgagatctacaactatgtcaagccggcagtgcttataagattaaactttttttgaaaccagctaattggaaacagtttaaaaacaaacagctttctgaatcttaatcaggaatatagtaggtataattattggtggttacatgtattaccctagaaaaataatttctaaattataagattgtttagctaacgtgttctacccaggagacttgaatctagactgagttttgggatattttgtttagaacaactagtagcaataatagacactgacaaatgataacagctttatatggtttatacagaataataaatatcccactatgctcatgaaagaacaaaattaagtaagaacagctgcatttggacatttaattttggaccccagagagaaaagacttttcatagtttgagacacactgtagggaagctgtgctataccccagagagtaacatcttccattgaagtcaagtttacaaagcactgtcccatgcataatctcactggactctcacagtaatccgttgcagtagaaaagatggttgcaatttttatttccattttaaggcgaggaaacagctcaagtgattttatgtaaggtcatacaccagtaagtactgggttgtgaaccaggacccagggttgttggtttccttggccagtacttttttctgttccaccgcagccttccgtgaagatgctgtgatttatgtttccttcatttcatactctgctgttttccaggggcccccagcccagttccttcctccattcacaccagggctggctattatattacataactccagcagtgccatttattttgtgttccctgatattgtacaacgagagg

SEQ ID NO: 132260 - DNA, 2406 bp, Homo sapiens
gccatcagtgagtaataggggttgccaaaaaggaaaaataaagtccattgtgttccaaaggaatgatgctgccaagtgtcttgacaggctcctgctgcacttgtcaaacagctgtgcctgggagtgaaattatgaagttggattctcacttagccaagattagaataggcttaattgaaggtgtctccaatgggggataatttcaaattcttaagtacagaatccatgcatttctaaaaaacatcctactgaccatctctaaatcactttgttttgtttctgccttcattttcactcagataggtatgatatgaaatttaaaagaggaaaggaaataaaattgtcttcataaggaaaaattctaaggttattaacataattatttcacttatagatattttagatctttaaatatttggcttacattttaatactgaattgttcatctaattataggtgtgcatgttctcttggtctccaaatgtgactttcaggtgcaaaacagcaaggcctctaacaactatctctatttcactcatttgactatttattaagcaactatttcatgccagtctctcttctaagcactggggatccagcagggaacagatcagacccctgactcccatccttctggagcttacactctggagggggaagataataaataatgcagatacctgggggaggaaagttccaggcagagagaatagcaagtgcaaaggcctcaaggcaggagtgttggccaagtgtgttctagaaacatcaaggagtccaaggtggatggagtggagtgaagaggaagaagagaagagactgtgatggagaaatgggggctagattgtttaggaccttggaggccactgaaaggatgcttttgagtagaggagtgatagggtctgacttatgttttaatagaatccctaaatgctatgtggagaatagattgaaggggaacaaggagtggaagttggaagaccaaacctcttagaattgagggcactgccgtagccttctgtctggtctttctacttaatatccagtggtagaagttgggatagctggttggattctggctatctaaacataggtagacctgaattgcatatgaggtatagagacagaagtgtcagaggtaactttaaggtttggttcatgcacctggaaggaggggggttatctttaactgagatagggatgatcatgggagatttagggagggaagcagatcggttgattttggacttgttaagtttgaggagccttttagacattcaaatagtgaatctggagatcagatgagaagtctagactgatgccatttttgggaccacctatttctaggtaacatctaaaattatgagactgacttacctaatttaaagtgaaatgagtagagtcatgacaacattggtgcctaccctgtattccatcgttgagggacaggttggtggaaggtgagaagagtagaagaaggagtgaatttctgtttaccaaacactgtgtatgtccttagtcttgcgttgctgtgttacccttactccaccttggatgtatcaaggagaattgcaaggggccattgaaagcaacaaggtggaattgaagaggttgttccaagttagcctgccatcaatatacttgtgtttatgcttccagaccagaatatagtcaaacagaaaacaagagggacctcttccaagagaatacattgatttccaccctcatggtcttatgctcttaaaattggtaggcattaaaaacagtatccatacatctgagttcctacagaactcagcagtgtgtaagcagacactctgagaaacggtattgtgttagttctaccatgagggtgacatggggatgacagagtccaggaacagactggaagacttcttggtcattgtgtgttgagaggattcaaacagcaattggtagtttttttctgtctttccaacagtgagattataaggttatatcttttaataagttaatctctcagtgaatttggtggtatctcgtgttccctgaatgtatcttctcagttgccgggcttctccttagagtgcctgctctggtaatgtctccatggtattgatgagaaacaatatgaaatggctactggctggaaggtcttatgggttgtactcaggttcacattctaaatgttcaaggctcctgtgctgttcttgaccaacgaagcctaatgagtctgtaaaaataattttaattttaagattacacaattatatttcttcttactgtagaaacagctaaatgaaaaaccttttgtgtactatgtgttgaatttgtttactgtgattatgatagctagggaacaaaactttgtgttttagcttttggaaaattttatgatgttcatgtctatggcaataaaacttcattggc

SEQ ID NO: 132261 - DNA, 1299 bp, Homo sapiens
ttttcataaatgatctgattaagggaatgtatgtcgaacctttggagatttgtttgtatatagattctaaaatgtgtttttctcagttctttcagactgcaccagtgtggaaaatttgtttggcaatatattagaaacaccctttgtgacctttggaatatttcttgattaccttttctttgagtggtcgtgttgtcattttagggtccagatagaatttgaatgtgtagagtgaaagaccaaacacatttatttttccaaaaagaagcggtcgtctgattctctttgatctttcagaaatgttttcttcaagttctgagtagaatgatttgggaaagagatgtttatttttttttccaggtagatttattagtttctactgtaattgctgagtcagggcttctaagccatcaataagacaatgcttgttgtaaccctggacagtggatctgtggttggctagcccagagcctgagtagggaaggcttgattttacgtctgctttaactctgggaagccatgtgtccttcatccagaggggagaccaatctgtctaataggtgtcatcgctcatataggaggttggcatagataggggtttggtgagaaagtggaatgaaacctgtgtgtttttatttcacggcacagtatttattttccttttcttgggccacaggttctgagcttgagtagggagaatggttaatctgttagaaggagaattttgaataattttttaaatgattagtttaaaaagttgttgagaaattggaacatgatataaccagtttctgggcaggcaggagcaatatgcttgggtaaatatataccctaatgctctacaattagggtgagcatatactttatttttcaaattaggacacttttgagagtgaaagtgagtttgtctcactggaatgtcagtctaaatcaggattgtcctggaaaaaattagggtatataattaccttacccaaatagtatgtgtactgatgtgttcactcattgtgtgttgattcattcgtttgatcactgagtgcaagccatgtaccataccttacccgggggatacagaaataaatgagacattccctttgggagctcacaatctattggggtgacagttgtgtaaacagtaaaacaagggctgtgatatacagctatgcaaacttttaatgggaaaactaggggaagaagctctcaagtatgcctgtagagtttgggcaggcttgttagaggaggtaactgcatcctgaaagaagacagtaattcttacagagaaagtaaaggaggccattt

SEQ ID NO: 132262 - DNA, 1575 bp, Homo sapiens
aacgttgttggagagactaaattggtgtaaccactttggagatcaatgtggtaatacctagtaaggttgaagatgagtctatccaataaaactgtgtctaggtgcctaccctagagaagcttttgtatatggtggcaaggagacatgagaaaaggtgtttattgcttttgtttttcaaaaaagtataaataacgtaactgtccatagataagtcaataaaccgtggcttattcctaatgaaatactataaaggagtttaaaattaaaatacgcatatatatattacatatatatctattaacatggatacatttcaaaaaacactgttgagtgaaaaaaatatgtgcaaaagggtatatatagtattaatacaatttatgtatatttaaacacaaaccgggcaatattatatagttctggtagataaataattatgtgatatttatttagatttatgtagataaataaaatcatgggggcagggtaactagtaattttaggatagtggttacatctcaaaaggaaagaaataaaagagatgggatgtgagggttttactttctctttttttccagagagagaactgaaacagatattaccacctaatggtggtaatataggtgtcataggtgtctgttatagtatttggtatactttactgcctatttgaaatatttcataactataaggatatattttatctaaaaataaatgaaagccaattactatcacactccaatttctttccacccatatcatttttttagatgagaacaaagcctagagaaattgatctttccacgactgttatttagctgttccatacttagaacttctgaggctgtagttcttaaccctggctgacactggaatcatccgaagtacccgtacctgggtcccatcttcaaaatttgtgatgtaattggcctgggatgcagcttccaaggtgattctaatgagcagtcaaggttgagaacagtattataaaagttttccagttctaacattagtgctagataaataaaagcctaccctgttacttctgttaagatgcagggatgtagtgtttagtagagtacatctctacttattctcaatggcctgacagtaatctctacattattatcaatgtcctgacaatgattagggtagtttaatgttctcttgtaataaaattcagagacgagataagatattagaatgattggtagtggcagaaggctttcaactgagtgtccatttcacattcagagtctctttcttcacaattattagtcgaagtttgggaggagtcttgtgctgaaccatgtatacattgttgccacctccttgcctccttgatttggcagtggaactgacaaatttgtcaccctgttcccatttttaaaggtaagatagagtgttctctcttccaaacacaatgcagactttcagcttttaatagaaaatgatcttcaaaacacttttgctactatggacatttctgaagagttggtaaattactaaaatattgaattttctcttttatcaaatctgcctgatgtgattaaataaataaaattaacattaatatcc

SEQ ID NO: 132263 - DNA, 1090 bp, Homo sapiens
gctactcagtgacggcttgcttacagtaagtggctgccactggtatcctccctcatgccaaatttcatgtcatgcatgagagaacgcattctcagaatctctgaccataactccctggacttatcagaaccctgggattcacatcattcaggattctgggtggcagaactgggggagggctgtgaatttattatttggttaacttactggaagaagagaatgggttcttttccttttaccccgacaactccacccttgtgtagatctctttcttattgcttctgtggaaagcccaaccagctgctctctttccaggcctggcctcgattgcagagacattcccacccagtggcaaagggcttgagaagtaaaggcctctgtagacagacaggcagacctcagctagtcagaaaccgggatatgccaatattacattttaaaatacccgactccattcactgctatctattaactatagtactttctaggtgctgaatctctttattttgaccttctgagcttagaccaactgcaaccttggtaaatctcagaattatcaaaatatttgagcattatcagctataactgttgaattctattaagtttttctgagatggtaaggtcacaggtcagaacaagtcatggagtctctgaatttgtccctttcccaaacccctgtttcatgttcctaaaaggacaacatgaagtataaacccaaacaatagatgtacactaatcatccctaacaatatccatagtgaatggttccaacagagtgcaccctgagaacgtttgtactgtagatctttttaccatcaagttgaagactgtgcaatggttgggtaacggtgcccagtaagtgtgttctgaatgagcttgggcatgctctgtctgttggtgcttctcatgagaaaggctgtctgcctatctggggcagagtgagtagagggacccagggttctgttgctaggatcagaaacactgatgacttgccttcacgtacgactgaaagcagttgtgctagcaggttggggagtgctggtaagggaattgggggaacgtgggcctccgcttaaattttgtttatttt

SEQ ID NO: 132264 - DNA, 1041 bp, Homo sapiens
aatgtggtatttgtaccctatgtattttatgacttaattattctaagttgaaagaatttatatatttttttgtataccacattcgtcactggattcctggaacttttttaaaaaatcggtgaattggaaagtatctgtttgtatattttccttggcatgtccaagcaatattttttagctgaagttcacaggttatgttttaagtaggtataatacatgaaacctgtttactttgctgataacaaggacttaaatgcagcttattgtaatatgaagaaattcatgttattgctttatcttttgcattcttatagttacctttattctttgggggcaaactattattttaattgctttttctcctagagtgaggtctctgctgcaaaaggtttttacagtctgacctacttaactagactttcctaaagaggtctaaatatattgaaacatgagagtaaaaactgagatagaaatgtggaaattaagttttttttaaacaaatgggagtgtttcggttatttttctatatagaaatgcgtgtgtgcgtgcgtgcgtgtgtgtgtgtgtgtgtgttttaactgggtactcggactaggattcatgtcttctttagctaaaggcccaagaacataaatcatttgaagaaaagattttccagtattttccagtgttaaattttagatacagaacttttcaataacatgtatattgcttcagaaaaatcttactgggcatggtggcacatgcctgtagttccagctactccggaggctgtggtgggaggatcttttgatcccaggaggttgaggctgcagtgagctgtgtttgtgccactgcactctaggtgacagatcaagaccttgtttcaaaaacaaacatatatatgtgtgtgtgtgtgtgtgtgtgtgtgtgtgtgtgtgtgtgtatctatacacacacatatacatattatatatatagtaatacacttgcctttaattagaatgtgaacatctgaaatactttgttgaaatttacttatgccccacattgttccaagaa

SEQ ID NO: 132265 - DNA, 1424 bp, Homo sapiens
gcagccattgacactatgtaaatggacaaatattgtctgtgtttcagtacaactttatttattggcaccaagatttgaatttcatgtaattttcatgtgccacaaaatttgatttttcttttgatttttcaaagccgttttaaaatgtaaagaacattcttagcccatagggccatacaaaagtctcgcaggctatagttttgctgaccaagttctacctggttaccagaattagctaagtaaaatataagtctgaacatttcattcgaatgcttaaacccatcaaaggtttgccaacagggactacaagaataaggcttaccttacttaaaatggcttattgattccctcatgatcacaggtccagcatcatagcttgccagttcatagcttgcactgcactcttcagaatgctgacctccttgcagtatcctgtccacactgagatacttctttttgaggccttgacctcccttcctggagtgtctcccatttacctttatttttctctttctttatctctcttcctttcttcttcttctttttttttttttaaatattgtattagaattgttggtttatttgcttcactaagaggtttccctagtgagacacggaacaaccatgtctcgttctattctgtgttcttatcatttcacttcctgcccagggccctgctaaagtaggctcttcataaatatttgctgaatgcatgtatacatgcatgcatgcatgaatgaatggacaaatgaataagtggaatggaatagttaaatgagccaattttgatattttgctaataaccctgaccaagctgttggtgagttcacaggttgaaaccagtacaggcagttcttaacataggaatgtgttgagttccaaaagtttgtttggaaattggttgttcagaacttggaacatgttttcccatataaagatgttataaactaaactatgcttaactattcagcttagtccacaaaaatattatttgaggcatcatgtcactgaaataaaattagaaaataactgaggtgtcaccttttcattttattaaaatattttaagcccacatttcatctcaagaaactctaaaagacattttctggcactgtgtaatgttataaatgaaacaaaactgaatgctggtaaaggcttagtgtgggtaaagcagggagataaagagattgtgaaaattttatgggaaactgagtgtttttaagagcatcaattctttactatttttgttctacttcagaaattatcgttttctttgccatgctcaatgtttatcacaagaactccttttgagatcattggaaagattatggcccttttttgagaatcaaatgtaaagatatatagacacattttagagacctcctccaaaaaaaatcttcaccattcacttccaacctccttta

SEQ ID NO: 132266 - DNA, 1046 bp, Homo sapiens
atgttggccaggttggtctgaaactcttgacctgaggtgatttgcccacctcggcctcccaactgactccttctttttttttgagatggagctttgctttgtcacccaggcaagagtgcagtggtatgatcttggcacgctgcaacctccgccttccgggttcaagcaattcttctgcctcagcctcccgagtagctgggattacaggtgcctgccaccacgcccggctaattttttgtattttactagagacacggtttgagttgcccaggctggtctcaaactcctgagctcaggcagtctgcccgcctcggcctcccaaagtgctaggattacaggtgtgagccactgtgcccggcctgattccttcttgatacttgactctcttggtatcaactcccttccatcttggtgtgttcaacctccctggttctctgcatttttcttggactgtcatacgttagttccttggtgggctcctcttactctgcttgttaataagtattggtttccctaggatgcagccttttcttcctccccttgcttttttactggttcctttcatattctgtatcttctcagcttctgcctgcagatgtatgcatggagtctcttactctcagacctaatgagttcctgaaagtgtatcagatggttatatgtacaaaaaccaaagccaaatattttctagaaggcattgggatgtgtgtgtgaaagaatcgttataaaatcgctaactgtactcctctttttacatattatcttcaatcagaagatattttcaaaattgtgcacctgttttctttagtgcttttccttcatagtagatcattctttcatcagcttaaattcattggctatctgacattttagtaatctcttttttaagtaatttcaacttttatattagattcagaggacacatgcaggtttgttacctgggtatattgtgtgatgctgaggatggatcatgttaacgcaggtacctagcatatacccaacagtttttcaacccttgccccatttctctttccccactgtagtag

SEQ ID NO: 132267 - DNA, 1108 bp, Homo sapiens
gtctggtgttgtgtgctggcaattagtaacacagtgtctctttccttacagaaaaaggtgcgtgcaggatgggtgagatggtggcaaggcttgatagatctctttctgcactgagtgtgaatgaatttgggaccttttcagtgatgctgtcttaggagcctgctggaaaacccactgttgacagccatccagtgagaattatattgtttgcattttattaaagtggagccaagtggaccttgaacttacataaacaaatggagtccatggaaatgcatataaagattagggcacaagttcatgtattcggcacaatctggaatagtccagcaaacaggttattactggttacttaccatgtggtcaggatggagctagatgctggtggagtgtggatggtgcagatgctcaaggaatttagccttgttgagggcgcctgtttaatccgtaggaaatcacagcctaaccttgcaagacaggatttacttaagtggagaagagtgtggtacagattccaaatttatcaatatagtggaaactctgcgcagaggatggcccatggagctaaagctgtcagggaagcttcctagataagggagggtaggggtgtgtggaatttaccttggaagaaggaaaatggcagacattccaagttgggggacaagagaaagcccagaagtgggcaggcccatgacttgcttattggtgagaccataaggagactggctctagcaggtgaagctgcatcgaagcgtacagccagtggggcctgcaggtaccctgcttccttggacgagcaggataagcattgtatttctttccttattttgaagctctgtcatttcccagaaagccttgcttatttttaaactgaagacttaagttttctgcattgtagaattcccacataagaaaagagtcccagggcagctcactaaaatttgctcttaaaaaaaaaattgctgcttagcagtcataaatagcttgctggatatgaatttaagcaggccacatttgaaattctattctattctaattcagagcatgttgcacagccctgttttcggattggcaattcaaatgctttcccagataatgcagagggatg

SEQ ID NO: 132268 - DNA, 1023 bp, Homo sapiens
cttctactcattgcctctaacactatgccctatttagatggagtagcatccgttcctcacatgttctatctctcttgcctctaggcttctgtatctgctgtttcctctgcatggaaaactcttttcctttggcctcatccttgtttccatagttgccttttagacctcagctaaaagttagtttttcaggaatttctgatatcaaaatcaaggtgagaggcgccacctgtgtgccatgtgtgtcttccccaccatccctgcccctgttgtagcacacactgctgtattgttttgcctgcttatgtgtctgtaaccctcagccctgggactgcaagggaccacatttgccttgtttcctattttgtcctaagtatccagcacagtgcctggctcatacaaagatctcagaaaatcttttcttaatgaatgaatgggtttcgtgattgatccattgttaagatgtgagccactacaagtgtggctgtgaaatgaagctgaagacatcactgtggatcattagaggaagcacctagaactcagccattggggaaaaagagatgaaagtcagtccttgaagaaagcagatcaatgacccttgttatttgttcttatatttaatttttaaaaatcgaggtataatttacatatatcattcacccactcgatgcatatgatccagtgacttttggtaaatttaccaaattgtgcaaccatgaccataatccagttttagaatcccagtaagattcctctgcacatttacagttaatcctctttcccactcccagccccaggcaaccactaatctactttctgtctctatggatttgccttttctgggcatttcatacaattggaataacacagtttatggtctttgtgtctggcttctttcacttagaaaaatgttttcaaggtcaatccatgctgtagcatgtatcagtatttcattccttttttattgtcaaataacattctattgaatgagtatattacattttacttctccattcatcagttggt

SEQ ID NO: 132269 - DNA, 1032 bp, Homo sapiens
tctttttttttttttgagacagagtctcgctctgtcacccaggctgcagtgcagtggcgcaatctcagcttactgcaagctccgcctttctcactgcaagctcacgccattctcctgcctcaacctcttgagtagctcggactacaggcacccgccaccacgcccggctaatttttttgtatttttagtagaggcggggtttcaccatgttagccaggatggtctcgatttcctgacctcatgatctgcccacctcggcctcccaaagtgctgggattacaggtgtgagccaccgtgcctggcctcaacccacattttcttcttgcatgaaattaatttagaactaaggaataaaaactaccctggcatctatttaaatggaagaaaaagtcaaagttttttttttaaacaatcttctctgagtatatgtagtcaatttatgtggacctaattttctcaaacattaggaaggccgcaactggaccatcagcccaagcatcatggagtccagcatcaaaatgagagttatatttgaattaataatttcattagaatcagcttttttagttttaaattcttaaatgtctttccctatattgcttgaaccatttttgaaaacgatattgaaaactactgagtgtgcctttcttttaaaggcaggcaaacaccaaccaagtattgtcatactgttgaagaagacaaacattgaaagctggaacatgactttgtagtaccacaatgttatgaggaaactttgaagtggttaaattatatggacgtgttttcagaatctacagctttcagtaggtattggaaatggaagctgatgatgggaacattcattgcatgggaattgaatcatagaaagatgattctgtggaatagacccaggcgatagcattatagtgaagctccagggttttttgatggacatttggaaaatgaaagcagagcattgggaaattcaggaatcttttcttagtagagttgtaataagaccaaacagatttttttccttcaccataaatgata

SEQ ID NO: 132270 - DNA, 1041 bp, Homo sapiens
caaacacttgcctgcaaaattagtgatctgtgcacgcacttgacattagataatgacactgtgacttgaaacatttggcaaactccagtaccatggggttaagcaaagtcttggctgggtctatttatgtttattgtaggtggtgagtgttaagtgattcacaaaagaaagggtcaggtaaacacagggggatagggtaggccgattctaagcatctcattcttgcctgtccattttctaggtcctaagatgaatcagcatatggccttctggaagaactgagttatgagaaatctgatgcagagagaatttgttaaataagcaggtagtgggaggaactttggtagagagaatagtattttgtttggggttgcaataggagaagagaaagaggaaggtgtactttgctaccgtgtttagtgaagaagctgtggtacataatggcctatagctgtacagcacttagagcttacaaagtgatggaacactcatcatctcactgaccctggtggagaagagggagggaggaagggagtccagaggtgttactggcagcatgaatggtcaaaaccagataaatctggatgctcccttgaggtctgtggctaaacttcaactcaagagccaaagtagcttctccttccctttctggttctgtgcacaggcagctgatcgggtcccagcatgctttgcagagctgtacataggatggagcccagactcttaaataagtggcatgaagtcttcctggatttgccatacagatggatcccaaaataactattttgcatagaagatggagatatggtggcctgaaaggcaagatttttaggttcttgtctcaaactggggacaagttgtggcctctttctttcattggaggcacacggtgcttttctccaccatttctgctcctttgtaatgtgtttccatatgttatctttgcccctttctcttctggtataaccccctggtaaccaaaggcaagtattagattttccattccatacactggtagttctttattcagacattctttga

SEQ ID NO: 132271 - DNA, 1105 bp, Homo sapiens
tagcagaccacattaaagcatttatgttcctcgttaggttgcaggaatgagttttcttaatgccatcactgaattccaatggaggaaataaattactcatgcattttctaatggttaaaaaattttccagtgtcttggctgtctagttctcatcatgcagaggttccattaccaaagagtaattgtataattttgactagcaggtctatactacttagaaaatcaactaaataaaacatttgagtcacaggtcctaggccaaaattttaaagagcgaagtatatgagagtcaaccttttgcagttgtaggggaaaatgcaagacttagaagaaaaaaactggtctcatcttattaacttaccaactttgtatatataggcaagctccttaacgtctctgaggctcattttccttatctgtagaaatgaagacagccgtaataatgcctgcttaactatctcgtgtgattattgtgcaagtcaaatgagattgcaaatgtgaaggcttaccagaaaaatagtaggaagatctatataaatagtatattattatagtttaaaaatattgtagtaatgataacgatactcatagtgataatcgtgatctaaatcttggcatagaattatgtataccagaacattacattggttggtatattgacagtgtttgaaaagtgcaagtcactaaaagaatgattttgctgttcaacattgatgtcagtaaatgaaaatagcttgaaatacttcctttgttccaaaaacagttaaaagcagctttcaaagatagaaataaaaaaaaaaaaacagaaaaagatgaaaaacaggtaagtgggggaataggagaagggaaagtgggatgtaacaaagggtgaagttaggactcaaaatgcgtctcgtaagccctgttccatttgctagaggtgtgccagagatttggttctggattttcctgtagccaatgcggtgagaaaacaatcagctgtgtagaatcttagtgtccataaggttaaatagtgaagcacagaactcttcctaatgatgagacacaagatagtgattttcccagggagtcctcataaagaggacagtgtatgatgaacgacatc

SEQ ID NO: 132272 - DNA, 1027 bp, Homo sapiens
aagtaacttgcctaaggtcacacagataaggagtagccagctaaggagacttggcttttctcttgagaccttgctatctccaaactttgaagcaatgctatagagttctacttcagaaggaagcaggaagccatatcattttcttatctttacctctgcttagctccaccttaccattccctcccccttaggcatagtcgggttgtttctgtgaggcggagtttgagccaaagcatagcacaccctaactttctcttgggaggagctcgtctttctgtttgagtttcagatgttgtctctgttggtagtttcttcatttattcaacatatatttattataatgacaacatgcgaaatactgagtatgaagttgttaaaaagatgtatatggacctatctttacggagttttatagtttagttgggaagaatgcaggctatatctaaataagaacaaaataattaaccaagcaagaggtcagtttacttctgttccttcttattgtcaagatattggaaagcagaattaatttgagtatccaatacgttatctgttgagaagagtcacttttgtgaatgtgactgtctcagaggcaggaattagtaatttaaaccagcgtatgtttgaagttgattaaaggaaaatattcagattcctgaataacgatttaaatgtgctggaacattacctattacccacatattacatggcaatattttaaaaatctggccagtgttaaaatgataacgtttcaggtaggtggcgctaataagtgttcttgcactcatagaatgttgagttagaaaatgttgtgggttgctttgaccttctccttcctcatttcccctgaagaaattaaaactcagaaaaattgcatatgcagtcttccccttacttctcaaattcatgactcgtaggatgaatagactctggtttattcaaggtctcaagagttcaagttgtcaacatttcaccctctcatacattagcaatgtcaatgacttggaaattaatatggtttgaactt

SEQ ID NO: 132273 - DNA, 1096 bp, Homo sapiens
tcttttttttttttttttttttgccaccttagacttctctttatgaatttctactttacccttttgtctttcaaaaaatttgctttatttgtattccctgacaacaaggccctgatcacttgataactgtgtgattctcctggccccttcccttttgttcttataagtatggggagaaattctcctggtttgaggatgagaaatggatacagtggggctcatcaaagttttctaagttagacatgtactgatcccaacaaattatgtgatcccaaacaatttcaacacaaagtacattccgatgccaccatttctttgcctgtgtccctcgggtccctggacagaacttggaaatgggaagtgaagaacatttcattctatgacccttagcagcattgttttttaattgaatcagaattgcttctcccttgcttttccttcctcaagggagttcagagctccttggcttcacctgactttatgcagtggtttcatcccatgataatatgttgggtttctgtcttaatagaacctttggtcttacagaagtcccggataggtctgctgtatatctttatcccaagactttatacattccagagttcctgaaagctcttgcagttactggcttttccaggattcaagtcactcttgcagtcaataggagatactcacatggaattactacagcacacagagaattttgagtattctttggcccagagaatactgatcggccccatattttgcctttgtgctaggatggagctccatatcagagagatcaatacaatctgaaagtcactgcctcttccataagtcctgctttaaaaccttcggtagcttttcttaattttcctttcaaggctatcattgtgtgggcgtaacttacttacttttttttttttttttttggtaacataacgtgacccagaaccatctttaggagtgtggcaaattctgtcctgtctttctaggacggggtaaaataacctgcctcaggatggaacacccaaccgagggaggaagagaaaactaggggtgcttgcttaggttgccagttgctgcagcaagacctgaggctccagtgcctcct

SEQ ID NO: 132274 - DNA, 1394 bp, Homo sapiens
aataaataccggaggaaataatagaagatatgaaagaccagcaaaacttgtgagatttacctactttgctagtcagttgaaattctgtgttcaggccaaccttgcatcaatacagggcactttattattattattgtttttaattgacacatagtaactacatatttatgggatatagtggtatttatatacctgtatataatgtgtaatgatcaaatcaggataattagcgtatccatcacctcaaacattgaaaattatatcagttttcaaaacaatcctttctccgtgccattggagtctaagggagttgcttgtttgtttccattgttctttactcactcatttaagaaaaacgtatttagcatccactgcacatccttacatttatatagctcttcgcatttttcaaattgcctttctaatattgtctacgttgtttcctgtacatacaccatgaagtaagtaggtctagtgttatggttcctgttttataacatgtagaacctgaaaattgcttataattgaaatttggcaaagtgatgagttcgcacccgaatttgggtcttccgattcctaggcaactgtgacttttaccttttgtaaaacacttgatcccgtgtggaatgctgagggctgtggaccacaacagtctcttctctgaaagacataataataatcattgtgggtttgaggccacatacctacaaaaacaatagaatccctctaaaccaacatgatctggactgattgttgctcagatcattaagaaaacatggttcaagtgggacgtcataaatctgtgatacatacatacctagacacgttacagcaacttagagcatctagatgtgtatttatttaccagtcttttgatgtagaaccaagatcttttatttgattaaggatcttcttggggtctacatcaatcattttttcttggataactcttctataatttaaaagtattctttaacgtagaatgagaacttaaaaatatttgtaaaccactcttgagtgtagaatcattttagatttaaaaattccttgtggtcaggcatggtggcttacacctgtaatctcagcattttgggaggctgaggcgggtggatcacctaaggccaggagttcgagaccagcctggccagcatggttgaaaccctatctctactaaaaatacaaaaattagctgggtgtggtggcggacacctctaatcccagctactcaggaggttgaggcaggagaatcacttgaacccaggaggtagaggttgcagtgagccaagattgcaccattgcattccagcctgggtggcaagagcaaaactccgtctcaaaaaaaagaaaaaaaattccttgagatctttaacagatatctacctcacatctgattc

SEQ ID NO: 132275 - DNA, 1158 bp, Homo sapiens
ttaagaaccttaatcagacacctggtcagctgaagggtatggggatttggcctgaagtgtgtagatcagaggtcactatcgttccttctatagaaccacctaattctctttcctttctccctctgtgtttccatctcccttgcttaaatttccccacttcttggaagtctagggcttacacaaagacaaagtctgctggtgaaaataactcagcagttaagagcataagtaggtcctttaaatcctgaaaacacattttctccgttttacaccttagttcacatggcaaagaaggagatttacttttttttacaaaatggcatctaattccagaaaggctcaaaagccagcaattgggatacattttcttagctcacatgtcacagtgacaagagggtgctgcccaccccaccccatctgtgaatagagcaagtttgaacaggtcctgcctccttcgctaggttaagcattatcttgtgttatttgggttactcttgcataacaccattgcaagcaaaaactgaaagcacacccatttaactttggtctcagtttgccctgaggacgaagggataggattatggggtgggcggtggggggagttagtgagttgtcaacagcttggtaaataaaataagaatatagtcaacttaaactcctcccatcttagttcccccacccctaacttccttgtattttcttccctatgaaatgaggagtttgaattagatgagcactctccagtgtttttcatggggaggatctgttttcaatcccccatatgtaaaggggaaggtggaagggatctgactgctagtagtggactgggggctcttggttctgcaatcaattaactcctcttagaaaatataaataaataaataaataaataaataaatgaaatgagcaactggagaccctgacctttggatctcatgaaatctgaagtttctccatattaccagtttctaggtttctgagtcttgcagaatactaaaaatgttcatcttgcaacaaagagataagatccaagtggtgaggtcttcattaattagagaagtatctggaatgtttggggaggagttatgcagggaggcagcagcaggcaggagatggcaaacccacaagggtccattggcgtttctggagtaaaatggt

SEQ ID NO: 132276 - DNA, 1781 bp, Homo sapiens
tgtaaaccagaaaggatactcctgattggttgcactggaaacattctagccttgcctttttccaaactattctctgaaggcaccctggggtgccacagtgaattcatggagaggctgtgggatttttttttttttttttttttttgaggcaaacactgaaacaatcaacatctgtcagctaccatgtgaactacgggcttaaggtagttcatagttttaacactagatcactacattcctttcggtgaagtcatatctgtgaaaagctgggctttcaggggatgctgtgataaatagccagtgtggtataaaaatcaatgtgaagcaggaaatggggtggcagaatcccatctaattccaaagttagaaaagctgcatagtgcccagcagcacataggtctcattgaaaattttggctatataagaatgaaataaaaataccaccttctcatcaatttatatctttttcttttcaaatagttactaagttgttaggacgtaaatatttattgagttgtttggatctacctatttaactcatggaactgttaggtattcctctctgcctagaagtataatgaaaaaaatacctgagacgccagagtgacatggactgagaacatttgagaacctccgatttagcctcttgggcccccatcccgctgccctctccagcttgcttgtttgctgccctgcatccttcccaaatccatgccactcagcactctgtcaagtgtttctgtgagccactgagtgaatttgcaaaaatagcgggtgtcagtgagcagtgcagtttctctcaaatgaggatttttaccttatatcttgttgggggcctcaagaaatggctagtgacacctcccatccaggaggtagccggagagttttccgtctccttttcctttttctcccccttgcactgcactatggctcccagatccgagagcactcttcagtcacatagttcagacacatggttaaggagactgtttggactagaccgggtctctttctagccattcattgctgttttattttcctctccatgaaaatatgttctaagcactagacaaccaccttacacaggaacttttagaacacagccctttgtatcatggggaccccctgcatctgctggagagccctctttggagacagtattacagggtacactagttgcgatgtgctataattggctcttaaaaactcaaagaagtccatatctgttcatagcaagagtatgtttttttgagattcaagataagagagtgaaaaggacctattttcatgggtttgtgaggcagtgccgcttgctttaaagactctctgaaatgggaattgcgtttagtgaaattgcgggtttatggccattgacaaagatgaaaggcagagaagtgagtgagttacgtaatgtggctccatccattcgctcaggggcattctaagggctgcctttctttgctgagtagagtaaccctcttgagttctctctctgggccattgtcacttcatttttgttactggccttctcagttttagccttcagaattactctgagcagtaagaaaaaggcctggttttattctaccatagagatattcttccctacctctgtttcttcctaatctccatgtttccattcatactttcaccatcccttctgttctctttttatcttaatctgtaccctcccctgtctccctttcttccctcctcttccatccctatttctcttctctttgcttccattatggcagagtatcaagtcccacgtctcactc

SEQ ID NO: 132277 - DNA, 1106 bp, Homo sapiens
taaggttggtgtctcttgtaaagacctggtttaagaaagataatgtattgtgagaacctgggaagtcaaaaacttaatgtactttaaataatacatcaagtttcatgtttattttttactgtttgtgtttggctatttcaattggttttaatctagagcttaggttagagcttgcttggtcagttggttagctagctgtgtgtttttctccactgccacatcatagattttaaaatacactgatttaaaatgttactttcctatacttaggaaaagtatttcctttacttaggtttatctctgggaaaacaacagacaatgaaaaaagtctgctaacaccagtgtgtgtaccgtgttgaatgcagccatgttagaactgggataatagtggagattggggtcccgcaattttgaagagatgcagttaatatattacctaaagaaggttggggcaaaatccgtggttatttttttttcacttctgctttttaatcatttatattttcttgcacttccaatgtggcttcctgcagaattagagcaaatgaagttaatattccataaaagtttccaaaaataaccaaacagccagagaccaaagacattattccagttgaggtagccagagttttcattttgtcttgccaacaagtcaggtgaaacacaatgtttacttttgtttactctctgagctacacagggtccagtttgtatgatttattgatgctttgtataaatcaaattgatgatgcatttccaagtattactcaatcggaggcgtgatttgttccaattataaaagggggtttcagtcttataacattacatctttaaaagaatctattccattagtacccttccccacttcaaatgctacaggacatgaagcagaaatggaactttcattagtcacctatagcattttctttcttctcttccctcccctcccctcccctccccttccgtccccttctcttcccttcccttcccttccctcccctccccttccctcccgtccccttccctcccctcccgtccccttccctcccctccccttccctcccctcccgtccccttccctcccctccccttccctcccctcccct

SEQ ID NO: 132278 - DNA, 1040 bp, Homo sapiens
ctttgatggaaggctcatgagaagtatacatttgatattatttatattatttaaaaattgagttctgctcagttgaaaactcaaataacagtggctttaatatcatagattgtggttcccaaacagtgtgttaaaggtcactggagtgccacagtgaactttgggagtcacagggtattttaaatttagaaggaaacagggatatgtgatatcctttggacaccaggcaaactactagcttgaggaggttgacagttttaacagtaagttgcactatgttccttttggtgacatcatatctttgagaagctccattttcagtaattgtgatttagaagcagcaagtacttttgacacccatgtccacagcagcattatttatgatagccaaaaggaagaaacaacccaatgtggtatatacatacaatggcatattatttagcctgaaaaagaaaggaagttctgacacatgccacaacatggatgatctttgaggaaattatgctaaatgaaatgcaccagtcacaaaaggacacgtattgtatgattccttttgtatgaagttcctggaatggtcaaattcatatagtcagaaagagtggtggttgctgggagttggggagaagggggcatgaggagttagtgtttgatgggtacagagcttcagttggtgaggatggaaaagttttggagatgggtaatggtgatggttgcacaataatgtgaatgtacttaatgccaccgaactgtatacttacaaatgattaagacgatcgcttttatgctgtatatattttaccacaattttaaaagagcaaatactaagtgaaaatcaacgtggaacgggtgatggtgtccaatcttactccaaaatttgagaaacactagagtgcacaatttaacacacatcccattagtatttgtggttgtttaagaatgaaataaaaatactatttttcttttaatttatttgtattattttttcaaacgactaataagctgttagtacatacatgttattgagttgtttacacctaact

SEQ ID NO: 132279 - DNA, 1048 bp, Homo sapiens
ctcgggaggctgaggtgggaggatcgactgagcctggaaggttgaggctgcagtgagccgagatggtaccactgtactctaggctgggtgacagagtgagaccctgtctcaataaaaataataaaatatgtaaaatatctctgcaggtagaaaaaggtggtgtgtgaatgcaaaagagttatactggattgactaagatgattttttttctcacagtattctttgatattttgtcataataagtgtaattgatagcgaagaaatgacaacaaagctttcatgtatagaatactttttacagatttactgaataatgtgtactttctgttcactgtcttttaaaatataatttcagtctagattttacagactcatgggaaatgatctaaactatttttcttgccattaaaatgtgcatttgggagtatttttccatagacatagatacaggagaactcaataatgttcctcttccttctttccaactcttgttttccttaggcattaccacaggagtcttggttcgagaacacagcaacctctcaactctagagaaattctactttgcttttcctggagaaattctaatgcggatgctgaaactcatcattttgccattaattatatccagcatgattacaggtaccttgagaaaacagatgttctctatattagtccattttcatactgctgtaaagaacttcctgagactaggtaatttataaaggaaagaggtttaattgactcacagttcatcctggctcagaaggtctcaggaaactcacaatcatggcggaaggcaaaggggaagcaagacaacctccttcacaaggtggcaggaaggagaaaggctgggcgaagcaggaagagcccgttataaaaccataagatctcgtgagaactcactcactatcacgagaacagcatgggagaaactgccactatgattcaattacctccacctggtctctcccttgacacctggggattatggggattacaattcaagatgagatttgggtgggaacacaaagcctaaccatgtcat

SEQ ID NO: 132280 - DNA, 1128 bp, Homo sapiens
tgtatataaacattattttttccagttaagcctaagcttcctgacagaaaaggcagaaaggaaaactatcatgagttacatgattctcaagtgttaaaaaaaaaaaaaatctcaggcaggacatgatgactcacacctgtaatcccagcactttgggaggccaaggttgtggatcacctgaggtcaggagttcgagacaagcctggccaacatggtggaacctcatctctactaacaatacaaaaattagctgggtgtggtggtgtgcacctgtaatcccagctactcgggaagctgaggaaggagaatcgcttgaacccaggagatggaggttgtaatgagccgagatcacaccattgcactccagcctgggtgacagagtaagactctgtctcaaaacaaacaaacaaacaaacaacaacaacaacaaacgatctcagttctttgagataaatttttcctagataactgaattccaaaggaggtttatcacaagggatgttgaatgatataatacaaatcttggtaaagttcttagtgcaaatgtgggacagggactccttatgattatttcctgaccaactccaggaagatctgaaggcaggacactcctggaggtgaaggctgtgggaagctgcctgcaggggaacttgcacctgactgggcttccctctcttaaatctgtttggaattttgaagtgttgcttttgcccattgcatgttattgcccattgtctgtagatgagaacgcctctcagctctttatttcacaacctgaggattaaatcgcgggtcctggaaacctgtcttttaaaattaatgtaatttgatttctgtctccccttcaggtgttgctgcactggattccaacgtatccggaaaaattggtctgcgcgctgtcgtgtattatttctgtaccactctcattgctgttattctaggtaatacttatttctgaatccttactactttatgtaatggtgattttttcattcgaaaagtagttggtggccagatgcggtggctcaggcctgtaatctcagaaatctgggaggctgatgtgggcagatcccttgaggtcaggggtttgagaccagcctggccaacatgaaaacccgtttctaccaa

SEQ ID NO: 132281 - DNA, 1031 bp, Homo sapiens
aaagtgttcacactggtaagtattctgtacttcctgcattattaattcctgtgtttttttaagcagactccaaatgtagctagcagttaaaatgaccctgaaaagtgccttcaatctaaaattcataataaaaatataaaccattccagaataagaaatctttataagaaatattcaaatatggacttgttgaaagaagagaaagcattttaacttcggggagcaagggtaaagtttgttacatgcataggtgtttttattattgtttttatattttctatagttttgttgactctgcctgggagatcaccagtttattatgtttggtcattgtatcttctcatttctggacctgtgctttctaacaagattataatcgtgcatcaatatgttttcttggttttgatccacagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtggtgagcagacactgtttaatgtcattttgcttcccctgacaattctgtctcctcaaaattagaaagaagaggttttatgtttgtcaactgatgaagctagagaagttggacatttaatattgaaccaccagagtattttgtgggggcttttgttgctgttctttgtttttgttttagaggcagagtctcactctgtcaccccagggtggagtgcagtggtgcaatctcggctcactgcagcctcaacttcctgtgctcaagcgatcctcccgtctcagctacctgagtagctgggactataggcatgtaccaccatgcccagctatttttttgtattttttgtagagacagggttttgccatgttgcccaggctgatctcaaactcctaggctcaagcaatctacccacttcatcctcccaaaatgctggaat

SEQ ID NO: 132282 - DNA, 1072 bp, Homo sapiens
ctcccacaaggtgttcatcttcaaattcaaatctaaaccagccaaaggctctgtggcccacataaagctggtctgaagctgggtcttgcccaaagccaccagttttgactcctgtttagtagtataaaataatggtattgatttacagtgaggtttgtggaactcaatttcattactttataatcgtctcatattgattaacttaataatataaggcagtatctgattatgtaccaagatactgttgcttctgtatgtttcaggaggttagaaacagtggggtattggtgttggaggcccagaacttattttcagcatttaaaaaataggcagaccaggtagagaagagatttgggagagtgaggcaactggggagagtataatgaagcatatgtatatagagaagaggaaatgtcctttggggtatcttctgaagtgtcctaaatattcaggcgagtattttcaacttgtgctgtagacaataagaagccgttagagttttggagccagaaagcaaagtattaatctgatgatcttgtgcaggatggtttgggagtaggtagaggctggcggtggggagactctgacaaagcctttgaagaagtctgaaaattagggcaatagaacctcaactgagtaggagagtcacaggaaagagaagggctgattagacatcagggctgggaagacatcatgagacaacttattttaggggtgcttaaaaacctgtgggtgtatgggggaggtacctggcccttttaaggaagaagtggttaagtccggtggcctgggcttgttacaaagtgaaggtgaactacttagtcagcagaatgaggtattgatggagagaataattgccctgcagaaataaggacacagtgtccttcattttgtggattcatattcttcatgatgtgtgaggcaagatgaactcaacgactaagagaacaaaataggagctcaaatgaaatcctttagggacttttctttttgtggtctctttttggccagggagatagaatagggaacacttagaattactaggggtcaaggtgggtgttgagaagaatgg

SEQ ID NO: 132283 - DNA, 1843 bp, Homo sapiens
tcccggcggccaggacccgccgttttcggtatagggaacaccagataacaatatataacgctacctaacaaacgtttctccacccacagcgccattagcggttaggtttgcagtgccgaagagctgcaagaaaacggggcttgaaacaggaatacaattgcagatccacccactacacgcaaagggcccgggacgcgcctccacagccccgccccaaccggaagtgacgcaccgcgccgactatttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccaggtgagaaggggcctgcgttctgcggagggatggagtggtgctgtcgccaaacccctggaatgccgcgtctcccagaccctcttctacgcctttttctacgcccacctcactgccaggggccggggacctgggacctgacgcctgatgccatcccaccccttttatggcatcttcggagggcagacggggtggccatatattaccaacctccacctccacgcacatgttttctttcgccttggctgattcctgttcactcttggaataccttcctccatctccccttcctgacagcactcagatttggggcggctcatgctgtaacattgaccctttgtcctcttgtgagaggttttccccaagcactttattctgttaaaggctctagcatacttgtgcacagttgctaggaacagtgaatgattgtagttcagcatcacactgagtcctgacaaagatttcacatgcgattttcaccgatgttgacaactgagtaaattctttaaatctcgcttttgacgctggcgtacacctctcccattcgcgtgaccatctttgccttactgttttgttttttagttttgcttcacgtcattctccagtgaaaatatatacgcatatacttgtgttttccttcagacttctcttaggttcctggtattgtgttttcaatccagcattcctgccttcctgcgactgaaacgtatccaaatgtgatatactattaaggatttttcagggacctatcttaggggatacttacatactcgcatcaccttgtcctgtttttttctccgaatccgtgtgtgttttggaagtatatttcagaatcacagactaaacactaatatattcaatggatcataagtgtctgccgccttcttgcaaaatggggttcccaagagtgtaacagatttaatagtagttttcctctcaacttattttgctagatgttaatgagaatgagttaaattgcttaccagtaagcgtgacattatcaatcttatgtccagctaacagggttagttggcttcacacagagaaaaatgctgtttcataaccactgtctgtactttggccagctaagtcactggggaactacaagacattttttaggaggacagaatgagagttgatgggtccatcattagtcacccactaattttggatcactagtgtcatctttatatacaaaatgtattataagcacatgatgtgctagggaggaaagaagaatgaacagcagatgccattgtcaattttgaa

SEQ ID NO: 132284 - DNA, 1079 bp, Homo sapiens
ttaagcatagctagtctacagttattcttgatcctattctaagataactattcttgatcctattctaagataacaaaaagtaaaaataaatattttattttaaaatattatattttatattaaaatattttatattaaaatataatatatatattaaatatatattatatttatatataaaatatattttaaaatatattttaaaatatactttatatattttatatatatattttatttttatatataaaatatattttatatatattttataatatatgaatatatattataaaatatacttagggacatggtttatagtaccttggctccaaacctgctgaatgagtaaataaaacatctgaatagcaagtgtccacatttgtcccagtacaaacgtgagtttgcctgaagactcagctaagaggtagggtccttggttactacttgcctcagaattgtttaccaccaccagtcagtaaacaaataagcatgatattgtatgacaaacaccacaacagaaatatgcataacttgggtcgggagacactgggtcagaaaaagtttagggcatgccagaatctggatgaagataggagtttctgtaggagttacctcgaagaaagaggattgccaaattgaagtgagggacaagggtgggaaagggaagaataagcaaacaagtagaagagcaatgggaactgagtctaaagaggtaatgggaaataacatcacgaagggctttgccacagagtatgtactttatcccaaagctaagaatgaaaaaaaagatcagattcattttttggaaagatcactccagtctagtggagtggagaacggcttgggataagagtctgcatttgtataattcacatgtgaaattataagggcttgaatagtgatgcagatatgggaacagattggagagaaattattctgaagttgatgtacatttgacgaagaactcataaagaatgtgccttcagcttttgttttatagagccaaggaatatagggtattgaatgtctatcacagtactttacatgtagtaattaagtaaataaaagtaattact

SEQ ID NO: 132285 - DNA, 1212 bp, Homo sapiens
aaacgattacttctagataaaaggaggtttttttgtagtgaagaatttggagaacaaaattataaaggcctggttgtcagcatgttgagtattgaggtgatgaactagatttaagctttgttctcattattctgcttgttcaggattatgaagactattaattaaacgtttgttaagcactagctttatgcaagacactgtgatagttgccaggctttttgttgctgttagttgtcaggggataggcctaaattaacaaagaagtttagaagttagttgatgaaacaaggactaagatataaaaacatgactgcagacctagaacacaggatatactatataccaaaatattgtacagaaatcctttgaattaagaaaaattgaactgtgctgcacaaacatccattgctttcttcatttcttacaaatattgtttttatccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataaggtatgagcttttactgggccataatgaaagaagaaaaactgaagtgtttgtacaaaccagttgtgcgtatttggtagcaaagcagcagaatcccataaacagtgttcaattttgacagtttatgaaaggtgcttgaaaagtttatgaaagtcaaaaagtctcaaagctcttgctgtagagctgcagactccaggcagttaagtgaccagactgaaatacatatttatataaatgtactgctgaacaaatattacatatattaaaaaacattcacaagaatttgatataaggatgggaaaatatatcagttatgaaatattttcctccacatatattttgtaccccctacactgattatcactactttagagttcctttaatgcaactaccttctttttataaatgaagaaactaagtggaaaaataagtagagtgacttgataacttagtggtgggttaaatgtgagaaattcctgactctgggat

SEQ ID NO: 132286 - DNA, 1014 bp, Homo sapiens
tgcccagctattttttgtatttttagtagagacggggtttcactatgttggccaggctggtcttgaactcctgacctcgtgatccacccgcctcggcctcccaaagtgctgggattacaggcgtgagccaccacacccggcctcatacatcattttaaacaaaattaataagactcccatacaagaaaattttaatttttaaaaatagtttaccagatgaatttaatcatgtaatatcagtatgatactataccacatatattgtctataggaagaattgctagatattcagtatctgagaaagaagattcaattagaatttaaaatctgatttaaatttctaaaattttttcttagagttttattaatcaagataaaagaaaagacacagaagatgaagataaatcagaatcatttatgcaaaaatatgagcaaaaaatcagacattttggtaagtctactacttggatttccttctttgtaatgtttggtatcatatgtacatgtgcaaaaaatggatttataaaaagagagccaaaaagaaaagtggcaaactccaattttgtagcttctggcacagctgtatagatcttgttttagaattttttttttttttggttataaataaaattaattgacagagcaaaccaaatggtaaagagaagcaaaagtattattatatagtgtactacctttaagacaactttatgtattccatagcctctttccatttcctaagtagtctttgcttttttctttttcctctttgcttccttggaatctgattatcttatgttttaaagattattcattttttttcaggttttggatatgatgctttataattcaggcagatccttgaactgttactcagataaatatagtaatagaaatgtatatataaagaactgaaaaataggttttttctattggggaaaaagggtaagaggggggttgatacaagtgaaggcttcccagaggagccagcatctgagcttgatttcaaggaacaga

SEQ ID NO: 132287 - DNA, 1643 bp, Homo sapiens
gagtctacactgtcgaatctatgcataatcacaaacctatgccaccacgacccctgaatttatgaaactattgtgcaaataatgagatagttgaggaaaaaaactgacttaacatccacaggtgattaataagcaatcattttgctgttacgtgttgtgaacttccaatatactatcttgtaataaatatcagagccttgctgttttcacacccagccagaccaatagccattcccagagtcacaatgtgcctgtttcttactgaaaatgcatgttgtctttaacttcaaaggagatatattacttgccacagcacactggatccccaggaatgttacaaaggtagtaggctctcaaaatgttcatgtgttttatttcccactctggaatagatatatcttaacaagagacctggaatacctgcaatttctgctttaccaagttccatcagtggagagtggaccaacttgtagtcatggggaatgatgagataataatccctgtggactgaattatggcacagagttgatagaggtgtgacacaagacagtgaaaatttgtggctatgcctgcttgatggaagatttctgttgtatgcttattgtgatgaaagaagaaagcttaccaaaatgatgactatattggtatactcctttattttgtttttttgttgttgtttaacttttgttttaaattcaggggtacatgtgcaggatgtgcaggtttgttacataggtaagcgtgtgtcttggggatttgttgtacagattattacatcacccaggtattaagcctagtattcattagttatttttcctgatcctcccaccctccgcccttcggtaaactccagtgtgtgttgttcccctttatgtgtgcatgtattctcatcatttagctcccgcttataggtgagaatatgcggtatttggttttctgttcctttgttagtttgcttaggataatggcttctggtatactcttctaaacacatctgcaataggagatgtaattaaagcttccagttggaggctttctggacttggattgcattctggactcttggttgacacgggcctggtgtgtgtgggggctgtatagggctataggggctttacacccatgtttctctgtggtcttatttgtacttatattcttcagagtttttcctaacttttcccttatacaatttgttgactgcctttcttgtgctgcttttacccttacaattaggtggaatttaccacctagtggtaaatggtacaatatatcatggactattataaagcattgaaatctgactttttcctctacatttgtatttagtttattaatttagttaattcacgttttataaatataaaatattaatttaaaaacaaaggcttttatctcttaaatttcacaaccgttatattcacagttatatgcatgtttgacatcactggctttatggtcatcagagctgctttttgagtcatctaattttcagagcacatcatcttcactttcagccaaagttagctgtgattcagctttttttaatctgtgtaggatgttgtcactggaaattttaccaagagctataaaagtttgctcaaatactatgatagaagttttttcgtttgttctgactatgaata

SEQ ID NO: 132288 - DNA, 1041 bp, Homo sapiens
tgttaattcgtctcaggtattaaataggtagttaaaaaatattaacatttggcagggagtggtggctcacacctgcaatcccagcactttgggaggccgaggcaggtggatcatgaggttaggagttcgagaccagcctgatcaacatggtgaaaccttgtctctactaaaaatacaaaaattaactgggcgtggtgacacacgcctgtaatcccagcttccaggaggctgaggcaggagaattacttgaacccaggaggtggaggttgcagtgagctgagatcgtgttgctgtactccagcctgggcaacagagtgagactccatctcaacaaaaagaaaaaaaaaattaacatttaatgatacccttccccatggccccaagtgtcaggaaccctttcatgttatccttcctgcaaaataaaccagaatggataaggcttttggtatttcagtaagtcacaatgctgccatgaagaagtaaacaagaggagcaatgctttatcgtggatggtagatagagttgaaaatattacctctccagaagtgtaagaaagctaaggcaaaactgcttcataggatttactttgtgggttcaagtataagaaataaggattgtgctttctttaaatctgagtcccaggaatcattaggcttttttaagagatatggtcttgctctgtcacccaggctgaagtgcagtggtgaggtcatagctcactgcagcctccaccatctgggctcaaggtgtgctctcacctcagcctcccaaatagtggggattacaccacgcctagcaatattcttatactttaagaagtagttttaagtaacttccataatcattctgtttctcagaacttcaaatgacctaatcattatgtccaaagcgttggggaaataactttataaagcttagaatactctatgagaaaatgctacagtctttatccttttttttaatccttttaagagatgaggtctcgctgtattgcccaagctggagcacagtggttccatcataccttctgcagcctctagc

SEQ ID NO: 132289 - DNA, 2429 bp, Homo sapiens
gacaaccattttcaaatatgcttaactaatttttaaaagactttgtttataacagacatcatgagtaaatggcttacataactaactctcaatttgcccaagactgcgggcattcatggatgtaggactttttaatattgaactggccactctggcctgattaattatctgaaataaaacttcctgtgaattttaggagctatttccagtctactgagtattgctttaaagagtactgtccctcacttgctcttttaccataatctgttgctctggtaatatgaattgtctttaaagagaatcatttaaaaataccattgagagattaatgaattaagaatggttggtatttcttcccttatgggaagaaagaaaatatttgacacttatggttcaattcttttttttacaggtatgttgagtcgatgggatgatagccagagatttttgtctgaccatccataccttgtatgtgaagaaactgctaaatatcttattttatggtgttttcacctggaagctgagaaggtattattatgtgaaccttgagtttctgggaaccttagtggaaatctgatttcatactttattgatgttttgttttgttttctacattaagtcctttaaaagaaagcaggaaggtcattagatggaattaccattttttgcttccagatctacttgagtttaatgtgggattttgttgttgttgttgtttcagttagcatacagaaacttttccactatgctttctctgccactccacctccatctctcttgttttcatattactataatccttttcaaactaatttgaaagtcgtattttaaaaatccagacggtaatcatggtattaaatcaagttcagagcatggtcttcctttagttattctggtccacatacaaataataaaaaaaaaactaagatatactctttatatgtttgtaaagtatttgacttataacttaagagagtaaaatcaaaagtattttaaaaattcaaaatttgaatcagtatgccaattaaatatatttatatatttgtttcttatatcatttaaatctttttcagaaaggggctttaatggaacaaatagcacatcaagctgttgtaatgcagtttattatggaaatggccaaaaactgtaatgtggatccaagagggtgttttcgtttatttttccagaaagccaaagtaagtagttatttgatattgataaatgggaagatttggtcccagctgagacctctttgttctgttcatatcaatagaaggcatccaagcaggatgccacaggctaaattctgtagattttcttgtgaaaagaaaatttatattgctaatttcttgctaatttaaacttaaaagagctatataagaggctgtactacagcatgtatatgaaattgagacccatttaaatgaatgtgtgtattcaggaaacttacgttccatcattaattcattcagtaaatactgagtgcctaatgcaaagcacagctgtttcagatgctcaggatgcattattgagcaaaatagatacaggattcttcatgtgtagaactcagcagtttaatgagaaatcagacttttataaagaaaaaataggaagcaacctaaaaattcagcaattaagggaatagttaaaaatacccatggtacatagaatatcatgcaccctttaaaattatatttatggaacttttgtaatgagctgaagaaatgcttacgctatgaattcacaggaagcagtacatactagatgatgttggctatgttgaagaaaaatagatgtctagaaagattaagtacctttcacactcacaagatttgcagtaatttaaaagctgcccaagaagtagggcaataagaatttgcgttcactgctagtggaagtataaattggaacaaccactttaaaaaatttcctagtaaagttgaacaagtgcctgccttaacacccagaaattctcctaggtgtatgcatcctagagagtagattctcaaggtggggtccaggaacccggaggggcttcaagaccttttcaggaggttctctgtcgaaactattttcataataataccaagatgttatttttaattttcattttcattcctcagtagtgtacaatagagattaatgcggaagtacaaatatgagaatctagccatcttctgtaaagtcagacattagatttagaaaaattaaaggaaaaagcagctctcttctcactaaatttttttgttttggaaaactttttttttaaataaaaatgttattaatggtagtgtaatgagtttgtcattgttatttttagttaatgttttaaaaattcctcagttttcatttctaacagtaaatactgacagatacaactcacataaacagaagctctttagggtcctcaataattttgaagactgtaa

SEQ ID NO: 132290 - DNA, 2945 bp, Homo sapiens
taatagtgccccctcattaattgttggagaattaaaaggttttaagaatatcccttgattgtttggtagtaggaagaagatagaatgaattggacagattaaatgactattttggatcctgttaaggatctagataagtcaaggaaaatacagagaaagccttcttttcttttagttgtgtgcatatgcatagggaggggttgttttttattagcttattttgctgaagcagaaggaaatggagcaaaccaattattaatgttcctataaatcaggtagttttcacaaatgtgacagggatcgtggtggtttctatatttagactattcaccttgtcattacttcctccacttcaaacctgttatatgctttctggaatttactatgtctagaaatcttgaagaacacagtctttgtttttttttttgttttttctaggcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacaggtaagttggaaaagtaaatatttgttttataagcctattaattcacataatttttgttattttgccccactcttttttttttttaatatgtgctactattttaaatattcctgcctcagaagataactgttgaatcttacttcatgccatgttttggtgctgaatctcacctcttaagtatttagagataccagatttcctctccttttaatgtagtagtgattagttatacctaaccattcttaagaacaaatcttagctattgatcatctcaatcataaactcttcaagatggctccctcaggagcttccttaaaacatctcatcctgagttaaaactatgccattttgaattttttaggatgattagcttcaaagtggacatgcacatggaaccagtgtgatctgttgcttaagtttatttagtattttcttgttaaatgttgggtctaccagatataacatttttagaacacattaatgtagctgataatattgtatctggtaatactggccaactgtttgagcctctttgaagtcttcagtggtttgatcaagataaaaccatgtcggctgggcgcagtggctcgcgcctgtaatcccagcactttggaaggccgagacaggcagatcacgaggtcaggagatcgagaccatcctggctaacaaggtgaaaccccgtctcttctaaaaaaaaaaaatacaaaaaaattagccgggcgtggtggcaggcacctgcagtcccagctactcgggaggctgaggcaggagaatggcgtgaacccgggaggcagagcttgcagtgagccgagatcgagccactgcactccagcctgggcgacagagcaagactccgtctcaaaaaaaaaaaaaaaaaaaaaaaaatcatgtcatataggcagcatgaaaaaatttacatcaaaaaggagacatgatcagaccactggtctgcctgatgctagttaggattacaagtttaagttattattagataattcctacccatttgattttactagtagcactttaatagagcccagtcatctctcatttccaggctccaagattttaagaccagctttagccagtttaatctgttgtctacattgtgagaaggaaagtcttattcaaaagacaatgtgaggagagtcctatatttagttttaaacctcataaagtgctaaaaattgggattttcagtggcttgaccttatctcactgtaatttcaccattccaattacatgtatgtcctttaaggaaagtgattgatcatatttaccccagtcaaaaatattattatcaggagtctctgagcctactctggctgaaaaaaaaaaaaaaaagtctcaaggatggaaataattaatgtttgatttttaaataattagtaatgttcccccttagttagacatgtaaagaatattccctctacaaattcctacagattatctcttaattttatttaaattcagtgatgatttttctcttcagttcctaagaaatagcccatagggaagtagtttttccaggggaattctgtgaccaagtcactgtgaaatccaatatataaacctcctgcaattaaaatgtcacataatgcatgggaaggagaaaagagactttggaaggatgtaactgattctaaatataagagggaaagatacacattatagtatcttaagcctatattatcaagaagttgcctctggtttgagagaagtaagtccttgttgttattagatagcaactatatattagatagcaactgatatcaggtgctaggcatcccttatagtcatggggggactagaattatacaattctgacacttctgtattgctgatattatcagggttattcagatttaattaagctgggctaatctcctcatggtgggagaccaattccttatggtaagtaatttgagcatcctgatgtggtccttctgaaggatacaagggctggagaaaatttcagttagatgcttgctacatgtgcggaaaggattatcgactagttgagggaagtaaaatgagaggccacctgaaagaccaaatcatcagtttagaggtttggaagaaaaatcttaccataataataacatcccatttttatatcagtttatatgttgtaaagcactttcacacatattatttaattttctcaaacaccctgtgattcattttcattcatttttatagatgagtaaactgaaattcatagaacttaagaaatttgcctgaggtcaacacaataagtgatgaatctaatattctacttttggatttctattatgcttcactgcttattcacctataccacagactgtgaatcatatgtg

SEQ ID NO: 132291 - DNA, 1648 bp, Homo sapiens
ccttattcatggtgctttaataatggttttatttttgcatttattgagtaagattttatgttttctattcccagtttttgaaattgacaagcataacatttatgagtttatgcttgtttaacaaatcctgttgttttattctcagtttaaaaaataagggtgtaaatacatctcaaaagtgtacagatttctcactgagtttgttttaacctttgggaaaccacaatagaccctgaagatatccataatttttacccagtaaattttttctttatttagatgatttgcagttttagtatttactgttgtaattagatggtaatcttaaaaatgcattgctaacttcaaaccatatttaaattatcagtagctatgtatatataatcacatggaggttgtagccttgccttgtatgattaaacagagaagaaaggtggtatttgttaacatttctgttttttacatgtatcattcttttatcacatctcataggtgatagcatcctatttttttctttattttcttgggattcagcccaagtctgtctccaaagtccatcttctttcctactgctctactacactgcagagaaataggacggtgaaactgaatatatatgtatgtactgtcataaaactggttataatgcgttctttttctccccccaatctaccttttctttttccccagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactctttcttaacatagtctgggatctctcagggagtaagttttaaaagaatactaatggcttgtaagaacaaacaggaataataatctgatttttaaatttgtagttattt

SEQ ID NO: 132292 - DNA, 1035 bp, Homo sapiens
tgatataaatatatactctataataaaatgtttgactaatttatatagtagtgtttgtcagcctgtactttttttttttttaaacccatgacctagtcgtagacatttttttctttttgttctgttctgaagcaagctcttatttttccctttctaccaaattgagagaatgggcagacacaggagccatattcctagtttcacagaaatgttacttgaattattattttcccttctttcccaggatttgcctgtaagcattcaaattgttttgaatttcattttgccttctctaagttagaggtatttaatgactgaagactggcaggagagaaagtatcaacaaactgagtaaactattcttgaggggcactgaaaagatgttctttgaaacttgatttatatatttttacttgcaaaagaatatactgtgttttgagtatgaaagtgtgattgggtctgttgtgggaaccactgactgatgccataatttgcacttaaaggctataaattacatagttagccgtactttagtactagaaacagtaaattgacatccttgaactaattcctaccttttttttgtttctgaagaaataaagagtatattaagcaaagggataatttatatttcaggttggacaatttaccctaaacaaattaaaccatggaaagtgcaaacacatgaatgaaacatttttttacatcaaagtatcatcaaagattcttgtttcatttgataaaattaatatttgaataaaaaaatttttaaatcaaatagctgtccatttattctctgttaactcagtgtcattttttcagtggtagtgaagataatactgccttaaaattattactcttaggtagatgggtaacattctcttccaattataccattagtgagctctttcaaattttgcctaatgagctcacaatctcttataacttctctttaggaaaatcaggtcctcctcttctttcagactggcatatcatattattacccttttaaaaatgaatgaacagccgggcgca

SEQ ID NO: 132293 - DNA, 1085 bp, Homo sapiens
caggttcaagcgattcttatgcctcagcctccccagtagctaggactacaggcacgtgccaccatgtcctgctaatttttgtatttttagtagagacggggtttcgccatgttggccaggctggtcttgaactcctgacctcaagtgatccaccctccttggcctcccaaagtgctgggattacagacttgagccaccacacccggccgaattcagtcttttcattctcagctcccacacgtagaactcagcgagacttgactaaaaactgaaagtttatttgcaagaatgttagtaatagtcagcattgttatttagaaatgctgacagttgtattgttggttgttttaaaaaaaaccttttagctgtgggacattatagagtaactggtctatgtttacaaacaacatgatgcccttactctttggaggaccaattgttgaagctggttccattttattacacagaaattaaaatgacaaatgttcacccacgatttaggatcgaataggtgcctgcaattgtgccctcagtaattaacccacttgtgacactggcttgatttttaaatcggctcttcaagaggcttacaacagttaagaagcttgttcccttgaaagcagtaccaggtgccagtgaatttagaagcaggagggtttctaatatcccaagaatgctgtatttgcataatttccttccttagcagatgtttcttaccgagaaaacagtgggtgttatttaagttaactgtggcaaattttatgaggtatcaagggaagaatgcttttgtccttagtgaaagccctgaaaacctcggaagaagggccacacaggtataaggaatcctcttttcacaaagtcataaaccagagttcttaggttgtccttatgcagtctttacaccagtgtgtatgtgtggaggcgaatgtgtggaggtgtatatgtggaggtgtgtgtatgtggaggcgtatgtgtggaggtgtgtgtatgtggaggtgtgtatatgtgtaggtgtgtatatgtggaggtgtgtatatgtgtaggtgtgtatatgtgtaggtgtgtatatgtgtaggtgtgtatat

SEQ ID NO: 132294 - DNA, 1044 bp, Homo sapiens
tatctgatactagtctcttctaatcctgtttagggcattgatgacctgactggggagcctctcattcagcgtgaggatgataaaccagagacggttatcaagagactaaaggcttatgaagaccaaacaaagccagtcctggaatattaccagtgagtttttgcttttcagaacttctcttgcgtagtggtgcactaagtctagttttgattttccttcctctacagctgaaatgctaaaatgccaaaagacccagttcacatgggcttaagtaataaaggaaatacattagcttgtgtaacagaagtccagaaggtaggttgggcttcagtcacacctgggtttgatcagtgtagccgttctcttggttttgccttcctgtgtgtgtattggctttgtccttaggcttcctgcatggtagcagacatttgtaggaacagccagggcttcctcttctatgaagggctgaggggtaacctttcctccagtgaatagaagcccagagcaccactcggatggagccaacttgaactacagtcagggaatgcctggcactaactgttacaggcttgggttactgcctactgcagaaccagtcattggggtgggaaggattccactgattacactgactagtccacttctagagttggcagtgcgacagtctcatccatactctgctatgtgcagatgttccgcaatttacaatgaaattacatcctaataaatccattgtaatttgaaaataccaagcaccataacttagcctgccttaaacatgctcagaacacttagattagcctacagttgggcgaaatcatctaacacaaagcctgttttgtaataaagtgttgaatatctcacataatttactgaatattgtactgaaattgaaaagcaggatggttgtacaggtgctcgaggtacaatttctattgaatgcatgttgctttcgcaccatcataaagctgaaaaatcctgcattgaataattgtaagctggggattgtcggtaggggaggcagggctggaatgaatgctgggg

SEQ ID NO: 132295 - DNA, 1017 bp, Homo sapiens
ttagagtaaaaggttttctaagcagcctctaagtaagttcatatatattcaaaaagattcagctataaacttggaatttcaactgcaagtcctaaataaaccaaggtgttatgaatctctatcagcgcaactcctaacacactccttggcagagcaggaaatcaacaaatgtttttgaatgagtaacaaacccctgctgctcctggggcaacctttcgcaccaagctcagtggacttgatcagtcaactctaccaagtaacctgagaatataccctcaggagttttggtcagaggatttccaagttcactcaacttatgtctgttagggcaagaggactcagggacagtctgctatgtgacagttccacaacaactactcaccacagttttgggagggttgaattcaatgttatagactcggccactggcgggatgaatccagcgagcagtaaggcgttgtttaatgacctcaaagggcacattcaggttaatcactgtgtcgatctgataagctctatctagggcttctgcctgtggaagtgtccttggaaaacctttataaagtaaaaaagaaaaagaagaagaaaaaagaaaggaagtatggggtgggggtggggcgggtggagaaagaagaaagaaaaagaaagaattaatgttggacaatctgaacaaaaggaatgaggctcaccaggcaggccgatcacagctgcggtgcaactgtgatggttacctgtcaacttgactggggcatgagtgcccagatatttggcaaatattatgctgggtatatctgtcaggctgcttttgttatgaaattatcatgtaaataggcagactgataaagtacattgcccttcttaatatgggtgggccttatctaatcaattttaaggcctgagtagaacaaaaggctgaccctcacccaaataacaaagaattcctcctgcctgctacctctaactgggacacaggacttttcccgcctttaaactcaaactgaactcatgatcttcacc

SEQ ID NO: 132296 - DNA, 1050 bp, Homo sapiens
attattttgtaacctttgtttttgtttttgtttttgagacggagtctcactctgttgcccaggctgaagtgcaatggcacgatctcggctcactgcaacctctgcctcctgggttcaagcgattcccccgtctcccacctgggttcaagctacccccaagtagctgggattacaggcacccgccatcatgtccggctaatttttttatttctgtagagactgggtttcaccatgttggccgggctagtcttgaactcctgtcctcaggtgatctacccgcctgggcctcccaaagtgctggggttacaggtatgaaccactgttcccggccataacctttgtttttatcagaaaagttgatgatgcacattttcagatgagtatgccattcagacttcccctttaggcaactcgttccgaggtgcctggaatgggataaaacaaatgcacttactgatttttttccccgctttgctgtagaaattggcgtgttagccaaggctttcattgaccaagggaaactcatcccagatgatgtcatgactcggctggcccttcatgagctgaaaaatctcacccagtatagctggctgttggatggtaagtggagtctcatgagcatttcacctgcccaaaataatcagtgctggcaggagaatgagcatttcatgggcttcagacagacgtcaaggatggtggtttggggagaggggtgcttgggactatcctgaaaccagtcatcttctctgggaccagttctatatccaaatggaaagagggaagtgaagtgcatgatttctaagctcccttcagatgtaactttagttcctttcccctttctttgagaatattttgtgatatgggaggatcaccacagaagaagcaagacccaagagtaatttacaataagctgtaaactttccctagccaggagtatggccgaatccttgagggtaggttgatttttagttttgttaatatagagaggacacaaaagagatttgtttcagttgagtcctcagctctcactaaaactgggataaacttggg

SEQ ID NO: 132297 - DNA, 1018 bp, Homo sapiens
aagaacatactctggggaaaggacagtctcttcaataaatgatgctgagaaaattggatatccatatgcaaaagagtgaaactagatctctatctcttgccatttacaaaaatcaaagaaaaatggattaaaggctgggagtggtggctcacacttgtgaggccaaggtgggccaatcgcttgaggttagaagtttgagaccagcctgggtaacatggcaaaaacccatgtctatacaaaatacaaaaattagctgagcatggtggtgcacacctgtagttccagctaatggggaggctgaggttggaggattactagaactcgggaagttgaggctgcagtgagtcatgagcatgccactccactccactttataacacactgttgtctacataaggctagctacatcccttaatcttaaactcccaccgctttcagacactatcataccccgccccccttccccccgcgaacccccgtgcattctgggactcatggtttggtgagtgttgtccaggaatggctacaaacccacattactatgatatcggacttctacttgtgtagtcatttgttagttaactgtacattttggaaggtttttgagtagagaagtgaaataatccaacgtttgggaagattttcttgtgcaggattggaggaggacgggaaagagggaaaaagcattgcgcgcgtgtgtgtgtgtgaagttattacaactatctatcttgaagcatgcgaggtaggagggcctgaattgccatgaaacgcaatgacgataaacgaagggacccgtgagaaaggggcaaagaggtgtctcaataaaataagcaacggcctgctgtgggaggattcgggtctcagtataggctgccactgtcagctttgcaatattcctcgagcctttatccatgagtaggacaggatggctctaccttgcagggttacagcatggagctgcgggactgcgccggcagtgcgctgagcggcatccctgcgatagggtgagtgcaccaac

SEQ ID NO: 132298 - DNA, 1184 bp, Homo sapiens
cacagtagtaattttaaaaatgtgtaatttaagaataacatactttctgagatgttatttaagatttttcatctgttctcattaaatgagattagtttgtaattctgatgttttttagtgatgttcttaactatactacaatagccatctttacacattcttttttgtgctttgggtaataataataataattgttatttttttgagatggagtctcgctctgtcgtccaggccggagtgcagtggcgcgatctcggctcactgcaagctctgcctcccaggttcacgccattctcctgcctcagcctcccaggtagctgggactacaggcacttgccaccatgcccagctaatttttttgtatttttggtagagacggggtttcaccgtgttagccaggatggtctcaatctcctgaccttgtaatccgcctgcctcggcctcccaaaatgctgggattacaggcgtgagccactgttcccggccaataattatttttttctttgaatgttggggaaaaaaaacttacagtgacttcatcagcgaccttttctgtttattatttgaaaaaaattcttcttgtcttctttttaggtccttttgtgtccttttcatttatttgttttggtttgtcattttttacatagctttctatcttaattccaaatatattggtaactaatggagaatcgtttaccataaagctcttaatctttttaattaattatatgttttttattttttattttattgagtcctatcttatttccttttacaaataagtaaagtggtcgatttatgttgtatgttctcagttaattagcttgatttttttttaatctttttttttttttcttttttgagacagggtctggctctgtcatccaggccacagtgcagtggctccatcatggctcacttcagcctcaacctcttgggctcaagggatcctcctgcctcagctctacctcaaccctgcccccctgagtagctgggactggggctactggtgtgcgccaccatgcctggctaatttttgtattttttgtagggtcagggtttggtcatgttgcccatgctggtcttgaacacctgggctcaagtaatttgcctgcctcagcctcccaaagtgctgggattacaggcgtgagccaccacacccagctttattttttattttcttt

SEQ ID NO: 132299 - DNA, 1943 bp, Homo sapiens
tacacttgtgcccaccaaatttgtacaaataaaaaaatgcataagatataaaagtagtgcataagagatcgtaaaatgaacacctttgtgacccccccatccacaaaaagaaatataactttgctaacatctgtacatcttttagctatttacagctccttgccatgcctctactggtagccactatcctcaccattatagcattgactttgattctctttatagttttataacctaattatgtattcataaacagtgtagtaaaattgtgcttgtttttggagcttttccctgaacgttttgagatacctgaaatcttgtagccccaggagcagtcttgaagaagaggagtcagcagggtgtgtgggaggtgaatgggcaaggaattctacacaggttggcctagtaaagtttggggactttgatcttaccattattaggtggacttgagatcttttcttgtaccaggtgatggagtcatatcttcactgttgccagggctccggaactagctctgagtctgcttctttgaagtgctgcttctgaagcaccggtttgccgtgatcagggatggtcctgcctggagttctctttatgcccattctctttctacttttgttctgctgggcgtttctggttttgtttgtgtgtaagagtccgtgtggattgcaaaaaacaaaatctagaaagtaaagtcatggtttcttccttttttcttttctaatttgtaaaaatctgtggggtttaatcttaggctttatttgtaggtgcttgttcctctatcccatttagacacttagaaagtttgaacaaatcaagggctttccttttttctgcagagcacgttagattttctataaacctaagtagaaagtggcattgtggtagagattgtgcctgatttgtaaagaatgttaaaaagatcgtagaaataatttctaattcaattccgtcgttcagatactttcaaactcctgtgatgctacttacatcacaacctattacacatacacatatgtgtaaaacagactgaagtttcacgaacagcatccttagtatatacagttattccaacgtagtttattctgttctaattttttttaatgttgattagagatccattaaattaactataagatccttcaagagatcagtgcctatagttgaaggtaccatgattttctagaggaagaggttagctccaaggaattaaactgaacagaggcaaactagtgtcgtggtgtggctaagagtgtggaacctttaggttgtgtgtagtagcttatgcctgtaatcccagcgtttgtgagcctgaagcaggaggatcacttgaggccaggagtttgaaactaacctgggcaacatagtgagatcctatttcttaaaagagagagagagagcatggactttggagaaggacagacttgggctcagatcctggttttgccactttctggtcatatgatcagggcagtctgtttggcattcttgggtctcagtgtcatttgactagggcaatctagttggcattcttggatcctagccttttgtaaaatggcatcttaatccatttcgttttgctataacaatgtcacaggcacagactgggtaatttataaaagaaaagaaatttatcacagttctggaagccaagaaatccaatatcaaggtgctagtatctggcaagggccttcttgccacagcttcccatagcagaaagtggaagagcaagagagggagagcgagagtgactgagagagctggactcatttttttttttccccccagagatgggcatcttgctgtgttgtccagtctggccttcaactcgtggtcacaggtgatcctcccacctcagcctcctgagtggctgggactacagatacacaccatggcacccctggctggactcatttttatagcagcccactcttgtgatataa

SEQ ID NO: 132300 - DNA, 2004 bp, Homo sapiens
atgtttacatgaaactttccaaagtccatttacttatattatcacattaaattatttcagccaactctgtgaggtagtttatgggctgaattctatttattttaaattttgtttgttaaaataagtttacacaagtatatgcaaaagatgtgaacatcccttcacctctttcctcttccattcccctctccaggggtagccactgtcacagcatttgcttacatggacatttgcataattcagaccatcagcaacatcatgctcttcatattgttcttcagccagcatttttttttttttttttttttgctagtacaaatgtctcagagaactttcccttccagcacatgcaggtcttccttaatatttctgtgggttgtagtatagtattccagtgtattgatgcatgataatttatttaactgctccccattgataaacatttaggttgtttctagcttttattttttctattagaaacttgtgtctacattgtatggaaaactgtggcaaacatccgttggctgactccattaactctctacctttccgcacacattccacaaataaatctctgaccttttccctatcttggctctcttaaggcaagcttgggttcatatgtggtcctataccacatgagatattctgatctatagctgcattcagccatatcttatggagaacaggtttcgggaatgagatactcacatgtcttttgccagctatgagtcccttaatttcctttagcttgtttgctttgaaattgctggaggttttttcagtaactttcattggtgatccagaagacggataattctattctttttttgtgtctgtgtgagacggagtcttgttccgtcaactaggctggagtgcagtggtgcgatcttggcacatggcgacttctgcctcccgggttcaaacgattctcctgccttagcctccccagtagctgggattacagttgcctgctgccatacctggctcattttttttttttttttagtagagacagggtgatctgtcgggtgatccatccacctcagccttccaaagtgttgggattacaggcatgagccacagtgcgtggcccaagtctattcttttctagtcatactggcaatgtagattgaggagtaagacatttacatgattctgctcccactacatgtccttttaattttccgcatcagagtagtaaaagccttcattctgatgatctggccagtttctcatttggctaatttgtataaataaacatacggatttgaagcatttagtgaatatatagtctttttatggttttttgatctaaaggatggttttgtggcccttacaactatttcagataactgacccagagtccatttgagaagtgttcattactttgatcagaatatggtcctgattgtgattgtttggattctagtgtttaatgtagtaaaacctacatttattttatgaaagtcccaagaactttttcccatttgagtgactgaacatgcctccttcctctaatgttaaatatatttttggtaaattgtgccagagggcattgcaaaagattttgtgcagcagaaataccttgttcaaccatttatgtccccctatgtcatttacagttttttacattgatatgtaaatctagtaagaagctttttggagagccaggcatggtggttcatgcctgtaatcccagcactttgggaagatgagatgggagtaagaagctttttggatagccaggcacaaggtggttcatgtctgtaatcccagcactttgggaagctgagcctaggagtttcagactagcctgggcaatatagtgagaccctttctcaaaaaaaaaaaatgattagctgagtgtggtagcatgtgcctagggtctcagcactttgggaggctgaggtgggaggatcacttgagcccaagagttcaagactatcctggacaacatagtgagaccctttctctaaaataaagaaaaaaaagaaagaaaga

SEQ ID NO: 132301 - DNA, 1035 bp, Homo sapiens
cagtgagcctagatcgcgccactgcactccagcctggtgacagagcgagattccactcaaaaaaaaaaaaaaaaaaaaaaaaagtagggttctccatttgttttctacaacagtccagtctctccatgctttttgcatgatgcctctgatgcacacgatgactttaaggtaggtgttggtctccatgtcatgaatgaggaaagtgcggctcagagaagcccagtggcctgtgaaatcacagtgttcctcaggcagagccagcccactcgctcagttatatgccagcatcctttctgtttaccacactgcatcatctacctggttgctaagccttacttgttttttttgactcttgtattctgctgaaggcttaattaaacttttcttttctgaaataatttcataggttgatgttcttaaggcaacagcactccctttgttgaaacaatttgggattgatggtgaatcatttgaactgaaggtaagaatgtttgaactgttgaccatatgttcctgtggaaaacattttcccactgactcattggaagagctgtgtgactcagtgtatgtgtgtcacatttgaagtcaccagttatcagaagactcacagggctcatgaaataaacactacagactttgaactgaaagggaccctttagtaataacaatagtagctgacagtgatgttgcacttcttttgcggtgggggccgttctaagcagtttacaaatactaactccttttctcctcacaacagctccgcccatgtgcctcagctagcaagcagtggagaatagatttgggccatattggctctctgatctaaatgatctggatataatttatgttcaggggctcccaacctggatgtccctgagaattttcagtatttccaaaatctagtagaagtagtttaagcatctgtattttgttgaattatatcaatccaatgtggtaaaccgtttagcatctctgccttttacattcatgttttaaacaggggaaatgacttcatttttatttaataatgttttg

SEQ ID NO: 132302 - DNA, 1034 bp, Homo sapiens
ctcagatccctgtctgttaaccaaacatttcagccactgctctgcagagctgcccatttcacaaacacctcaaaggaatgttggtttgaatggagatcgccctcttctccagttttggagcctgggaaaaaagagctgcctttggaaaaagcttgagttggttttgtggtttttttccttgcaaggctggttgactactggactaagcttggaggttgtatttcccatgggagggctcagactgggagaaagaggcccactctcttgtgtgcatttgtggttttaactgaattacttccaaagtgcatcttttccctcttgcgttctacaagatgacctaccagccagggcccagagggagctggtgttggttcctgccagcagctgtgactacacagtagttaccttttacttaatgccacccactctttctcacccctgccttatgtggggcgtaagagaaaggaacattctgttttagttttgcagtgctgtcctaggagctcatgatttggtacatgagaattaagtgaaaaagctggcagtaaagggggataagttggaattcgtgggataatctagtttcttttccttgactgtaggaaaggtactttgagaatcaagctctctctccacctactgtaacatacacacacacacccctcttagctttctctgacatggaacattggggaaggggaagagtgggagtcccatatggactgtagctatggacttgtacattggtattggttcttaatatggttttcataaatgggctttaggaggttcataaacctgaaaaattttctgcaagattgtgagtatatatgtttctcaggagagggtccatagctttcatcagattctcagagagttctctgattcttgaaagaataagaacctctgcttgggatttgaatcttggataagtaataaagaaaagcaatagctgacatttgttgggctcctactacacactaggcattaagagctttacatgcattttatttcatttgtgcctccaaactctg

SEQ ID NO: 132303 - DNA, 1520 bp, Homo sapiens
accattattagggctactaaatgatatctgacagccagagaatttcagagtgtctgtatctgaaaatggatttatttcctaccctacatgccttaaaaaggaggcaggggcagttgtagccatatgaaccacactgctggccacctatcctgttcagtctagccttggatagtaacgtgccttggtcagactggatttctaattttgacctgtgcaaaatatgtagaaattcaaggtcatccttctttgactatgtacaatatgttttaaagttattccagaaagaatgatcagaaagcgtgtttgtatgcttatgtatgcgtctagtggaggcaaaacagttaaaatggctgagaaaatgaaaaacaaaagaagaaaggcaacctaagcagttgtacctcaggagaaagtgtttgaagagaagtctgttctgcttgttaatttggaagaaagggaaggaaaagggggtggaaggcataattttatacataagtagtaagaataaagggatctaaccttaacaagtcttcagttttaaggaactcaggaagagataaaggagagaagttaatagagtatggcaagcagtttcctgaatgtatttgaataagtgtaaaagtaaggccatgaaaaggccgtttcatgtcagatagactgtgttgttctgtgacagattcaataaatatgagcgtcatccacttaacccttggaattaactctacatcttctagaactgattaagatttttttttttttgcatatactcaataaagatgatgtcctcctgctgctgctttaatgataaagggaaagtttcatttttttttttttttactagattcacttaagaagatttgaatctgatagtctcattctgatagtctcaactattacagttgctctaattaactgttagtttaaccctctacagttagttgatacaatgattactcttataagacctgtattctgttttattgttgcttgaactttggattttgatattatgagtgtatgtttctggttttttttttcctcctctcttttgttggctttccattttctggtttgtacaattattaatttgtgtttacagggtggatgcgtagactcgaccaaccaaagcctggcgctactactcatgacccttggacagcaggatgtttccaaagtcctgctaggccctctctctccctacacgtaagttattctttttcaacctcgttattctgtccagtgtaattttctcattgcccaaaatgacaaagggtgttgtgctgcacagagcctgcactatgaacacctgcttgtgtttatcctcaaatcagccagcagttgtcactcttaacctggtgtttatttttacatacaaggatttttgcatttctttccttccttaatcccaggtaactgaaattgcatgatctctattgggcagttattttgttcgtgctttagattttgtttccaggttagaggtaaactcctggtttggtgtagcttggattttattactagtt

SEQ ID NO: 132304 - DNA, 2445 bp, Homo sapiens
ggaagactgataagcaggaaactggtaaggaccacattatctcctgatagcttgtgtaaaagtatttcgtaggacaggatacctaaaattgagtaatcctaaatggcgtggtaacatcagtagtaaacaatgctaaaatagacttggtagttaagtacttggagaggagatgagggctggaagaatggcaccctaggtacagagactcgcttcctgtagagagctcactggaggcggctgccagctgtgtggccactgtggccccaccggctttgtagctgggctcgtagctgccgtttcccagcccttgcttcaggcctggggaagtcctgcttgcacacacggtatgaggtatggggtgttgtcttgaatgtgtgtggtcctggggcatggggtttggcagaacattctgtgaaaatggaatacatatatgttttttttcgtgacactttttttcttttgcttttggagatttttcaatttggctccaggacctgtatgatgttttcaagctttgcagagatgctcaagatatgactggacatttttgaaagttcctgtgtcctcttcaacacatcttctcaccaaacattaattgtagtgtcttttcttccagaaaacttgcataaaatgacttcctctcctgtgaaaacagtgtcctgctctgaatggagctttaaaggagtagcacaaattgtaagatgatgtatcttgaggctggggcttagagatattctgctgcctcccagagctttgtgcagacgggtctgccagggtgggaaagggaagcctccgttctttttggtaagctagcataaagacaggtaagggagtctattttcaagaaagctggatctgtttcatactctttctgcccctaatcactatggacagctccagcagcacaaagagatgaagggcaaaggcaggatgcagcaggcaaagttaacattgtatttgtgagtacagttgaggataaaaaagggatgaaatccacggtgaggaccatcatggtgggggaatagtttattctaatggattcaagagctttggagaccaaactaacacatttatttttatgtgtagttaaagtcatagaaacctgttttgtgaaacctcagatttctaaagaaaaccagaagcaagaccttccttggtttaaaaaaaaaaaagcatttcttcaagcagtttggacctgtttttcgtgtgtataaaacagctttttaaatgtctatgtaaagagcattgggattgctgttggtggttttctgtgctacttgagaaagtaagtctgtatgtgtgaaactctttttttttttttgagacagagtttcgctctgtcgcccaggctagagggcagaggcgcaatctccgcccactgcaagctccgcctcccgggttcaacgccattctcctacctcagcctcccgagtagctgggactacaggcacccgccaccgtgcctggctaattttttgtatttttagtagagacggggtttcaccatgttagccaggatggtctcgatctcctgacctcgtggtccacccgccttggcctcccaaagtgctgggattgcaggcctgagccaccaagtccggccaatgtgaaactcttttagaaaggcccaagagattttttttcagtagaataaaatactgttggataatcactggtatatgaagattctatttctgttaaatttgttgagttttaggtggcttacagttagtgacagtagttgcaccctccattcaacaagcttaattttacagtttagggagggaggatttatacttttggattaacagcaagaaaaatagcaaaaattaagatgcatcttaattagcactttcagaaattatttgtggaatgagactgcagttaccagagctctctgcattctgccagtgcacaagtcttggagtccagcctatctggacttaaggctctaccacgcgctaccaggagaccgtggaaatggtatttagcatcttggagccttggtgtcatttgtagataaggtgcgtggtcctgaagtcctggacttgtggagatggaacgaagcttagattaagtcagatgcttagtgctcctggcaacgtgcctgaggagctgtcagtgctgggtgctgtggttcctgcctggacaccccttcaccctgctgcagtccagtcccttggtcaggtcacttttttttttttttaactgctccttgaggagcaggactaccccagaggcagtgtggctagagtagcccggtcaggtcactttgaaccccaggaggcctagtaaacttgctttgggtgattttagggtttaagtcatctgtaagtggtctgcccagctacctataaatctatatccattaattttaaattatggattaaaaaattttaatttctagttattatttttatgactgacttcccctagtcacattac

SEQ ID NO: 132305 - DNA, 1114 bp, Homo sapiens
aggctgaggtggaggattgcttgagcccaggagcttgaggccagtttgggcaacatagtgagaccccatctcttataaaaaaaagagtcatcaccatatttctgtccattttctgctaggtctgaactaaataacttatgtgtcacgtacgaacttctaacctttccccccccagtttaatttatcttgctgtattgcgtgtatctctgcaaactatctaaatcttctttggaaactggctggctgaaaggaagtactatttaatcagattcgatgagaaggtcttaacttcagccctctaggtctgggagattaaaaccttggattctaggtggtagaggataatttttttttgaatgaatttctttttatttatttatttatttttttcctttttaggatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacgga

SEQ ID NO: 132306 - DNA, 1936 bp, Homo sapiens
agcaagcagcatgaacttcgtgtttatattggtttcccctgtctcacagtggacatggaggggcccaggtagatgctatgcatgttacaagtttgcatcatagccaaagaacttgttatgtttggggactccacctatttcatggcaagcctgttgtttcacgtgcagagattacttcatcccttaagactgcctcctgcaaacacagttttgagaaagaacccaggcaagagcctgcccagcaagaatatgcaggaataccaggatccatggcagatttcccctgccagctaatagagtctgcatttgatatgtgcataggcttgaagtttgtagaaggggaaagatgtacttctttctacttgaattccaaatggtgtcctcccccgggggtgaactttgcctcatcactccctctcggtaccttttgctttttaagtgaaaaggggctagagaaaggctgtgctttgatgtctaggggtgtgggaggatgtggaggtagagagttaaccttgaggaaggccaggacattctggactatgacattctactgagagctttacatactgtattggtaatatgctcttggtatataacaaatgctcacaaacttagtagcttaaaacaatacctctttatcatttcacagttctgaaggtcagatatccaggcagggcttggttggattctctgcttagagtctcataaggctgatatcagggtgtgtgtcacctgggctgggctcagctctcatctgaaggctctgggaaagaatgtgcttccagctcattcaggttgtcgacagaattcagggttgtaggactgaagtcacctgttttcttcccatttttcttgctggctgtgagctgtggacaactcttagcatatagacaggcactgtccgtatttctgttcacttggtctcccctaccttcaagctggcaatggtgcatggaatcctggtactttggattcaccttccgtttgataccagctggagaaaacattgcttaaaaatgactcatagcacaatagtcctacctggattatctccctatcttaaggtcaactgacaacagcaatactagatttgtgtttaaataaccaggggctgggaatcgtggattaccatctaagaattttgcctgccacacatactgcagtcttacctagtgccgctgacgttcgaactcagatctgcccatatagagctcaaatccagaactaaggggcacattgcttttggaatatcacatacctgccgttccttgtacaagctctggaaatggtgctgttggtcaatgtagggtggcacatagaggccaggcagattactataagcagtagaggggatatgtgctactgtctgctgcaaacctggaagtgtctggtgtggttccagccctgcatttggcaaagctgcttctggagttggaacatcttgcaggaatggtgatggtattgccaaaaagaggacaaatttaatatttatttaaacagctcactcccagccccttctcaaattcccaagagaagcaatgtaccattccttcgggaagaagtcatcctttgctgtttgctgggacatcttagagactattcaaatcctgcattctcttccttttttctagcttagctcctggtcggtccacttacttgctggggtagcttgaagcgagagattccagcgttttggggcttggttttctatcttggtctgtctgttcctttctgctgatagagatagaccattctgagttaacggcagcagttgttcaatgggagtgtgagttttttaggcagataaacctgtgaacttgctgggggtcatggcagtatcattctttgccttcttgtcatctacaaggccctgcttctgtctttcaacatcctttaactacattccatgcagactccagccagcctccatcatgat

SEQ ID NO: 132307 - DNA, 1042 bp, Homo sapiens
tgagagatattttggggcaagtactctcactgattctgactttttttcagattctccccctaggattaataatctagattattctggatttttataactttttgggtcttttaaagatccctccctgcttctttttttcccacaactaccgccataagcctggttgagaaggggctatctgagtgagcacagccataggcgcaggcctacagagtgggcccttcattgactttcccgatttgcctcagcaagtgtgcacctttaacctgaccctgcctttggtgacacttgaaccaagcccaacaccaaaatgtggtcagcactcaaaaaacaagaaccaggaaaatttaagggattttctcactggacagtctggggatttccattccaacatttgtattctctttaattatatgttattcaaatggacttcaattcatctaccacaaagaactctagccaggggatttctgcttttgtagctgtaggaaagaaattagattagaaaagattaaagcgatccttgcccaaggtcacacagctagttagaagagagctcatctcctggttccaaatcctatgttcttttgataaaaacgtaatgcttcgtattatttaaaatataaggtttggccaaataagttgaagattagcttttccctcttgagtcagaggaaaataataaatctatttctgcagtattcttctattggcctgagctagcatttctgaaagtatgttgttccactgaatactatttttaaaatcagccaggcacagtggctcattcctgtaatcctagcactttgggaagccaaggtgggaggatcagttgagtccaggagtctgagaccagcctggtcaacataaggtgacccctgttgctaaaaaaaaaaaaaaaaaaaattagccaggtgtggggccatgtgcctgtagtctcagctactcaggaggctaaggaggtggaggctgcagtgagccataatcatgtcctgcactccagcctgggccacagagttagacctcatcttttaaagaaaat

SEQ ID NO: 132308 - DNA, 1038 bp, Homo sapiens
gaccagatggatgcccagatgaggtaacaatttttttttaatccagggtagtcatgcattttcttttactttttactcaaggacttcagttcacttcctgaaatttaatgtgcggagcttccagataaacagcataatcagatgactgtggaacaaggcatggttatgacatgtgccctgtattgaaaattaatgtcttccaccaattaaaagatggcccttagtgttcatttaattttggtttattttctcctttacagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaattt

SEQ ID NO: 132309 - DNA, 1005 bp, Homo sapiens
attttccatttcaaggatccctgccttaggaacctttgacttataaagattctgacaagactctctctttgaacctccaatgagcaacatttctgctccctttcacacagtggtgtcctagagccagctcataccagctcacaagaaccaatcgctacattttcagggattgtgtaagctggttgttaaacatagtcacttaatgtattaaaacttttataaacttgcaataaataaattacagcaaataaataatattaaattgtgtttaaaacaaaggtaataaacagaactcatctgtttctaaatatttactattatccatactctggttatttatagctattgtatctatgtgatagaaatgcagatataatacacagacaaaacaaaatacagctacagtccagtttcagtgacatcccattggtagcctgaagttggtcttggtgggaatatttacacaatggaaatctgttgttgccaaatcaaggcttgacttcttattttgttgattgtctggaccaggggttgaaaaatgatggcctgaggctggccacctgttttccaaaataaagttttattgggacacatccatgctcattcatttatgtattgtctgtggctgccttcccattaccatgacagagccatccttgaaacagaaacatgagtccacaagcctataatatttactgtctggccctttaagacagtttgccaacctatggtctagattttaaaacttgatgaagaaaatgctaataatgcagattaagcttaaaagtgtgctttgtctgtaactattacattgtaagtagcataaaagttggtgaaatattcttctaatattgaaaaactattatccagttcagcaaataagttgtttacatcattctcaaataaatgaagttccaacatttgtcttgaaggaaacaattgtttcacttttgtcctactcattagtgtaaatgaaaacaccaaccatcatccattatactctct

SEQ ID NO: 132310 - DNA, 1092 bp, Homo sapiens
gcggctgggaggtggaggttgtagccagccgagatcacgccactgcactccagcctgggcaacattgagcactgaatgagcgagactccgtctgcaatcccagcacctcgggaggccgaggcgggcagatcacccgaggccaggagctcgagaccagcccagtcaacacggcaaaaccccgtctccaccaaaaatacaaaaaccagtcaggagtggtggcgcgtgcctggaatccctggcactcggcaggccgagacaggagaatcaccggagccagaggcagggaggttgcagcgagccgagatcatggcggtacagtccaggctccgcaagagagggagaccgtagaaagagggagggggagggggagggagagggagagctcaatcttcttaaaacgcaaatgcaaagagcacaaagaaatatgttcttaagacgcacaaggcatcttcttaatcatccctcctcagatgcaaaggttctgttgcctaattgtacagaggtaagaagatggatggtatccacccttcccctcacaaaaaaagagagttgtttttttcttcaagaattcagttcttcaagatttatggtgggaagaaaaatcaggaaacagccatatacttatagagcagggaaggattttggaaattatctagttcaatcagttggtgttaggtgagtaaaatgatggccagactcgttaagtatgcctgaggtcaggcagctagttaggagcaagaactagaatccacactgtgttcctagatcagaaattttactttttttttttactttgtcataagcccaaggtagctcaaagtggagcatacaagaatgcatgtagtgtattattataagtctccttgctttttttacattttaggtcaaaatggggtttatattttcaaaatctatgaatgaaagcatgaaaaatcaaaaggagttcatgcttatgaatgctcgacttcaggtatgttttaaaataattaagctattatgttgttacaatgcttaaagtttctaccacatgtactccagccgtacattctctttgactcccaacaataaaatgttctttgggctgcatcctta

SEQ ID NO: 132311 - DNA, 1071 bp, Homo sapiens
tttgcgtaccggtcgcctggtcccggcaccagcgccgcccagtgagtgaacaccggccgcaggcgggtggggagaagggtcagcccggccatgtcagtcagcgcgatctcctgggctccgggcttgccaggcagcgctgggcgcccgctcctcgtgagcgccggctcttggctctcgcactgcccctggtgctgataggtattgccaacttcgttccattagagcgcgttcttgtcgcctggcgtggactccggatctctccgtagctttaaaatagagttgagaaaaacaggcacagtgctctcaacagaaatcagcacactattgcggggaatacctaaattacagtaactggcctcagggagcaagggcggtgttaattacagaaaacctccggaagctgtgggctctgggctggaatttgcaaggggatgtggcttaatttcaatgggatgcaaatattgaaaatgactgtggtgagacgatcagtcatacattcaggcaatgtgtcatctgatcgggaaataagtcagcgtggtaatcccgatgacagaattcatgcaattaattttttatgtccccccaagtaaaatcaaatctaggtactcacgggtgaccggaagaaaggttgtctggaacttgcaggcaccacttctcctccccagaaatacaccttcccatagtaatctatagctcacctgaggcagggctgaagcattaaagaccccttccaagatctcagaaggaatcaaagggaaaatgaagacagagggattgaaatcagcattctctgcaaaacatcactctgagacacagtgatgtttaaaattgtataagtagcaagacatttttttttacccctggtgaaaagtgttagaatttttaaaagacttaacttatacaagtgagtgaaatcaaagttatccctattgcaaggtcaattttgcttattttctgatacatattttgtgagcaagaggagatagctgaaagtgttctggacaccctacggaatattcccagactttgggaaatgactttgccaggaatggggaagttgggaaaggaaag

SEQ ID NO: 132312 - DNA, 1037 bp, Homo sapiens
ctcacttagtaaatcaggctctcttaggagtgatatattttaaaaagagacaactagccttgtggaagggacagtcgtttagtagtctaagctggttgtttcaatgttcaaaagaattgtggaaattgtatgtgtacagtgataattcataagactgaatctctattaaaatctctaactgtacattatatgggtcttctaatgaacttttatgtactacttatacctactgtcctctattctaagtaggtattcggaattccactgtttagactcatatctcttcagaattatttcctaccccaaatttgagaaatacagtatagtgttgtttatgaacaaaagagcctctagatagttacttagcttttttatattggagccccaatattatattttggagccccccaaatggtgttaaaaaaaggctcagtatgtgtaggctagattggggtggtagaggtagaacttgactgggggcagttggtacatttctgctaaggttattgtaaaaggactagtttcagctttgaggatgaaactgttgcataaggtaggttatgatttatgattgacgtaggtgtagtgtgagatgaattacattttgtactgtactgagggcccagaattattcctttaatatactaactgtgactatgaaagtctatatatgtgaacatcagaatggtatctttgaatttagccattctaaattagatgtatagacattctcgtttttcaggtcaccgactttaaacatttaaattagcttcagaagtatttttgaacatcaactgtaaaagacagatgtgtataaaagggatgaagagacatgttatatgttagtgtgttagatgttagtgtgttaatataaatcttgtgagatatcactgttgtaggtagctaataaaaagctgaaatgggcaaataattactaggcttataaaataaattatatgtcgtttagtaatcctgagcaaaaacttagttcccattggtatgtgctaatcatggaaaaaaacaatgatatgtcaaaa

SEQ ID NO: 132313 - DNA, 1035 bp, Homo sapiens
cttgtctattaaaaaagcttattcactaactcatttctcttcccctagtctctttcacctacataatgaagtttatcatttgcattgataacaatttttttttttttccaaaacgaagtccaagctctctggcctggcatttagaacctactttctccatatcttgaacacatcgaacccacaattcctatttaatgcctctattcctttgttatttgctctattcagtatgactcccctgctatctttttttatgtaagaaatttatctgagttggttttcaagctcaggtcagacatctgttgtactctataaaccttctgccctcaactctcctatatccgcccctgtacccaataaataactgatctggcatgtgcattcccatagtatgttttaaaaatttacactactaattcatcaataccttcttacttaaaaaaaaatccaacaatgagagatctataaagataaaaagtaaaaaaatgtgaactttgcttttttagattctaatctcatttcactctccagttgtcctgtatctcttgagtaaataaatacctaggaatagaattgctgggtcatatcacatgtctagtaatttcagattggatgttagatactgtattacattatccattgtctgatttttgtccttttcctttaaagagtattgaaggttgttttgggtggcaggtaagctgcttggagatcttactgatcttttgaggctttttgtatgtcttttaggatggatttaactgttaagctagcttagcccttctgaagtccactgaatgtcctaggtctttaagaaggtctctccattctggctagtcagaaccgaaatgtctcccagtcctatatgaactgggtagccaaaaaccctagtagtcattctttgcctgtatttgtggagtgtcactatgtatttggatagtattcagtaagactcgggaaacccctgcaggtttctagagcttttctctgtgtggctcccacatcactggtgctctgcttcacaaatagctgctt

SEQ ID NO: 132314 - DNA, 1066 bp, Homo sapiens
agggctaatatccagcatctacaaaggactcaaacaaatttacaagaaaaaaacaaccccatcaaaaagtgggcaaaggatatgaacagacacttctcaaaagaagacatatgtctttttaagtttccactgaaaggagtctacctctgtgttgttttctgtcttaagctttctagccctatttgaattttaacttctgtatatatattactttggaaaataaaatttaactttaaaaccagatatattaatacatcgaagacatctcagtaaatcatcacagactgtgtgttcagcagtttaaatgtgactcctataaactaattactttcatgtcctttttacaggctgtcacatcagtcagacatgttagttgaacacgaacctgtatggttaaacattagctagtttagtcatttagacttagaaggaattaagtaagtactccagttcatagtagtagcaggatagaatggtaataaatcaccacaaaactttataagaaaaatagtctgtaacaaaaaaataagcaaaaataagtaagaaagaaaactaaaaaaatgagcatcaaaatatatttcccaaagccaggaactttgaaagctattggacttgtttgcctctttgtgcatattttaatagtatcgacaaattataggaatgtacttgactggaaagggagagatgacatcagcaggctaattgttgccacaagtgatagctgatggtgagagacagataactgttaaattccagcacaggcactgaagaagatactggtctaccatgccatgtggagataaagaatacaaaacaacctgtagtcctttgaagggtcgtgtgtgacagttcagttaagttggcattgacccagcactctactgcagctatttgatgccagggatttaaaattttaggtatttagctacttattactaagtaacttgtgaaacatctcctaattgcacccttgaatttcaccttaattctgattcacacccaaagaataggaatgaaggataaggtgtggagtaagtaaagatgaagccacacgatttggatcact

SEQ ID NO: 132315 - DNA, 1212 bp, Homo sapiens
ttaaaagggagatgaggtatctccatcttgtttaaaagagagagcatgtatttttctggaagaatacataagaaactggggatgagaactgagtagctatgggacaggtttgggggaaaagctttttattgtgtactcttttttaatattgaactatgtaaatgtattgaattatatgaatgtcatgctacttttaaaaaaatccctctgactcacagttctaagtaaaggtttatttcaccatttctcttgttagagtactgtacagaatgatactgaaacattaaaactatgcaagtggctgggtattgtcttgccttgtttggtccatccccttcatatcttattctcatagaaaagaacacaattattatttgcttaaatgtaatcagtgttacagaagattgagttcaaagttactcatcgccttggtcacaaggttattcatcacttcacattttatttatttcagcatgggaatcgttttcaagaaagtaacttgatacataaggaattctgagtgtctgtaggtaccaagaaaaggtggaattgtacaggcttggctttctacctccacctggtgggaaaccttgtatggtgcatggaaatagaatagaaaaagagccaaaaagaaaaaaaaacaattctgccatcttgtccaagtttaacctgtcaggtgctaggttttaatctatgaatttaggtggttggaaatctgtaaggtttctctcaaaactccagtgaaataactgcatttcagaacaaagttatcagcacctgaaacacataactgctggaaatttgaaatttgctatagattttaaatcgagtgagaagacatgaaacttagatttttataaccaattattttccctcctgtcaccacaaatataagtcagataaggctaggatattggttatgctgttgcttataggggtaagagtactatctcatcttttatttttgatttgaagaaaaaatattaatgttaagcatctaacttttgttattaattgaggatagagaatgtttagaaggtaaaaacataattttaatgagagtttcccctcccctcccttcccctcccctcccatccccttccctacctctctccccactcctccgacagggtctcaccttgtcacccaggctgaagtgcagtggcacaatcacagctaattgcagcggcatgatcacagctcactgcagcc

SEQ ID NO: 132316 - DNA, 1066 bp, Homo sapiens
tttttcatcagtaggttcattcctgggcttcacagacgtacacatcagagacatggaatactgtgccacacttgatgggtttgctgttgtatttaatgatggtaaagttggatttattacaccagtgtcaagtagatttactgcagaggtatgacttatttactttgaagggttttttgttattgtgtacttattttattctttgttatcaaattcttctctattttcatcattcatgtaagattttaagggttgttaattttttaatcaaaccaaacatataaatagtataagtagacaaaattctcttggacatgttaaagaaaaataatgattcctgttctcctccctgctctcctcatgcctaattttccacttttggaggcaactacttgttattcctttactggttattttgatttttaatctccactactctgaatatttcctttaatttttagttcttaggctgtgtttattgacttcttactgttgaaagtgaccatttacttccctcttccctgcttccaccatacttatattcttctcatgttcccattatagttattgtgattttgattaggttactattaattgtttatatttttatcaatatgtaagccccattagtaccgaaaccatgtggtactgacgcagaagtttttgctccttagtttagctaaaagcaggttcttgtcacacagccaggaaagattaggcatgcagacatactgaaaggtgaggagagcagaatttattaaaagcaagctctcagcaaataaagatgatgtcctgctaacaggctcccacttcacagattgattaccaaaccccagcacacacgcgcgtgcacacacacacgctgaagagccccagggtcctacccgctgaacaaggcgtgaacttaaccccattctcctagtgcgcttgtgggcattattcagaaagaatcactcaggaaacggcaaacgggcagttatttatccctctggatcaccagtttcatctgggacaaggagtcccatctttcagccttcaggcactttttgggcttgaaagtgggttt

SEQ ID NO: 132317 - DNA, 1001 bp, Homo sapiens
ctaaagaataaaccaaacagaatgtactacttttcactgactgagaagttaaatactatgtgctaggtgatgagaataattacagtgagcaagttagatgctgtttccgctgtcaaaatgtttacattctaacaagaaagtcatctttatttgaatttggagatgaatttccatattttagtgttttttaaataaattaactagcactggactgagctgagtatttatcagaccaattcatgagaagtttgaggttttaagggagactatttggtagtattttaagggagactattgtggtagtcctggtgggatattttcctctgcagatgaaaccaaataaagcattatgaaattgtatgtttattgaaggagaattatattgactacggtaaatttggagaaacactttttaagccttaactatttttctttattatagcagcttcatggagtttggccacaagatgttgttgacggaacgtgtgtagcagtaaataacaagtatcgactaatggcatttggctgtgtgaggtataattgatgtaggcttttgcatttttaagagttgttgcaaaaaatactggtttttttttttgtaaacataagatgttcctaacatacttataaactgcatcatgctatcataatttatcagtcaaccttaatatgaaatgtaaaagtattttattagattgaaacaaacaaaagtaaagggcagattttggaggttgagcatgttaatttgtaaaagttagcgttttcttcagtggtggaaaattgagttacaagttaaacagaataaatcagttaaagtttaggttctttattgtttaaaagaggatttggaagatttttttaaatcttaatttttaagacatcagcattcatgacgccttcaaattagtgagtgtgctttagttaacaagcaaatttaaagtgcacatataaaaccagtttcttgccttagtttattaaatagagattttagaaaaaaattg

SEQ ID NO: 132318 - DNA, 1817 bp, Homo sapiens
aatgtgaaaatagcctgaatttcagatccattattccacttgaagactaaggatccccagaaaagaagagagcatttctccctccccttccccatcccaaataataatttaaaagcacccttgagttttatgtcaagccagcatttggactaaaatggaaaaatgacaagggtagggtgctactttgtctgatttcaatagttaatgagtctactcacctttgagaacactggctttctagctgaaatctcatagtcactaagagcactattctttctaattataacagtgcatgagattattgtgtagtctttgtcctctgtgaagaaaatcaacatcgagatacatgtacatttcctataataaaactaaatcgatgtgttatttttgcctgcgtaatattgagttgtttttatttgttttcctcctttgcccttttgttcctctttccctcatttagagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacaggtaaatctttagttactgattactagagacttattctttgataggatatcacctggaacagattattaaatatttcatctgttaacttcaggcaactgagaatccttttaaccattttgtcatgtccctcttctgcttttctgtgttcttgtcctctagtcttctccctcctttctttccacttggcgtagagtgtatccccacctgtttcaagtctattaataatgtcaagaactagaagtttatgttttgccttctcattgagaactatttattttactttcagcctctttttttgtataaatttagctctacggatttgcacaggcaaaacaaagtgtaataatctcatggaaagtggcaacatcagctagtactctgtacagctgaccttacagtcttaaggggccacgttgaggttaatcatgtgactttggacccaaattgcagacttgtgatcagtagagagctttattgttaatacttttattagctaatcttattccaaattatttattcattctgatatcacttttaaattaacagtgtctcacagtaattctgataaactgacatttaacatggaaattaattctcaattttgataccaagtaaaattattttggggaaaccagtaagttgaagtttcttaaaagaaacttgcatacataatttcagtcttccgactgttttctttccctttttgatagcaaaatattttaggtacatcaaagcccactcttagtttcttttagtcagtttctgtttccataattctttgccttactttgactctctatatgtttaccctactagcctacttcagctcccatgttattttcagttgactttgagtgaagataatgagagacaaaaaaatggtcatgtgaaaggttgaaggattatctcctacattgacatctggtatacactaaaagaaaatgaacttaacttacattaataaattcatagaatcaaacaatgtacataccattttataattagtaacaatttttaaataaaactgcactagctacttccttgactaaaattttccactgctcccttctctcctatagccatttctctgctattttcatttccccatactttgaactattcattctacactgacctagcatcaatgccagtt

SEQ ID NO: 132319 - DNA, 1084 bp, Homo sapiens
ttaaaaataaggaaaatcagatataaaaaagtgatattgaataatatgtaagatttgattctgataaaatacttgatatttgataaaggatcttgtgttgaaatagttggtttatttttaattctttttaagatcggtaactataattccttagcctgaggatttattcttacattccagcttgagtttatctgatgtgatcagaatagatttccacagaatttgagatcattccatgcctattctgtgtgtgatgtatatgggatagtgagtgtgcgtgtgtgtatgtgtatgtgtgtgtacatatacgcatgcagttggaagagaaggaaatcagtacttattaggtgcctattgtgtgttaggcattttaaggcactttcatatatgttatcttactcatctgcacagcaacccagtgaaggcactactgttactgatcttttgatgtaaacacacacacacacacaaactaggattcagttactcatctgataagtgattaagccagaatttacactaagccctaatgggtgttagaatgatgatgctatatagcacccagttatttttaatggtatacttgccttcttaaagaaatatttatttttataaataggatatggatcattattaataaaggctctagagttatcattggagagagggggagtaagagcagaaataatttgatctttggctgggcgtgtggtggctcacgcctgtaatcccagcactttgggaggccgaagcaggcggatcacttgaggctgggagtccaagaccagcctggccaacatgacgaaaccccgtccctacaaaatatacaaaattagctaggtgtgttggagcatgcttgtaatcccagctacttgggaggcggctgagacatgagaattccttgaacccaggaggcggaggttgcagggagctgagatcgagccactgcactccagcatgggtgacagagtgagactgtctcaaaaaataataataatttgagctttgtctgggtaagaatttttataaatatattactttgttataatttctggtagcataaggtaaattttttaaaaaattt

SEQ ID NO: 132320 - DNA, 1056 bp, Homo sapiens
atcttatctgcatgctaaatacttccatatgtccaactatttcattggatgtttattctagaccccttaagcatcttggtctcccttctttttttttttttttttttgtccttttttctttttttttttgagatggagtctcactctatcgccaggctggagtgcagtggtgcaatcttggctcagtgcaacctctgcctcccaggctcaagcaattctcccgcctcagcctcccaactagctgggactgcaggtgcacgccaccacgcccagctaatttttgtatatttagtagagacagggtttcaccatgttggccaggatggtctcaatctcttgacctcatgatctgcccacctcggcctcccaaagtgctgggattaagggcgtgagccatcgtgctcggccttggtctcccttctataggtaaaattggttttctcctttaaaatatagttcccatttcctctgcaaaccttatttaatggtaaccagttagtcctaattgataagggaatatactgttttacagaagtttagataaaaggtgtgaaaaaaagtgacaatttaaaaatcattttgcagtcctgaggaactaatcagtcttatcactaaaaatgggaaaaccagatatggtatgcttcttgaggtgatataacatgaagttcacaagaattattgccaaaaatcttgaacccaaatcaaatcaagtatagagagtcatcttccctaccacaagggagcagaatacaagacattctgttggacagctacaagtcactaacatgggggaagaaggagtgaatcttctagattaaataagactttgaagccataaaaaccaaatgcagtggttaaaagtcatttgtgaggcaaatgtgataatcactaccctgcagaaccaagtcagtaagctcatttgtatcttcattcaaatcagctatgaaaagacactgttgaaacaattagggatatttaaatactaatggagagagaaagtagggaataattgtaaattttattggatgtgatactagcattgtagctatgttagca

SEQ ID NO: 132321 - DNA, 1078 bp, Homo sapiens
ggttcaagtgattctcctgcctcagcctcccaagtagctgggattacaggcacctgccaccacgcccggcttatttttgtgtttttagtagagacggggtttcaccattttggccaggttggtcttgaactcctgacctcgtgatccacccacctcagcctcccaccaaatgctgggattacaggtgtgagccactgcgcccagcctggcccagcctcacctttaagcttctgatgctggtacagtcgtctctgatttagtgattgctcacatttttacttggaattcttaagaatttttttttattttttcaaattaaatgagccaaaaagaaaaagggaaactctttggttttcccttccctaatttctcttcctgtcttctatcagtgataataacttcaacttctctagcacctcagctaacctggaaatcatctttggttcatctctttttctacctttcatgtctaggatagcagtaagttctgttttttaaccaaaatgttccttcctctttacagatagaaatgacttgatatctgaggttccttttaaaacagggctgctcaaagtttaatgtgcataatggtttaagttgcgtgatagggctcaattggaaatcattatactaggctctctgaggtttgattgaaatttttcattataaaaaggcagactatttcctcatttctgaagtcaacacccatgaaatctgcctctcctcagtaacctatcctgattaactctgattttttaaataactgtcttattcaagaaccataagtagtggcttctttcctgctgctcttttacctggctttctgaatcctccttgaaggtctgttaccatccagctttgttctcataatgtccctagtctagccagactgttctcactttcccaatagttccatgtcttcgttttccattagattaccaacccttactctcccacacgtgtatgtcttcctcatctgtcaggttcactgcatccttttaaactttctgttgttatgacagctagatcactgaagtgatctctcatttttataaacttctaaagttgtcttagcttt

SEQ ID NO: 132322 - DNA, 1038 bp, Homo sapiens
gcaggacagctcatcatgatgcagagggacaggtcaggcccacagatccgggagaaggacagtaaccctaataaccaaaggaaacttgtgagtaaagtactagtcatttcttttcaaacattaagaaggtatgggatgaggatgaaggaatgaaacaatttaagagaagagtattttatgatttggaaaggagaaattaagtccataaaatcagtcttaagcctctgggtgtaagactgactgactggaggataaggtcccaaaatgatcatgaaatgttccatactccatatgttaactgcttaggcatcattcattgcaaattctaatggaaaaaatagggatagactggtgaagttcatggggtgttttgttttcagatttaagtgtatatactttaaaaggccaggatacttttattaactctaattctaattagatccctttgcttttcccaaaaaaatattatactatcatttgaaagacttagtaaactagtacctaggaacttaagaacctgcagatttaataggaaaacaacttgattcttgtctctccttctccagctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctgg

SEQ ID NO: 132323 - DNA, 1084 bp, Homo sapiens
cttcttttcctctgggtagaaccccagtagtgagattgctggatcaaatggtagttctacttttggttattgagggaatctccaccctgttttccatagcagctgtactagtttacattcccaccggcagtgtagaagtgttccctgatggccacatccatgccaacatctactgttttttgattatggtcattcttgcaggagtaaggtggcattgcgttgtggttttgatttgaaaatgcaacaaacttttaaattacctctgatgatagaggaccaaaaggaagatagataaatctgtaggtaatccaaaagccttcttaaagtcgtaattttacctttccttctaattatactttttgatataaatttagtgctaatgcatttgacactcttgtgacctattgattagagaagttattacacagtcggggagccaaatgaattgtatgctggagactgaaactgctatcacccatagatgggatattgtcttctgagagatgactatgaattcacactaacattataaaatcatgagaatttcctctggtttgtgaggcctgtgtattccttcctatgttcttctgttgttgtctcatttttttccttacctaatcctttgttttatattgttcatattctctttttttttttttccccaggacaacatgaacatatgtttatattcttactaccgtgcttgggcacatagtgagagcttattgaacgtttgttattgtcatgttttactgggtttttttgttttttgagatggagtttcgctcttgttgcccaggctggagtgcaatggcttgatctcggctcatcgcaatctccgcctcccaggttcaagtgattcttctgcctcagcctcccaagtagctgggattacaggcatgcaccaccacgcctggctcattttgtatttttagtagagacggggtttctccgtattggtcaggctagtctcaaactcccgacctcaggtgatccgcctgcctctgcctcccaaagtgctgggattacaggcatgagccaccatgcccagcctgttttactgttttttaacaagtgcttacta

SEQ ID NO: 132324 - DNA, 2882 bp, Homo sapiens
tatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactggtaagtgctgctttccttaggcttggtgtccttccatgtcttttggtgaatcctgtcctttcacattaaggcctagttatggttcatgtgttacattttatttatttattatatattatttattatatgttcatttttaagctactttctttagtaatcattctatacccagctatttaaatggataattccatcgagtaaggttacactgttggtcagtgtataatttatagtgtgaatgtatatcactgacttaagattgatgcagtgcaaatgagcttagaattagactggaacttcagatttgcatccctgtgaaattgaaagcaatggtctacaaatatctacttgaaaagattcaaacttaaggtccatgtgaatttaacattccatggcagttacaagcaaatccaaattagagttgtggttgcagttaagagccttggactctagccctgtctttattaccagttaatgtgtgtatttggagctagttacttcccttacttggatctggttttccttaattggcaaatgcatttaggttaaatgttgtctgaaggtcctttttcaagtctaagctcctgttggcctttcaattgtaaaatataatttttagttgtaatactggttctaaaacatcagcctttgcccctaatgcttagaaacttaagcctcaggcttatgcaatgtgcagccccctctgctgggcaggacagccaagaagcctttcctccctaccttctttgcctcctctctcccctcctaatctatcgtcgtctttaccatatcaatgttcagtagaagttcacccgtaatgttctaccaaaccttttgaattatggcagatgagctaatgttttttttctctacatagtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttact

SEQ ID NO: 132325 - DNA, 3240 bp, Homo sapiens
acatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatatactggttggtatctttttaactgaaaaacagatctgtgttcttctgtatccccatattttcaagggttattccatgtccacagagccttttaattgctgttaaaagacctagatggctcatgtgagcaaagaactcaacatggaaatgtttacttcagttagaatcctttatcttagaatgaaatggtacttctgaatttcacagaaattattaggtaaatgttgagcttcacctatgtaggagttttaaatcatccccattagcaaaaaaatagcaaagggtaaagggcgttcttttatttgggagtaagggtaggagggagggaagaagttgcctttcagccagagtgactcattgcttattctaatctccacagaaggaaagggcaccaccactcaccaaaatagagcatgaactttgagttcagagatctctgtgcaagttatttaaactttgagtgaattctctcagaacagttcaatgcaaggtgaagcagctgaacaacttctaacctaatactcctcttcttcttttagggccaataaagtcaagatgcagttatggctatttacatttgtttttagccaagatgcagttacgactctttttaaattttttaaaattatactttaagttctggggtacatgtgtggaatgtacaggtttgttacatatgtatacatgtgcca

SEQ ID NO: 132326 - DNA, 1100 bp, Homo sapiens
tcaagtctcaggaaagccagtctgctggatagtaagttactgagaaaaactaatctattcaactggctggaaaacaaaaagataggcccagtgcatcagtaagattataccatgaaggactaaccttgtataacacaagactcctatgaaacaaagaaaagagaataaatatttataaaattcccaccactcccagccttccttctaccccagaatagcccagatggcagctcagtgctctgaggaaggaagttaaggtcatgtactggcacaaacaatattctgaaccaaaagaacctacgaaaaccagaggggtatgtggccaaatattccccttttcaacttggtaagatggagaggggtaacagacatgtttcagaggaaaacaggcatagaaaaccacctcaggaaagcagcacagcagtgcatctgtgtgtccacttgtcaggacagtgagtcaccagctcagcacagggtccaggcctcagcacagagagacaaagcacatttgagaggctgcctgaagaaacagcttgacacaggctacagcctcaagagtgcaatgcttctctcccagccctatggcaatcactttccagtgacctacacagagttatattctcaaggggaatcattacctcagtgaatgatattttacccaccatccactaatacaacaaatggttttggggcttaaattggaaacaacttttgtctcattaacaatgctctgacagtgtacatctttcttgatcctaaaggggcagctattgaagtggattgttggctttgtccttaaggtcatataaaatgacgtgtgtgtagtggcagtacccacatgtgctgaagtgccaaaagactggcattttcaagtgtcaacaggccatgcatcactgcgccacagctaaacccttatagtgcttggccctgaaaagcgttaacccagaaagctctttgaacatatgatcattaaaattcattgacttacgttacaaacatccacgtaacatagggagaaaccatgtcacatggagtatccactgggcatgtacttagagctcatccacaagattaaaatacaaagagatcgtaggtgcaca

SEQ ID NO: 132327 - DNA, 1053 bp, Homo sapiens
tgtatttttgataggtttgctgttgtaaggattgaaggagacagtggacttttgttatctatagattaggttctaatctaatctgaagtcaactagttatgaactgaatgcccccacacccccgtttatttgttaaattatagtcatgaatgggagctatggatgtccataaaagatgactcagataggggacatttaaattctgttccactgataatatgaaagggggcaaaatgaaccctggagatgttcattgtggaaatggaaaatgtccccaaagcatggaaatcttggaaaccagaagaaagaggattaaagtgtcttatcatctaaattatattttattgggaaagcttttggagagaagactgcctcttggaatactttagaaagctcacttatttttcattataatgtgaaatagccctgccgcactttgatgccatgagttatcactcttttaattattttcttacttatgtgtagcagtgttaatgatagtggcttattaatagagtaagactgttttctttgggtaatggagaattgaaccacaatgcatatttcagacagctttcccttcagtccttggggatttattaaatacatctgctagaaagcaattaaagtcttgtcaagcaatcacggttttttgtttgtttgtttgtttgtttgtttttgagacagagtctcgctctgtcactcaggctggagtgcagtggtgtaatctcggctccctgcaaccaccgcctcctgggttcaagcaattctcgtgcctcggccttcctgaaatattgcatcctgtgtcactctaggttctgagatgggtgcaaaataaaatgaagagaagcatgaaaagggactctgaaatgtccattgtgtgctgataactgagctgtttctgagtcttctcctcctgaccccacttgtatcagcagtccccatttcccctgtcattcaatcagtatacgtataaccatgaaggtccagcagagaataacttaaggacacctattaactgattgcttgctgggcatggtggctcacgcctgt

SEQ ID NO: 132328 - DNA, 1129 bp, Homo sapiens
ggcgtttattagtgctgtctgggtagcattcccattgctcacaaagctctgtgtgcataaggacttcaagcagcatggtagggtatttttgattttgatatacatgggagaataccttaaaatacttaaggctttcagggactctttcttttttggttttattgggtaggctttctaaattgttagtttttaaaagttttcataccacacaaattatcttatgccttatactccatccctttctcatgtttgtgaacacatactaatatattacttgtgtattttgctttattcttatttgtattttatcctgagtgaaagatcctactccaagataacatacacccttaagggcaagagtcacatctaacctaatttctgttagggtaccaaggcacaccagtactataaaaatttatatctcactggaggatttcatagatgtgtgctttttttctctttttccctaggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttgtaagagaaaataagtttttttctttttcttcattttttatatgaatatgaatttagccatactagattctgtgaaatagtgttacgtgtactttattgagaaaatctgaagcagaagaaatggtgaatgaatggccatgcatcttgtaaatttggtatcgtaagaaactgtagtatagagtttgttgttgctgtttaaaagttttttgcctccctatccttccaaattctctgatttacctcttttcaaatagcctgtcagatacctgagtgtgaatttgtagagcgtttaccaagtattaattgttagagattgcctggtggtgaatgatcctaatagtatattttgaaattactaattagaggcacatgttaatagatacatgggtggttttattagtgcttttagagctagtgaaggaagactaaatctgatgaggcttttttcattatcattccactaccttg

SEQ ID NO: 132329 - DNA, 1018 bp, Homo sapiens
gagatcgagccattgcactccagcctgggccacaggctctgtttcaaaaatgagcaaacaaaaaaagagggagtctcgctatgttgcccaggctggtctcgaactcctgagctcgggtgatcttcccaccatggcctcccaaagttttgggattacaggtgtgagccaccgtgcctggccctctttgccttttcttttgcacagccttgtacttaccagggatgttgtttggcaccgctgatggtcaccaggctgccttctgtgataggtgactttccgaacctgatgtgcatggccattatgcataggaaaagaagcagaagatgtctttggatactgcctttgaagagcgattattttgttttcatattccttacctcatcaaagtagtctctctgtgtttaagcaaaatcaagactgataatttaagattgtttaacaaatatttgttttctttccttctctttaaggccagtcatggtttcattactcagcacccctgggctagcttgattcgtgcattcattaacctagaggcagcaggtgtaggagggaaagaacttgtattccaaacaggtatgtgagattgtgcgttgtatattttaatgcaattctagtttttgtaaaagtagaaagtttttgattataaataatatcttcaataaacagtctcttgaatgagcattctttttaaagcatgaggtggtgttagcttgtctttgttaaaaattttgaaccaaataatgcagcatctaacacttgtatagtgcttattatatgccaagtgttgttcaaaccatttcatatatattaagtcattgaatcctccaaacaacatgtaagataagtactgttacttccattttagagatgaaactgagtccagagagattataacttgcctaaggtttcacagttgtttaatggcagagtgtgatttgaacctagacagtccgggtccagaaactttgttcttaacctctaattggattgttatataggtagtgaacttttagcc

SEQ ID NO: 132330 - DNA, 1036 bp, Homo sapiens
gggctggaaaagccctgcgggagacggcatatccaccacccgctgctgggtcggccctgcagctgtgtgcacccgagaactgccaaagaagctgggtcttggcgcggcgggacgggccaatcagaagaagtttggccctctgcagtttccgtccgctcactaggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccaggtaccggccgctccctcctggcacggcccgcgcgtccgtttgcggctcctgcgcaggctccggggcaccgcacctgtgtgcacccgcccctgccggaccgctgggactcgctgacccctcccaggctgcacgtggggtggggtgaccttgcttgtccttcttctggggtctgaattgccgggacttggggcttgcctgtccccggttaagctcgtggtgcagattggggttgccaggtagattgaacctgctttccactgtctgcccttcgtgcagatggttggttgtgagtcgtctccccatattctggaacagcttcccctttttaccttgcttagcccttctgctttccagatggaaatttgtgtacctagactgttgtataaattcgctttgggggcggggagttttggaaggcgctagtgcactgttctaactttctgaggg

SEQ ID NO: 132331 - DNA, 1049 bp, Homo sapiens
tattggacagcactagtacatatacaacacagcataatggttgagagcactgactctggagccaaattactgtgtttgattcttagctccacaacttactagttgtgtgaccatgggcaagcgagttaacctctctgtgccccagtttcccattctgtaacatgaaaataataaaaacactcccagaattgttgtgagcattaaatgaagccctgacacatttgttctggatacaatatcctcttgttttatatttggtagtatcaatgtgcctttagacacaattacaacgatctctgtggtaaagatgcaatgtatatggtgtctataaatagcattcaatgattcgttagttagggcttgagacttttactgtcatggaaaatctaggtatagctaagcttttgagattttgggaactccttaaccctatttttctctactcttgcccccaacaatcagcctatatacttgtgaaatttaacaattacttcactgggcagaaattatatgggaacacttagaaatttcagtccacagggaaagtataaatatgttaactattttaacttaatcccttcctagaaacacatacactgttgccaagcccatattctccctttcttgttctcacaggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggc

SEQ ID NO: 132332 - DNA, 2842 bp, Homo sapiens
ttgcataaagcatatgttaagactccagagcaaccccaaatagtactgattccgtctacagtgggcacaccaataaaaataaattcatcaccagctgtgtctcagataaaggatgtgaaaattggactaaacataggtcaagcaattgtaaatacttcaggcactgtgccagctataccatcaattaacatattacaaaatgtaaccccaaaaggagaagacaaaagtagcaagggctatattttgccattgtcaacaagtggtaattcagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtggccaacctctacaacatcctctaagaagccctacaaaatttataaactcttttgggaatgcaagttctatacccacagtacatacatcaccacaactcataaacacaactgctaaggttcctgttccacctcctgtaccaacagtatcactgacttcagtaattaagtctccagctactcttttggctaagacatctttggtttctgccatttgccccagtaatcctccactgccaagtagcacttcagtgtttcatttggacccacctgtcaaaaaattgttggttagcccagaaggagccattttgaataccataaatactccagcatctaaggtttcttcactctctccatctctctctcagattgttgtatctgccagtcgaagtcctgcgtctgtcttccctgcttttcagtcgtcgggcttagagaagcctgacagagctgcatcttgaatttagactaaaagagccagtttttaaataatggggcattgttttgactcccataaaaattttcaatgtttattatactgttgaaagcatactatacattgtgtgtgtgtgtgtgtgtgtgtgtgtgtgtgtgtgtgtgttttaatgtatcttttcattagcttgcaacaaggctttgttttcttggggagggaaagatctgttccatttcacttactgttctgaggagggtttcaaggttctgtgtttaaagtcaggatttacctgtctgtagaacataaagtgaacaaagtttgaatagtttagagtaagctagccttttgcacatttacattgacatgtttcttcttgaatttggactgttgcagcatatctatgatatggtattcagtgtcattagtgaaatcttatttttgtttctgtaaaaaaaaaaatacatatatatatttatgcattgtgaaaaatgcagtccatgatgtaaaattgtacatattccagaatccctaacaacctgtactaaatatatgtacaaagaactatgctgtcttatttatgttttgtttacataatgtatagttttttaagtattttagtaattttggaccagtgaactgttagcaacaatgcagaagaatctgcatgtaataaactgagttgctgtatttctttgtttgaataccatttttaacgtgtgttcttgttccattgaaagaatacaggatgtaattgaagacagtcctttacaagaaagaattaagggtgggaaatttgaattagagctagcacttgtacatggctttccagcttacaaatactactttcacttaaatcttgtgtttcagaaaatgccttttttttttttttttttgactcacctgttgcccaggctcgagtgtagtggtgcagtctcagctcactgcaacctccacctcctgagctcaagccatcctcccacctcagccccccaagtattaggttggtgtgtaagtaattgtggtttttttgccactaatgccactaatggcaaaaaaaaaaaaaaaagccactaacggcaaaaaaccacaattactttctcactaacctaatagctgggactacgggcatgggccaccatgcctaattttttaatttt

SEQ ID NO: 132333 - DNA, 2846 bp, Homo sapiens
ttagtttcctttcaactttaataatttcatccgagatgaaacatgatcattgttctttgtttttcccttgtccgtgtatatgaataaagttgatcaatcagaaaagctattagtagcttttagttaatgacctaatttaaagttcaataaatatttgcttgatttttatgtagatttttatattagacccaagataaggcagattatcatctcatttcttttatataacttttcttctctttacattaatttcattgtataccatgcaactctgagaacactactaagtagaaagggacagtgtcattattttaatttgattggggttataagcaccatgttttgaccaaagcagatgatacataaaacaggcagtgtgagtttcccttttactctaagtaattaaagcaccttacctcaaatagcaatcccagaacagttaattttcaacttttttaaacctctgcatgcttttgagcaacataaaaacttgactcacattctccatggcagggtataggggtgccctttgttgtggtcattatattcatatgtatctgctagacaaagcattttatcagtcttttctataatttgtgttgtgaaaataataaacttttgggtttgttttcgaaatatagaatgatttaataagcattttcaaattatgaatgaagtactataccaccactaccccagactgaaaatacataaagaaagagaagaaggccacaaaacatataatgttaaaagataacagacatttcaaaacagattagtgggtaagttgtatgaaagaagtctgttctctgatcataatatttaagcttccttccttatatacagtcttctagttcagtagtatatttctccatgtgggattaaatttctaagattagtaataaacataaaaggtaaaaactttctaatcttttaaaaacttttctacaaaaattaatattgtaattcaacagaggcagaaatacagttgacaaatatcttgaaataacaacatcccagctacccagtctccccatcctgtgcctcatctacctaggcctaagtaaggtcttctgtgccacaatactgctagtccttctgcatcccccgccacactaccacttgctaatccaggcagcagtcatactgcccagagtaactctacagctgccatttttctcctgtaactcccggtgaggaattcagcatgcctggtgttccctagcctttgaacagttttccagttaattctgccacaaagagtatagtctccctactatcatatctttcctctttcttctctctttaacttaggaaagatttacttccactctgaccatttgacttcttgaagccaaatagttgagaagtggaagaatgttggttacaagtctacctaatttctattttaagttcactttttctagatgaaagttacttcctgttcaattttataatgtatcatttaatagttttgtgttcatggcttaaaataagcacttttataacatttctttgagaaaaataaacttgtaaggtgtagctcatttttaacttgcgtcctttgtgtactttagaacacatttaacaagaaagaggcctatctagattaatatatgaaataaaaattacttttcttgaattttttttcttaattctttgattcatcataccattaagaaacaagaattagtcatgagcctcggttccatattcattacgtgcacatgcacatatataatctcatatcttcctactcttctagtaagcaattcctcttctaagatataaaaacctcagaggtagaaatttacctgttaatgtgcataaacattctgctggtttaaagcacagaatattttttgtaaaactgtactgttcgtcacacaggtttatatgtgactaaaattttcatgacaaatttgaaggtcatatatatatatatatatatatataatctccttatatatattgggaaatttatgcacatgtttgtaatagtttttgctctagatagtggtaatttttccaccttagtgttctacttatatgcaaatggactcaacagttgctgtaggacaaaatctgtttatgcatgttaaatgtgacccataacgtatataattatgtatcttttgttagaaagaaaacatgtggattgtgtgatgtgtgaattatatctcaaagccattacaaaaaaaaaacccaacatgattatgtaacagtaggtgatggtaataataagtatatactgtggcttagcagctataaatttattgttcctatgttattcaaataattttatatatacaggtgaggtgtatcttctagaggtttctatagcctgtgtcagattgaattcatgtgatgtactttttaagaggtagtgatgtggttctaagagcttggacttcagaatcaggcagatacgggtttaagttataggaccttaagcaagtcatttaatctctatgagccttattttcatcatttgtaaagtgaacataacaatgcacacatctcagaaggctttttgtaaatgctagagctctctctagatatatatatatgtgaaatacctaggttaaaacttagcaaattgagaggacatcagtaattattaactcttagtatagcattagggtattgaaaacagtaactgcttggttgcttttctgggctagaaacattgtaaaataaaataattgtaaaatttcctaggaagtttgttaaaaagactgcttttagacatgataacaaacctaccttttctcccttttccccagtctttgggaaagttacagtaactttactgaaatgacccatgtcatacttacttaatgaat

SEQ ID NO: 132334 - DNA, 1108 bp, Homo sapiens
gagagaatatgaaaaaataaaagtaagtaggatactgtccctgcttttcaaatatttcccgtcttaatttcacttacttggaactttttatgcccctcttatgccaaataaacatgccattactttgtggtttagattgtgctgtgaattgtttgagaacccatctttctgatagcatatatggatctgttaaaatatcatcagtttgttggcttaatatcaatttattgaaaacagtcaaattcagatactcaaccagtggttaatttctagtccacggttcattctttgtaaatgaaaatggtagcacattgtctcttaaatgtatattgttagattttcttccccggtgatagtgaactaccttaccaggaatgtgacctgtcacccagtttttcccccgctacaaagctggaagacagagaaacttgaaatgttatcattattgttattgttgtagtttgccttcatgctttctatttaaatgctaatttagaaatataatggaaatgttggatatactattcaatgtattcagtgtgggatgcctttaaagtacaaacgcgttccttttctcctagtcttaagtaaaaattggtaagagtatcaagagaaaataatagcatatataatagttcatgttagagcttctgtcagtgttaaagtactttttaacttttttcatatttatatgtattatactgtcaaaatagcactttttcagggactgtgtaccaacatgattaacatgatgttttacccccaaaactgtgaatatgcaggaatatgttagtatggtggtagtttctgtaggtaagcagtaagaaaaataggtgaatacttattgaatatagtattaccttttcatgtaatagtacttagactaaggagaatgtcaaataattagtttattaaaatacttagttacagtttattatatactgtttttatacatgtgagtttagattatacctttggatatagttagtgattttaaatgagacatcttttagtgcccagctaactcagtcagtagagcacgagacccttaaataagacttctttttgtagggatccatttagcttttctaaaaggtatttgtgtttt

SEQ ID NO: 132335 - DNA, 1051 bp, Homo sapiens
caacagcaataactaaggtttgttaaattgtatagttagcaaaccaaggcaaaggtataacagttctccaagagtgtgtttattcacctactgggagactgcctgatgaagcatttcttaaaggtgatttgacaacctgtgaaatctagggtgagtttccagatctttgtcattctgggctgaaagttaatgatgttaagaaagtacccgaattataaagcaaactgaaaggtggggatgtgggatgaaaccaccaatgttgaaatttcagcttcttttatactaagcctgaagttcatacatcatagcaagtaaatatattttaaaatataaactgcagagcttttcttgctttttactattacagagaaaaataattgtgaattcagtgtgtgttaaaacaacttctgttaccacattttgggtgttttatattatgtgttatcaagctgtgtttttgtgttttattttagcttatttgcactaatcttgatgaactcagggaattaatcacaaaaatcgagaatgaactcaaagatctggaaaacagtagaaaaaaatcggtaggtgttgatccaaaagttctatctattattgtcagcattaaaatttattcctgctttttcctaaagcctttttgaaatcttgttttcctggattacatgaaaatttaccatgaaagatagaaacattgtttcttttatttctcctgtgtggtctagttttcatttttaatagacagaaatcgtgccaggggctgttaaattaattttgtttgcctggtttgtatcaggtatagttttagatatttcccagtatactggctggttgttttctgactggtagttttttgggtaatgtttgccttgcaaatattcttaataattatatgcttttaatggaagtttattgcttagtaacataaaattttaattcagtgtaacataaaaacagatgtaaattgtttaatactgccccggataattttgacacatacttaacaatatgactttttaaagaacctttatctgctgaaagtttttttttaact

SEQ ID NO: 132336 - DNA, 1020 bp, Homo sapiens
ttggtaattaaaagatctcaaaatgttttagggcatgtttagttgtaggagtatatgttttcatttagttctaggggtatatgtcttcatggttcctgtaaatttctacaaactgcatgcaaaatataccctattccttgtgtagtgagacaactgagatgcaagtaaaaattcctctgtggtttgccatatgtgcaaataagaaatctatgatttgatattaacaagtacaccaagttcggtgaaagaggtatagccatccacctgcaagctctggggcaaatttgacaccgtcatcataatagtagattatactatgaaaagtttagtcctcactgaatacttaataaaaatccacggtagggacaacattgttccaagtcttcatagttacaatagaagttgaagacgctctctagttctagacccacttacctggttggccagtccactgcttgaccatcagcatttctttcataagtaaatttggcaaattggaatgtgtagtttctaataaataccagctacactgtcccactacatcattgtattatttctactctcaaattgtttaatctgggttatttaaatacatattttccctacttggtcaattctatgaatttgaaattatatagatattcctaatatgtaattgttaataaaaattatctgtgatcattttttcttaatctcttaggttgaactgtcttgccatttttgtggataaaaagcatatcagcaatttcatatggtttaacctaatagaagaaatttaaggggctctgtcttatttttgtcactcagtagccacaaggaattatcttgttgtgacccacttttgcttttattgtttttgtttgctcttctaacagaagaaagtgccctttaggaaaacagtcccctgacactgaaattaatgaatgtatcgaacttggggctgataaaagctaatggtgaattagtaatttataagtacagtttttttttaattatcacatggtataaacattacaataa

SEQ ID NO: 132337 - DNA, 1445 bp, Homo sapiens
agattctgtaaattatttgttttgttcaaggtgttttaaatatcacatttctagcattaaacataaaaatatagaaatatttagtcagaagatcttcatattattcattctgaaatatcttgcttctgaaaataatgaacctgtttttggatagataatagatcccttttgtaaaacctgaccagtttgccaaaggaccagtcttctttaaattgacagaaagcatgcttagatagagataaatgaaagggttaaattgtgaagttttttttttttaagtcctaatgagtttttaaaaatgttttgacctcagctgctttttagtttgacaatgtttttgttgactttttttaaagctagaacttgaacttgcccccctatttgcttcagaaagaatccatgtttatatacacacctaatatctgcacccaggtttagaaaataatcatcctactcctatttagagtatacactgtgagcattcaaatggtggattggatttgtatgtgtggcagggtggggtgggggtgtgtgtgtgtgtgtgtgtgtgtgtgtgtgtgtgtgtgtgtacagtcagccctctgtatctgtaggttctgcatctgtgcattcaaccttggattgaaaatattttcttaaatgtgtccgtactaaacatgtactgattttttttcttgtcattattccctaaacaatatgatataacaacaatttatatcacaactatattgtattaggtattataagtaatgtagagatgacctaaagtatatgggaggatgtgttatatgcagatactataccactttatatcaaggtcttaagcatccttggattttggtatccgcagggttcagaggtgagtcctggaaccagtaccccacggataccgagggacgactgtatattgtaaagggtctaaccaaatgtgtgccactttttcctaagagttatgtcagtggttctcaaactttagatagtataaaaataatgtgatacctttatttaaaatgaagattgttggtttcatcctccaaaagaccttgattcagtgggtaccagtaatctgcatagtggttaaacacaagggttctgcaaccaggctacctacttgggtttgaatgccagctctaccactgattaactctgtggggtaaggtatttaacttctccatgattccagtttctcatttgtacagtggggtaataatagtaccttccttgtagagttgtgaggattgaatgatacagcttactgttttagccatttttattgttttcaaataagcaggtcagtcgcttctggtgaaaaacactgaattatgaataggaaaatcaattaaaaatggcataaaaacatctattattgacccttagcactctttccatttacttaaaaccttgaaataaatcttggatttggtcttaatgaaagtggcacatga

SEQ ID NO: 132338 - DNA, 1324 bp, Homo sapiens
tgaaaataaagggacaatagctatgaaaatattgataatatataatgtgagtttaatagttagatatatctaaaaatgtggacacattcattttcagtaaaaattctattttggagagtgtttttatggaagttactaactggtaaaaatttaacatttttaaatcaacagttaaagaaaatagacatgtttttctcttagtactgtagaatagaatatttttaatgatattcttaggatgaattacaaacatttctacaaaatccttttatatattatataaccttggttgcagagtagttaataaaaaaataacaattttactgtttacttagaggcctttataccacttcttgtaacatattttaatgctttagtattacatcatcacgcgtccactgctgtcacacctgtgtttactatttctccgacttttgtttttctcagtcctcaaagcatcagccctgggaatgtagatgttagagcaaatctggcccattgttaatatttcctctatacccatcttagtgaatagacttttccatatattaagtagcacaggctgcatagccagtgttttttaaaattgcagtggtattcattagtgaggcatgaaatcattttagcagattgcatgaccagtgtttcttttttaagctaacaaaattaaactagaaaagaaatcagcacaattacatatagtaagtgtgctacacatagcagtgtgaatatgtacactcacatatattgtttcgtgaaactttggtttcaattgtatgtgtgtacacaaggatatgcattgtaaaatgtgttgctgaccatgggtcatggtcaaaatattttgccagattgagctgtttaaaatggtcttggccgggcccagtggctcacacctgtaatcccagcacttagggaggccgaggcaggcggatcacctgaggtcaggagttcgagaccagcctgacctatatgaaaccccatctctactaaaaatacaaaaaaaattagccgggtgtggtggcatgtgcctgtaatcccatctacccgggaggctgagagaggagaatcacttgaatctgggaggcagaggttgcagtgagccaacatcacgccattgcactccaggctgggcaatgagggaaactctgtctctaaataaataaataaataaataaataaataaataaataagtctcttcctggttctcaaggtgtcctagagggagagaaaacagagagggaagaagagagagagagaggatagagaggagtaatagtctcatgaaaacagtggttcttatgcctagtttacaatatgaatacc

SEQ ID NO: 132339 - DNA, 1025 bp, Homo sapiens
aaattaggggactttttataaaatctgaaaaaacacaaaaaagattacagacgcattaacagttacaaaaagcttatggtgttttaagatactttcaaccagttctgtttggaaagttttcccccctcaaatagtcattattgtcttttcttttctttttttttttttttgagacagagtctcactcttgttgcccaggctggagtgcattggcgcattctctgctcactgcaacctccacctcctgggttcaagcaattctcctgcctcagcctcccaagtagctgggactacaggcatgtgccaccatgtccggctaatttttgtatttttagtagagatgagatttcaccatgttggccaggctggtctcgaactcctgacctcaggtgatcggcccacctcggcctcccaaagtgctgggattacaggcgtgaggcagcacgcccggccagtagttattattttcacccaaatcactttatggtagcacctctaaactgactaaaatgaataagacaagtggtcttattctcttataggtgaaaaaactaagttaaaaagtggtcagtgacctcaagtgaataatagttaagtacagataaagacaacacaataaaaggtcaagtagagaaaaaatcaatgtgctgtgctagtctgggaaggttttacaagggatgaaggactttgaagaataatgggaattggataggtggaaaatgttgaataacacgagcaaaagcatagaggtataattaagtgaggtgtcactggaagaagcacaattaaagaaaacttttgtggaaaagttgaggttttagaagctgttcgaatgatagaagggtgtcatttttgggtgatctttctaagcatgtggtactatgttaaataattgaatcaagattccattgcaaggaattgagcttgaaataagatatatcagatgtgtaaaaagtaatgagctgctttataggaaatgactgagaaggtaatgtaatctacagtgtttgattatttccaggccc

SEQ ID NO: 132340 - DNA, 1489 bp, Homo sapiens
aaatgttagtctctaaaatattaaataatattttaaaattagaactacttcccaactcaattatatagtatattattaatataattgtaacccagaaccctttattgtttattacacttctgttcatatgctcaaaggcaataaagtggtttataaaatagacactgctgtagatcagagagaaaattgggaggaggagttttgtatccagttctagaaaaatgaatagaaacacttggaaggcaaatttataaattgtattcagcaagtactctaagccttagttgaggagagaagacttacatgcatgaaatagaagaaaagaatacacttgtttgtatacttattttattctcagagcaaattttaggaagtcagatcttaagtgacaaaaatgtttggatctggtagatgcagttttgtctgcttacctagttaatactgggtaaacattggccaattcccttttttcatcagttactgaattccttattgatataacaatgttacataaactgttataataacagctaaacatttgttttatgtaattttcagtccacttgtctatctgaggctttaccctgttcttctttattaggtgtgagacgttgtggcctttcatagtcagttcggggcataccttaatccagtctttactttctcactctttttaaaagtgagctccatcatcataggtttggaaaatactcctcttaaagattcacattgtcctttagtagaggttcacaattcattttgcaaaactgataatagatttgttttgaaattcagaaatcttcagatttcagaagggcattatggtgtatataatgtttaagtcatccccagtggggcttaggttaagtaatatccccagtgggaattactcctgtaatcaaacatataatctctactgaaaaatgtatgaattagactaaataaaacaaagactagaaaaccttaagttgaagtcaggttttcttaccatataaattatatttgagactttgagttttcaaaatcttctgaacttctaaattgttaagttattctgggcctgtttattaaagactctggaaagtcttgaagaaaagaaaactgcttaattttgtttaacgtagtgttttttttttgaatttattttaacacagctttttttcgagtaatgattaccgataacctgtgtattctgtagaatacgctttgggatgagctgtgtcattcatgactgatgtatgaaccttcacttagggtggactaagttctacatgtggttaatctggtctgttttatgttgtgtaatacaggctttaatttttggtagtatctccaaatttagtaagccttcttattgtgttggcaggtgatttttttttctttttttttttttttttattatactttaagttttagggtacatgtgcacattgtgcaggttagttacatatgtatacatgtgccatgctggtgcgctgcacccacgaac

SEQ ID NO: 132341 - DNA, 1971 bp, Homo sapiens
ctgcactacagcctgggggacagagcgagactctgtctcaaataaataaataaataaaactaggacagttgattgcctttttggctaaagataaatatacttaaaatttatcattttatggtaccctctgaataataatagtataatttgttaaatttctttaggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgataactgtgctgaaaaactggggttgtgtcctcagttttttaaagttcttggagaagttaatccattggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctcttagtccaggtgaaataaggtttatagaaaatcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggtaagctaacacaaatggatgggagttatatttaagtataattcaaattgttttttccattatgcatcatggatgctttgattgagagagtaaaatgcacatgtatgcatgcgtgtatatttgagggtcaaattttattttatattcaatgtgttaaaaagccagagcagatgacattttatatacttacaacaaaaaaagtactgatgcagtatgtttgaatttaattttcagttgaacatgtttggacattatgtttttacctttctctggaccaatttctttcccatcgcttatgaaatgtgtgtttttttttttttttttcaggctaagggcagtacagtgtagtaggaaaagcactgatttcaggaagtaacattcccaggact

SEQ ID NO: 132342 - DNA, 1040 bp, Homo sapiens
caggcatgaccaccacacttggcaaatttttacatttttcgtaaagacgaggtctcactatatttcccaggctggtctcgaactcctgggctcaagccatcctcccaccttggccttccaaattgttgggattacaggcatgagccaccatgcccagccagtgtgtattttgttagtactctttatttcatgtacttttacaaacttgctggtattttactgatctggaaatcactggaattgaaacagatttttaaactccagtgattatttttgtaaaataaatactatgactttataattaagtgatttattttcatattctctataacacaaagtagcagtgacttaattaaatatgtattcatcatttgtggccacccagcatttttaaatagctttcttacattttggtaatttcctatagtacaagttttaacttcccaggatagatgccagaaaatttatattctcaaaccccctcacaggtaaggtagaggtatatgagcaggtatatacttcttacttgatattgcatgaacaacatcaggtagcaatcttgagtgagagggtttattttttgataaaggtggtagtaggagtttctggttgttccaggttcttggtatcaaaggtgccaactagtgctgaccgtgtagtttttcttggagaaccttctaagtgtggttgggcttgttttctggctttttgtcatctaagtttggctctctgactcttgacagagcttctataagctccctactaatccttaaataaattccttttctgcttcagctagccagaggagattctgttgttgtcagataaataagaaggttgactgatggacttgatatgaatggttaatttttctaaaatataatattatgtgttattcatcttagaaaatataaataaatatcttgcttccctttttcatgccatcaatttgtgtacattttattatttcttaaaactccttttttttttttttttttactaaattgcaatgtctttgagagtgaggtccatgttttctc

SEQ ID NO: 132343 - DNA, 1049 bp, Homo sapiens
ctcggctcaccacaacctctgcctcctcctggttcaagtgattctcctgcctcagcctgccgagtagctggaattacaggcatgcgccaccgcgcccggctaattttgtatttttagtagaggcagggcttctccgtgttggtcaggctggtctcaaactcctgacctcagatgattcgcctgcctcggcctcccaaattgctgagattgcaggcatgagccactgcacccggctgtttataattttttcaaagtgtttatgtatcattttacattttctttttccaaatgtttctgtattattgtacattttctcgtaccaataatagatagtatgaaatacattgcaaacaataaactttgttttctattaaagagatagtgctttagtcaatattttaaatgcttcagtctcagatttttttttttaatgcagggaagagactgtcactctgattttatgacataaggagtatgagaaattgtgtagggaggataaaaagttagaacaaagctaagtaagtaaggtttaaatacttttatgtatttagcaaaagggattcttaagttgctggctaagggggtttattgcttatccagaagatttgaccttgtgaattgacttattcttctccaaggcacttgagagaaaagacaacgatagcagttacatctagaggctattatggattggaggatgagaagggaactgcatgtacctcaacaaggcgtcggtcaacaccgcgaagtttggcaggcttgacaagtggagtttttgaatctataatggttcaagttttgagacaggaagaacagctgagagcaaaagaagaaaaaaggtaaatgttaagaaaaaaattcataatttcagctgcataatttttatgtgcccatatcagatttctgggcccattttagtagtgttctaaaatgcattgttacaaaagtatgaattcataatgaaatatcgcaataaaatttgtttaaaatgtaattttaaaatttaaaaccacttatcttgaagctatacaaaaataatttctacagaa

SEQ ID NO: 132344 - DNA, 1048 bp, Homo sapiens
aaggaagacgaaaaagaaattcagggggaataaggtaatgactgggaaaatagaaggtaaaaatcaagtagaaagtaagtttaatggtctttaataagtgcttttttgtgggtatgaagactacttcttttcctgaaaacctttttgtgtgtgaggtagcttatagctgcagataagagcagtggtctccagactttcatgatctggcttctcaagcagcaaacattttgaatatataccttcgattatgcatatttatttataaatcatatatggatactttactattatgttttatatattataaaacataagctaagctagatacttaaaatgagagagtaaataagcatatttaaaaaattttttaacattattgatggtataaaaagtttttggtgagggcattgtgatacttcattagttttgagaatcttggtttcgtacttggctgtagagctatttgaaaggcttgttttaagttaggtttattttgatacttggttttaatggctgttgtagcacagagcttgtaaagatacataaatgtagacagaagcttagatgaatgatgcttatctatcaaatatgcaaatttttttgtcagaattccccagtaaaattttctgtctttcctaatttaattagttgttcttggaaagtatttctaaggtgtgctgtgctgttaatctccatttgcccctgtaaatgcattttctacccttgtgcactgtgctctgtgccccagaaggctgatttataaggatcaaactggtatgccttgacctctgacttctgattgggttcagccaataggagggactgacaggaggacagagaggacagacatatttattcctacagcttcctttttgctgggttgcaagttgtcagaaactgtgctccatcgttatggccttctcctacagtcaccgctctctgggttccagtaactattcactctcctacccatattgggcttagagtggtaaaatagttctctgctgtggctagcactggagtgcttcactatcccttcctattttct

SEQ ID NO: 132345 - DNA, 1083 bp, Homo sapiens
atggggtttcgccatgttggccaggctggtctcaagctcctgacctcaggtgatccgcccgcctcggcctcccaaagtgctgggattacaggccctagccaccgcgcccggcctataataaacatttcttagtcttaaaaaagagcagactaagaaactacataaaggtaaatttctaaatgcttagaatcatcattctcagtcgttaatgctcagaatacttatattcccatgtgatctaatagtatccatatttagaaattaaacttacaacattgtagtttataaaaataatgtatttctgacattcttaggccagtagaggtaaaattcttgctattttagtagcaaaaagtagtatgacctcaaatagttaattaaagttggagtccctcgcttttttgtatttgatgtatgcaaacacatcaggtttgcgagaccacacttgtggatactaggacatcagttcttctagcctaaaatctgagtcattactaactgcttccaatgggcacaactttgagaaaagcataggtcacaactgtttgaaatgcaactaaggtatatagatgtttcaaaacaatattctatagagtgttcatgggagtgtgattttcagcatatagatgactcatagcttatttgtaaatatctcaaagtggtatatggtattttagaaatgaaaccaatgaatcacttagatattatttgaattttccgttgacttctggaatatatttgtaagacactaaaggaacttattttcaaagtgtaaagagactttaaagccgttccctatactgctgagctttctagtgagcaataaatgaggtatattaggtaaagaggataccacattctcattagagagcagcccaatagcattagtaccctggacacagcatataacttgaatctcagtttccttatctgtataatgagggtgttagggtagaataattgtgcaagtatttaagtatcttctagaattaggcattcatgtccctgagatcaaaagataagttccctgcccttaagtggtttgtagttgagtagggaaacagttacttaaaaatagaataa

SEQ ID NO: 132346 - DNA, 1037 bp, Homo sapiens
cagatgtaaaatggaatgggtcccgtaggaagaattgcacgtgtaggcagaggaacagtttttgtgggatggaagttggacctgcaacttttagacagttttagcatgacatttaaaacagcgtttaggatgaaatatctctagaaaaataattttggcttatgtaaaaaggtgtcttaaaccattaaaaaataattttatcatttactacccatgtcggtcatcgaagatttatggagtgttactaaatggttaatggttacttttgcatactactgatcttttctctccgtttcatctgaggacacccaatttttgcaataatagggaatgcatcaacacacattttttaaagtttatacatttatgtttattctaccagaaatcataggcaagtcagatgatactgtgctcttggtatccgccacccatatatccaattatttaacacaagaggaggatactaaaatgaatgtattgttttataataattgtatagtctgtgtcagccaagttaatttctaaagtttaaatttttcgggagtggaaaaattcaatgtttttggtattggtagttgaagtggaatagtagtttgactgtttactattagagtgaatttaagttgagcaagtcacttaacctttttggcctcagtttcctcatctatcaagcggggataataatagtacttctctcatagagttgctttgaggatttaatgagttaataaatgtgaaatcaacagtgctgctcccatagttagccaagtataagtgttagccattttaatgtaagtagtagcagtcgttgaataatatgagtgtatacttcatatctgaaacggcattatacttgtgctcttacagaatagctcctagaaattgtgttaattttttggttcttgatttgtcactgtaatttaaaagtaacctttgtcattggcttcccatatgccattttcaagactaacggtgatttttttcaccaaaaacagttaacatagtgcctgtcttcgttaagtgagctctctttaagg

SEQ ID NO: 132347 - DNA, 2158 bp, Homo sapiens
attttacacattctagcccatgctgaaaccatgtaagaggtctgagggtcatcatcttccatattatttaagtctgattgtgtcttcaacaacagctgcatcacatttgatgcatcttgcataaatttttccttcccaacagcaagaccaatatggctaatgcactcgatagtttttcctctcagaagcttgagttccttctgaacagcaagctcaacaatgtgctttagtgagggcatgaatatatcataatatgggacaaatttttcttctattgtatctgcaactgatgcaatggttgtcacaagttgttccaaagccaacttagttccattccgaatcaactcttgaagtttaatcaccaagacggaatgtagatttttcaccatactatccacatatagaactagcaatgatttagggcagtcttcaataaaaataataagagcagaagctgcatgtgattgcacacgctgattaccttgattttccatggtacgtaacagagctgcaatcactgtttcatgaaatttcttttggaaattaggtgcaaaatctgtagccatctgtccaagtgtagtacaggctgcagccctcacccttggatgaggatcctgaagaaaaagcaaaacggagttaactgtttcatctagaattgattccatttgttgatggcatccttctccaatggcagataaggccattaatccagcatgtcgatacttccagtcagggctctgaagcatctgcatgatatgctccttggtcattggtaaaacaacttttccaccaagcccacaagccagtctgtctagtgcactctccgcagcaactgcattgctgtcaaaatcatcttcttccatttcatcagcatttacccagtcctcatcatcttgtagatcaaccatcattgctaatatatgaggaactgcctgtgcaataatatttgtatgttttttcaacatcggagtggcagtttcagacaaggtcactataacttcgagggccagctggcgctgcagattactaagcctagagtctccacataacttcaaactcaactgtagagtatcttctaaataaggacccaagtacttaggtacggtatctgcaatctcaacaagggattctagcactgaatcatcatcctggtagcatgagtcattcacagcctgtaagattccaggaagcaagtctgcaaagtctttgaaaagagcaatattattctcattagcaagtacaaatgcagctgcagctctagcggataatgtcctgattgctggatgttcttgatcttgaatacactggtccaacaaccgtttgatgatatccaaatcatgccgctcttgggtcccaaaaatcccaggaaagtgccagaaaacgtgaagtgcaacttcccatagaaccacatttttggagtagattgaatcaataagaaacttcagaccttccggccagtggttagtgccatcctcatctatcaaattcctggccagcactgcaaaaatatcacaaagttttttcctcatgctagcatgtgtttctaacttaacagccagaatcagttcaatcttgacatctctctgaacatcagcaggcagatttggataaacctcctcaaacccagaggacaaaagccgtcgtagcagtgcggcagccatttgtctcacctcataacctgctcttctatttctgacggcatctaagaggaaggtagtcttacacagacctgggatattttcatagatttcctctgcttgcctccgcaccatacagcttggattgatcaggttcttcagaagctggtaaaactcttgcttttctgacacggtcgccggcacccctgcagacgcggttgccgccattgcgctctgtcaaagctaccgcgaccgggaaggagggagggggtctgcggctcgaagcagtgacgtaggcgaggcgccggcggggatgggcggggtgcttctccctcctctgcccagaaactctagctgcgctctggcaggctgcgagctaggttttggagagaggtgagagccgtgtggaggccaatggcatcctccatttgtttttcaataagataaacgtgcacttgcaggcgagagaagaaaagcattgattagaatgggatcatgactttttttttttttggatacaa

SEQ ID NO: 132348 - DNA, 1174 bp, Homo sapiens
taatagagaaatgctttgtgatgataagaacatagcagagaatgaagtgtgtaaattctggggcagagaaaattctctggactaaacacactttagtgtacatgaacatccctccaaattttatcaggctggtgcctatatgtttcagcttaaaatatacttcctgataagcagaaagaaaattttaagtaatagataaataacgtgtacacatggacatacagtgtggaatgatagacattggagattccgaacgtgggaagaaagcatagggtaagaaattacttagtgagtaaaatgtatattattctagcagtgaatacactaaaaattcaggctttaccaccactcaatatatccatgtaacaaaattgtacttgtactccctaaatttatacaaataaaaattaacttctctctctctctctcttcctggaggaaaataactagtaggtttcttttgggttggataggacttatttgcttttcaacacccaaagaataactttgaaaatgttattttcaaaataaattgagtgttccctggaagttgctgtatttttttaattggttattttggagtagtctagaagacttccctacaattattgtttaagccttaaaataaaccctttagtatacaaatttgaaaaaattaaagctttcttgaaaatagatttatatatactctatcagagtgcaagcaggaaacagaagctacaccagttacttgaacatagagactttaaggaatggttggtaactaggtaactgaaaggattaaattaacaaacaaacaaacaaaaaaacaacaatgaaagtaacatggagatagcaactgcaggaagcagctaccactcctggggctggggatagcagagggaagtgcttggatttattagaagttagaaactttgagaaagggccccacaacttgtgctggctgtgagctgggataagcagccctgtgggcctgccactgaaacctttgaggacagggcactatttatagctcacttgtgtctatgaggtgggggcatgatgaagctgtttttgcgaaagttgcaaaaactgcaaattggaatcagctgctgctatggaacggcatgggtgaagaagcactcctggagtgatcttacagaaaccacaagctgacaagcctatagggaacaaa

SEQ ID NO: 132349 - DNA, 2918 bp, Homo sapiens
tggtagccccgcccctccgacccgccctctccgcgcctgcccattttcgttccctcgggtctgtaaccctctcccgggccgcttcctctttaaggcggagcccggcgtggatctcgcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcaggtgaggcgcgcccgccgcgcccctagcgaggctgggggccggaacagctgggctcctctggacgcaccggtccgagggctctgtgcgccgcgcgcgcagggctcacctggctccgctgcgggtgggcagcccccgcgaggcgcggggtgcggggcccagtcccgccgaatggtggggagtgggtccctgccagccccaactggaggtgcgccgcgcggggtcagaagtgagggcgtccggagcgcaaatatctcgccgtttgtatttggtaggacagcggccgtaggcactgggtgcccaggtccctcgcttcccgcgctcggcggggcctggggcccccagagggcggggagggcagagggctctggcggccatgccaccgcgcgggagacccggagagctggctaacccggctgagcgttcgcctggcttccgcggctcttccgcgtcttcggctctcaaacaggggaaactcgggcattgagctctcaagaataagaaccctaactctgcttcctgactgtggtaggattcgcgcaaactgaagattcgaagggtttccagaacttctggtccctctccctcgccgcctttcctaggtttggaatgtctcgagggaggttagagacctgggcatgaagaaactgtcggtttaaccgggggccgggtttacgaatgccctatataagccaagagttttattcccgaagtgaaaaggagtgtaagactgtttgcttttcttacttctcgccttctaatactcatgtcgttcacgctttaagcatagcactgcagcatagccagcggtgcatacttgaaggctgtctgtgggcatctctggtatttttatggtctggccagtctaagtttttttcctattccacaagtctcttacaatctatatccctagccactcagacccatcgtatttttctttgtcttcatgttgttgttaatacactaaaaagttggcatcctgagttgatagaccacagtttggctccaatcctgtggttttaaataagtgtagctctttgatttggtagaagtagcctacagttgcaaactacttaaaaggaatattttcctccccttcacaggcttagtcttcgaagactgtccagaaatttcatagtaacaaattacactttgggaaggagagagcttttttttcccctttccttctctctttaaaataatgttatagcacctttgatttgtgtttgcagccagttttgtactgacttcttagtgtttgacttgtaaaaacaggtatttagttgtaagctttgcttttgaaataattgtacacttgttaaatactacatagatttgctttgctgtgcctcaagtggctgataccgtttccttttgatcacaagtgaaaaagcatgtaatcgtttgatgcattttattttctagctggggacaaatagtacatgaattcctaggacactggtgatttcagcaccagagatagaaatgaaggatgttcttgggcaacactcctaaaatctttattatcaaatatgctaaaataattatcacatatgggattgggttaaattcaaggcaacaaagtagactttcagtaaactaggaagctcattccagattccagggaaaactgaggataaccgttgtacttcctcttccagggtcctagtgggtaattcactacttgggtttcttcagcccagtgataaaccagtagggtagaggaatagacctttggtgccagccattaacttggaaacagaaaaggaaggtcattggtaccagctgtgtgttcactttcttatgcgctgacaagtagctatggcaatgagtgttatctttcgtggtctctggagctccacagatgaggtagccagcctgtagcaggtaactactggaatggcatcacagagagtccccgtcctgtaaaataccatgtcctcattggaaaaaggtacccctacttcaaaatactttactgccacgtagtgaaaaatgtcataaattgtagacaatacatttatttttatttaagtggtacccgccccccatactccattcgtatgttaggctccagcttttaatctttggtatgtatcagaatcgcttgtggatatttattatagatgttcagctcaccccagaactgcaagtagttgaatttaacaagaccccacgggagattctgataacaccagagtttagaaaatgaatgttgatagatagtctcccactagtctcttactattcaaagtatggtccctggattctcaggaccagcagcattagctttacctgaaatcctcacgccag

SEQ ID NO: 132350 - DNA, 2169 bp, Homo sapiens
gaatataaaagtacttgcctatttaaaggaatatctatgtatatattatatatgatgtatataacatatataatacacacatatataatatgtgatggatacgtgaaagttgttttgcccttcactggcatccctagtcagtagttgcttgggaatgacttcccactgccctctcagccacttccacttggcatttgctttctagtattcccttgcatcattgttgcagttcctcttgttacctggagtttcttctttcaactcagtaaaatttcaagagtggtctgacaaaaaatcctaaccatttttgcttcttaagtattgtaaatactgcatctccatcttcgagtatggcagttctcaaacatttgcttttgagacattgatggacctaagttacatgcttctgactcacagatgtttgtgatttctaaatgaccgcttccttttttccctacttagagcttaatttgagtgtcagagataactttcaatcttcactttcattaaatgtggaagaacttcggtacttttcaagtaaatcatctcaacacttcacagctcttcataatatgtgaagctttgtggaataaagttgtgtggaacttgttattgcggtagataaatggtcactattgtaggaagactggaggagtacctatgaattagcgaaggagtggataatctgggtttaaaaagcctgtcatagcaagcatgaggaaaggtggttatatgttactgtggatgtaacttatagggtctcatgccgtgatatgcttagacatggtgctcttacgacattttttcctgtcaaatcaaattttaaaaagcaccagttgaaacagtttgtatttactcctgaccgtcatttagtagaaactaaccaggagctgactgtagaaataccctcaacgtcactctgactctggtccctcaaacctaagtggaaaaatgttctttcaatttccagcagttttatcactttaactgctatcttcatttttggaaatatgctactagttaatttgcatgttttatactgttagttttttttaattatctttaagcactttcatttaaaaatagtcataatgtttgtcagttgtatgttacgctttttcagctcctccagaattagtaaggtattttgttttgggtttttttgtgggggtgttggagaatgtcaaaatgatggtgtgaatgcagtgtttgctccttgagttttttggggtttttttccctccacgggagttcaagactagaggatgttcctttttttttttttttttttaaatcaaggaagcaatattcccatccctatccttatcagggcttacttgcttactgacttggaatactactttggcttatttagagtaagcatggtaacttgtgaggtagtacataatttaattccctgactgggaaacttgtgaaattcttgatcccttgttctacttgacaaatgtgaatacctgtagtgtttgagattgtgcttgttgggttcttggaccacctgagttcaaattactgatctagtagattaaaagttttaaattcaggacatacttttatttccatttggttgacttctcaaatatgatgttactgtgttagagttgtgaatgttgaaaagtaatacatatgaagagtagaaaatgagcaatttaaaaattgattatgtttctgggaaagtgatagttgtggcctgaaaggagtttagttttcttgtttcactgtatcatagtgaaattgccaactgaactttataaagaaacaaaatggagacttaatttcctagggctgttgtactaatgtaccaaaacctgggtggcttaaaacaatagaaatttactgtctcacagttctagaggtctagcaaggtgtcagcagggccgtcctctgatagctctagggggagaaccctttacactttgccggaaattttctttcttggcttatattaggtacatcactccagtcacatggctgcctttttcctgtgtcttcacattgtcttccggctgcatctttccaaatgtccccttattatgaggacactagccatattggattagggccctaatgactttgttttaacttaattacctctctaaagaccctatctcaaaatgaagtcacattctgaggtactgggggttaggactt

SEQ ID NO: 132351 - DNA, 1058 bp, Homo sapiens
taagaatttatggccgggtgcggtgctcacgctgtaatcccagcactttgggaggtcgaggtgggtggatcacgaggtcaggagatcaagaccatcctggcaaacacggtgaaaccccgtctctactaaaaatacaaaaaaaaattagccgggcatgatgacgggcacctgtagtcccagctacttcagggaggctgaggcaggagaatggtgtgaacccgggaggaggcgcttgcagtgagccaagatcgtgccactgccctccagcctgggcgacagagtgagacaccgtctcaaaaaaaaaaaaaaagagagagagagaatgtattggggtccagagaagacactgacatcagaggccattaagtattaagaatggttttaaaatctctaaactgtagtgctatggattttaagtttggctaggacatttgagcaactaaaaatgtagtaagatacattttagagaagcatttcactattctttctttattttctagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtatgttgttttcttcagacttactgttgtgagaatacaaataaatttattttctgttcaggatgttttgaataagtaaacattgattgccatttgaaagtaaagattgggatgttaatatcataacttttaaaagtagtcttttaaaaattgatatgaaatacgtagacaaatgtacaagatgtatatgtacagtttaaagagcaataaaggaaatacttgtgtaattgcaccaaggttaagaagtagattgatttaaaatactttttgtttgtttgtttgtttttgataacggaggcttgctctgtcacccaggctggagtgcag

SEQ ID NO: 132352 - DNA, 1081 bp, Homo sapiens
agttttgctttatcctttcctatctttgtaacttcctaattcttatcagttgcgataaatgggcacctatactgtttttcaaagcatttaagaccaaaaaattggtagatgaagtaaattactcaagattattcaaatggagataattttagatatatggaaaaatgccaacagatctacatatgtatatagaaagattaagaagagattagaaccatgtttccaaagaaagtaccaggcttggatggctgaattgttttaaacctatgaggagtagatcattataatgttacctaagttgacctacaacataaagaaggaaagcttcctattgctttataaattgagtttaatactgatactaaaacatgacaaaaagcacatcagcttcactaacattgacataaaacctaagttctagtcagcaaatagaattatggctgtatttgctgatttaacttgcttttaaaaaattatggctgcttattaaaaatatattactttaagcaaatatggtttgtcaggatgtggggacagttcattattataaaatgtttcaatataattcattgtactaataagccaaagaaaacatattaatttaaaatgttttctgcatttaaatacaaatttgagtcattagtgattttttttttttttttaaagaaaagtctcggccgggcgtggtggctcacacctgtaatcccaacactttgggaggccgaggcgggtggatcatgaggtcaggagttcaagaccagcctggccaagatggtgaaaccccgtctccactaaaaatacaaaaaattagctggatgcgatggcaggtgcctgtaatcccagctactccggaggctgaggcaggagaattgcttgaacttggagggcagaggttgcagtgagccaagattgcgccactgcactccagcctgggcgacacagtgagactcagtatcaaaaaaaataaataaataaataaaggaactcttgataagaggaatagacagaataggttaatattttaaacacattctataccggtattccctttaaagacgagctagacaaggaagccaattca

SEQ ID NO: 132353 - DNA, 1035 bp, Homo sapiens
attttggtttttgtgtatggaagctttttatgatgccagaaagatcgtactttcaagtggctgtcatcctggactaaataatgactgtttagaatgatgatggtaagcctttacagtttagctgagcatgtggcactgttaaacttcttacatgttttcttatgctcattgtataatagaaagtactggaaagaggagaattatcattgataacttcttatttcttttgtccacagtacagttcttgatgtttaacctttttgattatgaaatgtattagacaatacaaagagcacgatcactgtctataaacaccatccaagttatgaaatagaataacaatactcccaggaacttaccaggtgcctcctcctgattataactccctcttccctagttgtaactgctacccagacttctatggtaatcatttctttgttctttactaactttcttattaatattaacctttaacaacctattaataatctttaacttatttatgcaaccctaatccctaattttctggtttctgaactttatgtaaatggaaccatattgcttttgcttttttttttttttttttttttttttttttttttttttgaacgatctcattctgtcacttggctggagtgcagtggcatgatcatagcttactgcagccccaaccttctgggcttaagcgatcctgctgcctcagcttcctgagtaaccgggactacaggtctgtgccaccatacccagctaattttcaatttttcgtagagacagagtttcactatgttgtccaggctggtcttgaactcctgggttcaaacagtcctcctgccacttcctcccaaagtgctgggattacagtgtgagccatcacacccagccctgcattttaaaatttgtgattaaagaaagatggggccgagtgtggtggctcatgcctgtaatcccagcactttgggaggtggaggacaagtggatcacttgaggtcaggaattcgagaccagcctggccaacatggtgaaaccccatctctg

SEQ ID NO: 132354 - DNA, 1011 bp, Homo sapiens
atgctgcattctctgctatgcaatatttttatagtaatatatgaaacttacattttgatttgctgcgacagagtagtaacctcagtttattctcccaagtatgatggaccttaacattgattattttcatttttactgtgttgtctacaagagactaaatgtctttaaatttgtcagtgattagtatgggagaaatgagcctatgtttatttaatacatgaattaatttatgtaatgtataacatgctccatctctgattgtttgtcctacccagcatggttggctcttaggtttttattttttcctaaactgttcattcttgtgtaatattaaactttatgtctttcaagctatttcattgctaccatgttcattacatacagtgcctttggtcaaatgtacctcttctggtagtgacagttgatagtttttgtttagtctgtattctttctaccctctgtcattttgtggtttgaaacctttttatattttcagtaacttatttctaagttcctcacttacctttgaagttcctgtatacctgtcttgtcatttatatcaaggttcatggtatgatggcaagaacataagcttcaaagtcaagatgtcttcaaatcctaaccttacatttcattagctttaacctagaggaagttaatttctcagagcctttgtttccgtattttgtaaaataggaattaaacttcttagggttagacatatctaagtaaagaaccttgcataatatctggcatactgatatttaacttacttctcccacgaggtatgccatctattagacaccttaagagtggtgtcttctcccttcaaggaaaagataacttgatgaaatagtgatcttgtgttgatttcattttttcctttttaagggcttaaaaagaaagttgaaggaatttctcttggttgttgtcctaaaagggctctggccatttttttttttttctttttgagacagagtcttgctgtattgcccaaactggagtgcactg

SEQ ID NO: 132355 - DNA, 1835 bp, Homo sapiens
tgggattacaagcatgctccaccacgcctggctaatttttgtatttttagtagagacggggtttcactatgttggccaggctggtcttgacctcaagtgatctgcccctgccttggccttccaaagagctgggattacagtgtgagccaccatgcctggcctgatcttttaaacagcgtttaaaaggagaggatttgttttttaaacctttcatttcataactcttaattctctgatacacctgttttttaatactccttccttttgtcagattgcatgggttagttgtggatcagccactggaattgactacctccattttgtgtcttacgccctgttcatttttatattttatctttgttctttgaggtggtagataaatgtatttgcctagtgagttactaactagtgatcgaacttcaccattttgtatagatgggttcattagactcttttttttattgtgcataattctctcattttcaagttttgttttctttttaatactttactgttttctggttggactgtgtaagttatctttaggattatgaagaaattaatggaacagattagtcatattagcttaaagtcctggcttttcattagtgtcattcttactggatgacttgcaagaatgactcttaggtacaaaagaataatattttcaaaagtctagtgtatacgtcagtaaggcgtaaagaaaacacctatttcattgaaggaaatgaggaagaaagttagttttcatcttagtcaatagatttaagatagcacaaatcagaaagaatagttttgatctaatcttattaaccactttaaacatgagtagctgcaaatattgtttaccatgataacccacaaataacttgagttacattaaggtttttgaagcagtagacaaaattaagcttcattaactgattttaaactttttttaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgagtaagtgctcaagctattgaggactttattcatattttcatttgtagaaaccaaagccttctatttcaagattattttaaatagtctttctgaagaaatcctttagaggttatgttcatttgttactttttggttttggtggttgtactctaatttaaaggtccttttagctctcgattatctctggttcttaagtggtttattttttagtatcacaatactggcttaatttagggtgtatgggtttctgtttgtctttttctctattaggtgggctttttttgagatggtctctctctgtcgcccaagttggagtgctgaatggcacaatctcgcctcactgcaacctcagcctcctgggtttaagtgattctcctgcctcagcctcccaagtagctgggattacaggtgcatatcaccacgcctgattaattcttgtatttttagtagagatggggtttcatcatgttggccagactggtctcaaacacctgacctcaagtgatctgccccccttggcctcccaaagtgctgggattacaggggtgagccactgcgcctggcctctattaggtattttgatatgtattttaacagtattttggaaactgtattttataatatgtagtgtaat

SEQ ID NO: 132356 - DNA, 1006 bp, Homo sapiens
caggtatgagtcactgcacctggccagatttttttattgagtagtaagctccaagtgagtcgatagaatgtggttgtcatatagttatgctgtaaatctgttttgctttattttatttatttatttttgagacagagtcttgcactgtggcccaggctggagtgcagtggtgcgatctcaggtcactgcaacctccacttcctggtttcaagtaattctcgtgcctcagcctcccaagaagctaggattataggcatgcaccaccacacctggctaatgtttgtatttttagttgagactgggtttcaccacgttggccaaggtggtcttgaattcctgatctcaaacacccaccttagcctcccagagtgcgagattacaggtgtgagccaccgcacccggctagtttcattagaagtaagatacctagtacaaaccagatgatgctgctgttgtactggactggctattccctactaggaatattgtcctccagctctcatgccttaaaaacaataccatcaggacctggtgcatgttcagagtaggactcaaaatgtaaaactacagtgaagagtagccaaaaaaactaaatacttagcttgaaagacctggattatgattgttcccatattgtaaaagctcttagaagagatttctgtataacacagaagggaagtttcaggataacctaaacttcctaccagtcaaatatctctgaagatggagaatggtctgccttgagaagtagccagtaaactagcattggccattttcaaccatagatgggaagacttattggagatgatgcactgcaaagagaatctatgaagttagtaattgtattagatgacctgtaatgacagcatgtcatttttacctctaagccagtgtctctcaaagtcacatttttgtactttaactaaataggctttaagtgcttataggttaccatcccattgcatttatggctttatggtatttctctcaaagaactactttttca

SEQ ID NO: 132357 - DNA, 1967 bp, Homo sapiens
acacttaggtatggtgtagatgtcagttggaaatttggttatggagtgtttgttgaagtggtattatctataaagaacctacaagctagtattgataagttttaacattgaattgaataaaatataatatttaaatccataagaccttaccttgtttgtaacattctgttgattattttactacatatatagcatgagactaaccatatttggagatgttgaaaagtataatttaaagtgaaagtgttaggtcaagttatatgacttgaaagtatactacacacaagattgcatttaaattttgcattattttgggagatgcctcaagagaaaatgtcaactcataacatcctaatgaaatgttttgactctgaaataagaattgatgaaattatacttgggtttagctttcttaataaagaaaatcttctctgacaggaccgaggtgatgagttcacatacactggaagcggtggtaaaaatcttgctggtaacaaaagaattggtgcaccttcagctgatcaaacattaacaaacatgaacaggtactactatagacactgtttagaatttgaacattgaataaaagtttcattataggactgtaaattgtaacttacgttgcagaggagaatttcaaactgggagttaaagatctgaaattaaaattccagtgcctgattatgtaattgtttttcagcatcctaacatatctttatactgttattttttaaatgccataatttctagtcttactgaatacatgtgatatgcatttgaaaatgttaacaactttgaaggaaaggagcctgtgtaatttaagtgaaattgagaataaggtggcttgtctactactccattggtcaaagctaaaagtgacaaactcctttttagagtaaactcagtaatttgaaataaagttatgtttgggagccacatttatgtacataaatgaaacataaggtaacttaatcagatctgtactgaatgtacttttagaatgtctgctaatcagatatcttctaagagttgttaaagggaatgttcatttagttacaaaagtgatcttttctaactaaatccccttaagacattacaaaagagccaccgtgtgctgatctttattctatagaaatactaatgacatctcagctcccgtgggtacagaaaatttattaatttcaaaatgttttattttataaatgcatgctaataccaatattaataagtaacccagaccaccagatagcaaaaatcacattatagtttgtcctgctgaaatttttgtgaacatttcataaagttaacagtttttatatcctgttactaagggtattttgtcgattgagtaaaagtgagtgtttttcactttgagtctaaatcactcagttttaagtagtgtccccttaatttctgattactgtgtgatgtaaagaatataccagtatgatttcaagactttcatgcgtatcaatttacatagaatctctgtttttatgtgttctatattgtttctgatagtaggattatttttactgaaccagcagaggagacaggtcagatttgctggtgaaaacattcttgagacaggagcttagctattcttttctagcaagaaagcagtccttcaagaagagtgtcttaaaataaatattttgatgtgtttttgtcaatgaaaatgtatctcaaatttgcaaaaggactctttcaagttgtcaaatctgaaaattatttttccctttaataatcgataattttgcttgaaaggaacttccttcataactacccaccattgtaatgtacatgttaagattcctttcacacttttggacaatctgataagtaccgctacaatctcattagaaaataattgacaagcagtaaacatgttttctataaagaggagatagtgaaaatgaaatatcaactgaaaacaatttaggattgaattatcagagagactttaa

SEQ ID NO: 132358 - DNA, 3498 bp, Homo sapiens
aatttatagcagtctgtcctcatgggaagtactgtaataggaattaaggtcaaaactgttttagtgaatattcttgacttactgtccttacagcaaagcagaatattcagaagttgcatttagttctggcaaagattattttgataccactaatgtgatgaataagtctaaattttaaatctcaaactggcactgaaatattgtgatttaggtggtgaaatactggccagagatttcatcaagccatggattcttggtttggcgctatcttttaagaagagatgatgttgaacctgctccttggacctctgaaggaatagaacggtcaaggagattatgtctacgtttacaggttagattacatttgtctaggctgcctgtgtgttcataaaaatatacacctcttctatctacatgccttaacactggatataacccacagcaattgactggtggactataaggggtgaggaataagatcatgcaaatagacagaggaaaagaagagaaaaggtagtatcctagatgtcagactgccctgggaccaagggttgtgcttgggaaaagttggacctgttaattaaaagtaaaatatttccaaatcaatttggaaatgacttgaagtgtgagggaaagggattcataaaatttaggtataggaggccctggaaaaggacatttatcctagagggcacagggggtgtctctctggtaggggaagggtggggaggtggctttataagagtggtctgccttctccctttctcacttttcctcaccccttttctctcttcccccgcaaagctgcttccctgccctgccaccacctttagtgctttgtcttttttcccctttgcccatgctcagctgttaacccataaagacttcgttgattttgtgtgcatagtggatggtatggctgcattaatcccttcactgcctgtataccctagaatttgtccctgacactgacttcagagcatggtttgagttcatctcccatcattccccattgttgtgcttcccgtaaaaactgccagctttatcatttcccctggctctgcccacactgcatgtgtaggggctgaactatgggcaagtgtctgaccacccaggcaggtgagtgtgtgtcttctaatgcaagtctgtttctgtttttgttgtctttttaaactcatagaattgattgttgaaaataaggccatcaactgctaaaacaactactaaaataattctttttaatataaaaataactttgtcaaattcactttcagaagatttttcagatgtccctgttgagagcattgttctagataggttatatttgaaactgtgagcagaagcatgtgagcccatctgctatgatgagtaatagtcattgaggcctgaaacatacagtgctttaagcatgactgttattacaaagcatgcttctcccaccccacccaccccctcaaagaaggtagccattgaaacataaggatgatagatagaatgtattacttcaaatctaactcttagctggtggaggatttagtaatttagttgctttaggtcttgtaaaagctcctgccgctaactttaggagatgagaagtttgacccttaatgttcttgatatttttttagatcaactccacaatttactgtgatccaatccatctgctttctatctgttgtgctctatgattggttctcatttaccttcatttctgtattctactttccttaaactttaaggaaatctaatcacaactcctgaagacttacctttcttagatctgaaacttaagatcagtgtattataaaatggaatctcttagcagtcacagctacataaattgggattttaatagttgtctgtgctttgaattcttttcctttaaatgtctgtttcttttatgtaaagtttttcagtttggggaacgtgtagtcttcccctcccttttaatttctcaccaggatctaaaccccccttctctgtgaagcttaaatctgcattgtactctccctcctccccccccatcagtatccagcaggttacccttcagataaagaagggaagaagcctaaaggacagtcaaagaagcagcccagtggaaccacaaaaaggccaatttcagatggtaggtaatgattgcaaaatataaataataataacatacttttgttgttgttgttgttgagacggggtctcactcttgtcacccaggctggagtgcagtggaaagatcttggctcactgtagccttgacctcctgggctcaagcgatccacctacctcaacctctgaagtagcccacggctgtacaccaccacacctggctaatttttgtatcttttgtaaagatggggtttctccatgttgcccaagctggtcttgaactcctgggctgaagggatcctcctgcctcagcctcctaaagtgctgggattacaggcagaagccactgcatccagccaacatactttttaataaagagaaatattaagaaaataaattgagacttaaatgaaagcaaaggatttggctgggggggcatggtagaagatggatcttttgtttaatagtgtcagagccaaatagcaggaaataacagtatcctaaattttaggggaaattagatgctgttttatgttggttatctttctgctaaacattacttgtgccagttaactcttttgtttcatagttctgcttagaaccacttgtaagtctgctgatacatttttaaaataaatctagatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccagtatgtgaagatttttttaaataataacattctgatattaacaaatgataaataattgtctcatgaagtctgtttttcacacatcagtcaaaacttcatccttctacccggttttctaatccagtgccactacctttcagaaataatctgaggcaacacatatacatgcgcctaaatttactttaaacctcttagatgctggattttgacttctctatgcccaaagttactttactttgaggtactgttcctcagaagaattttcagtttgtgaaacatcgtcattttaatctaaaaatcaccacgaaagtttttgttacagttcaaagttacctaaccgcataagtcttaagcagttcagcacaattttcaaaacctacatgttaaactaagtggtaaaattaaccagattatctattaagtattttatgtttctaaattttcattttttcttaatctttaaattaatcacataattttaaagtaaaaaggaatcacagttaattaatgtgtgggctttgtgttaagctgtgttttgcaaacaagcccttcttatcaaatccctaaagttggagtcttcaaatatgaactatct

SEQ ID NO: 132359 - DNA, 1012 bp, Homo sapiens
tcagctcactgcaagctccgccttcttggttcactccattctcctgcctcagcctccccagcagctgggactacaggcacacgccgccacgcccagataattttttgtatttttagtagcgatggggtttcactgtgttagccaggatggtgtcgatctcctgaccttgtgatccgcctgcctcggcctcccaaagtgctgggattacaggcgtgagccaccgcgcccggcctctaaatagaagacattaaatgtgactgaaacatttttattgctaaataatagatggatatattttgggatacatgtgaaattttgatatgttcatataacatataataaatcagggtaattggaatgttcatcactataaacatcttttatgctgggaacatttgaattattctctactagctgttttgaaatacacagtagatgaattttattagcatattatgaactgctaacttttctttccttatccttggatactgttctagaattttctgaaaaaattggaacaatcttttatgtgcgtttgctgtcaggagctagtttaccagcctgtgacaactgagtgcttccacaatgtctgtaaagtaagtagaattccttcctcactttccctgttaggtatgaaggcacactaatttctatacctgtttttagcatgctaagaagcattttccgtgaagcgggatagttgcggaaccttctagttaagaagcatttagttacgtcttggtggtaaatgcatgttttaattagatagtgataataattcaaatatgtgtcatttgagatattctatcatgtttggaattttgaggaggggctgaaatgggaaagaaggtaagaggtcattgctcttgtctgtaatagcttatatgttttatatattatagcgcaaactggagtgttttcattaataaatcatataaaacagtttatacctagcatcatgcccagatgaattgaatattgtgttttcagtgtggtgtgaaaggaaagt

SEQ ID NO: 132360 - DNA, 1033 bp, Homo sapiens
ttttccatagtgcagattcaagcctttatgtttgttcattctgtacatttctctcattaccagtttctggttcctatttaaaagcataagttgctgagtacttacatgctttatgctcagattaaattggatgtttttgtttttaccataggattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcacc

SEQ ID NO: 132361 - DNA, 1582 bp, Homo sapiens
gtatggaaaatgacatagcaaataaattagacctatgttaaaagagaaggtcagctaaatatccaaacttaaggatataatgggcagataaacatagattccaaagtcttctttaagcagttgaagtctttcaaacacaactttgctataaactggtccagatatcaacagcacatagggatgcttaacaggggtggtgatcagggacacgcctcctgggaaatgcctcttttttttaaatggtaatgtagggttggattttaggttctcagaatatttgctgggctgatggtgtcttaggttgtgggactagcattgccacctcctttgccctaagagaaacctcccagaacatctcacagcatttccatcttttgtcctttgcagcccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaatgcctttctcttggtgtactttatagttttaccaccgttacaacctagattcagtgggagctgaagggcaatgagaacacccaacccaatagccattgttacatcatcagttttgccttcgactggctgaagaaacagttgtcttggtcaacagtgaaaaccactttgaccctttttgttggaactgagttagagtgcatgtaactgtactccagctatggaaggtcaatcaaatagcaatttatcttttctcatttaagtccagaggtaataagccaagcactggtgctccttcagttttcccgctctgccctcctttgcataaaattttcatccgcatggtctcaagaaggctgttgcatttccaggcgtctgacatacccattctagttaggattaaaagggaagagcaaaggccaggcgcggtggctcatgcctgtaatcccagcactttgggaggctgaggcgggaggatcacctgaggtcaggagttggaga

SEQ ID NO: 132362 - DNA, 1050 bp, Homo sapiens
atatatacgcaaaagtaattatttgatgttgagggtaaagttgctgaaaagtgtcaatggctctagaaatattttgtataaaaggatcaggactatacaacacatttaactgttgcaagtagattttatgtccgcagaatagaaataatctcatccccagacacctccggtcatatgttcagtaatgccccccacctgccattagccataatcaggttcacaggtgtgtagtgagctgaagataagacacatcggcacagtgtgctaaacatttttatttgtaataagactaaatgaaacctttattgccaataataaacttacccggtgcccatggcttcttggtcctcgctgatacacataaaaagctgatgcacttatttattaaattacttattcatttgtttgggtaaaacaataagctgatgctaatcttgggctgaaacaactttcctgaacaggttatgtgggtcatgaatttattttggacacgagacccttcaaaaagtctgcaaatattgaggctgtggatgtggccaagagactccaggattatggtaagtggcttttgacattcatgccgccgcccatgctggctgtggaccacttcctaaagcacaaatggaaaatgcaggcaccacagtaaactgatctgggggataaatggggagctcagggttcttggcaacctccaaaataatagagaaaaaagtttgcttatgactgcactggtcctgcccttcagaagatattaaaatatgcatcttgaatccattaacagccaagaaaagtgtttaagattaaaattaaaacccctttgagttgcagtgagtgtagtggtaaaggagacagagcaagtaacccatcgaagtggtagagacaaatggcattggagttttatagccacctctgtcatggcgtagctgtttcagctgcttctagagatgaagaaataagtgtagtagttttcacaaagaaaatgcaactttctttgaagcattttgaaagacacggacactttacctgtgcattagtgggtgttcattcagc

SEQ ID NO: 132363 - DNA, 1026 bp, Homo sapiens
cccctacacctggctaatttttgtaatttttttttcgtagagacagggtttcaccatgtcggccaggctggttttgaactcctgacctcaagtgatttgcctgcctcagcctcccaacgtgctgggattacaggtgtgagccaatgagcccagctccacctctttcatgtttattcattctataagaagcagagcagttcgtagactgtcttcaggggctattaattactggagctattcttcacaggcttgagaagttatgcttgctctgagtctctataagtggattcatttttgctgagagtgaggaaagtgggttaagaagaaggagtacatcattatctcatgagtagatactttcctggaaggaaattcatcagttggtggaccgtggaatttgggaagccccggaggaatattggtctatttattaaaacgctgacttaatggtttattcctgatgatggttgtgtggtcagtagctcattctggggagctactggcagcctggacctagagaagaagcctgtttatgaactacaggtcgaatatccctaatctgaaaatctaaaactttttctaaaaatttatatttatttttttgagacagggtcttgcccctattacccaggctggagtgcagttgtgtgatcgcggctcactgcagcctcgacttcccaggctcaggtgattctatttttagtagggctagggtttggccatgttgccctggctggtctggaactcctgatctaaaacgatctgcccacctcagcctcccaaagtgctgggattaccagcatgagtcactgtgcctggcctgaaaatccaaaacttttgggtgcccacatgaggctcaaataaagatctgtaatttcaaataagggatatgtcattggtagaacaaagtgaactgggtcgcacagactttggcctcattaactccttgttacttacggtatactgtttgacgtcgcgtatttctaattctttgtttgcagcctgaaaccaaaacatcaaaaggtc

SEQ ID NO: 132364 - DNA, 1035 bp, Homo sapiens
ccataacaccactttagttaactgtttaggggcattactatatgcaggtttctcctaggctcctagtctacacagcagcccaggtcaataaagattccacaacactgaaatgtgtacataaataccataagctaattatttacaaagtgctatgatatgccttgaaagagtagagtaactcagactgggtagaggcaggatagaatggttgacagcgccttcttgctggagccatttgagatgggcctggaagccagcgtagccgatgagagcctgagtaagcagagacacaggagcaaaccagagaaaagaaagctctctggtctggagtgaaggatgggataggggagagggagcaaatgacaatgaggctggaaatgtagcgtggggccttgaaggccttggaaggctctggacttcacccttgagctggacaatagccattaaaggtttttgagcaggggagggtagggattcatgaagagaccgttacaatcattaagacggcggcaagggggaaacatgccttagaggtagcaaggggctggggtggtggctcacacctgcaatcctgtaatcacacctgtgattgaaggttagctagcctctagggcttacagtagagggaataataggcaggggaacaaagtcaccctggaagtgatgggagggaactaaaaaccaggcatccttttacacattgggctgtgggctcaggacctaatagctgagtcttggaagtggtgaggccccaggaaagaatattgaaggtgagaagccagaacaaaacgcctcaagtagatggctacattaagagggagggagaagttgggtgcctggtgaggggcactccacacctgaggcagctttagaaccctggcagtgcttggcacagtgcctctccctcaacacccctgcctggccctcctgctgccgtgtggctccacctcctccctgcagcctccactccctcctcttgcccacccccgaccccaccccggagcagctgctctcccacttggtattgtctggctc

SEQ ID NO: 132365 - DNA, 1076 bp, Homo sapiens
gggaagaaagtaggccataagaattggtgcagtcttgatttgaagctctttgcagtgatgatgtgtatcccttatgatcacagggactcttaactaccaggacaagattgagcagtttttaaacataagcagcctctactagggacaatgggaaaataaaccagacaaaattgcttccgtggagatattggcccagatcccatcggattcctggcaattatcaagacctctcaaattcatagtaaacaaacaaaaaaatcacaaaacacatgtaatttaagaacaattcttttctctctttagataacacagtagtcagtagtcagcttgccctgttgtaggctttgctactacaataaagaacgtaaaactactattaaaagaagaaaacaaaaatgtattacaggcttacagggatctgacagatatccttgttggaattttccactcatctttactccagagtcatggtgggctgccttcctttgtgggtggagtttatctgggggtgtcttttggttggtttcttcacattcgtgtttgcctgttcaatggctaatggctctttttccctttgttgcagatgatgggaggcaagggtcttaaacaagccacggaaactgcgatattaaatgccaactacatggccaagcgattagaaacacactacagaattcttttcaggggtgcaagaggcaagtatcaactttaatctatcattactttggtttttttcttggccaaactaagtttgacctagatgcgcttttctgacatgggcaagagacttctatttcttagcacatatcagaaaatagtgtagagttcttggaaataactcgggtttattttattttatcttgttatttttgagatagagtcttgctctgtcacccaggctggagtccagtggcaggatcttgtctcactgcaatttctgcctcccgggttcaagcgattcttttgcctcagcctcccgagtagctgggactacacgtgtgcaccaccatgcccggctaatttttatatttttagtagagacagggtttcaccatattggccaggctggtctcgaa

SEQ ID NO: 132366 - DNA, 1117 bp, Homo sapiens
caagctggagtgcagtggtgtgatcttggctcactacaacctccacctcaccggttcaagcaattgtccctgcctcagcctcctaagtagctgggattacaggcacctgccaccatgctcggctaatctttgtatttttagtagagacggggtttcaccatgttggccaggctggtctcgaattcttgaccttaggtgatctgcccgcctcggcctcccagagtgccgggattacgggcatgagccaccacacccagccaggatcttattatttctttggaatgatttgtgaagggagtaatggctgtggtttttttttattgctgtcattgtactttgagacagttccaggaaagtaaagactgagacttcatctttcttcatcctttaaaatgaaaggcgaggatttggccaagaaagaaacatatcctccctccatgtccttctctaccccttttctttcacaggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaactgaagaggcccgcccttagttcccactgagaaaatggatatgtggaaaaaaaaaaaaattctgacttcttgagaggcttcctgcctgagggaactcagacccacgacctgaccactggtggttgttgatctctcatggccttggaaagccacttatcctggcatcagctttatcagctgtgaaatgggggctcaaagggcccaatcctgattacttgggggacagaggatctatgtactgtgaacctctgaagaaatgctgttgggagcccctgcaggagaggagtgacacaatctttttgagactcttattggtgtttgcttttttcctttttctttctttctttctttttttagatggagtctcactctgtcgccaaggctggagtgcagtggtgcgatgtctgctcactgcaacctccacctcctgggttcaagcagttctgctgcctcagcctcccgagtagctgggactacaggtgcatgctgccac

SEQ ID NO: 132367 - DNA, 1034 bp, Homo sapiens
acgtctgtcattatcatctgtcctggataagccaagcagagcactgaagctgtgatgtgggccctgagtccttgagtttaacttccagtctcatgttcttctaaggtgctttctgtgtatcctaactgagacaaggttagaataagtccaggcctatttttattgtactgggataaaggaagattgtattgatttcctgagcatcttcagggaacaatatttagggattcatatggaaactttttttggacattgctttgcaatgacaaataattaaattgtagcagattttaaagcactagtgttcagcctaaataaaaacaggtggtgtctaatttgtgctacaagcatgttgtagtacttttctgtcattattcatagtctgatgatgattttgctctttctttgcttcctttctattctgtaggtttgcctcattccgaaatcagcacatgggaccaacccagcaagtgcccacatggcaggcatgaagattcagcctgtggaggtggataaatatgggaatatcgatgcagttcacctcaaggccatggtacttgtcttctccttagcagatgggagaggccgggatggggagtgctggtggggatcagggacttgatggattatgtaaatgtcttctcttgcattctaatgaaaagtctgcagttcttcctttgaccagagtctactctacccctcccatcaccaacagggagaaatccccgttttctaattccagcttgtgtaaaaaactgaatgaattattcatggtggtagtaagagtactccttgcagaacctgcctgcctctttctgcccaatcttccctctccttctcgccttccccacttaataatcaaaatggcagtcacacttacacatcttcgtgtcaggaattgtaacacaaatgtcagctttgcaaatatccatgactgtgccagccccatcatgctgaattcctggcatcatgcagcttggtttccaccaacccccactctcaacctcccaacctccaggaagaagttgcttagc

SEQ ID NO: 132368 - DNA, 1022 bp, Homo sapiens
atgataggatgtttgaagtttgcttcaaaatatatagttcagcatgaaagtggttagtgagaaatataataggaaacaagattgaccgtaaaccaaattgttacagctggctgacacacacgtcgtagttccttttgttcttcactgtattttggtatagttttgaaatttttcataataacaaaaggctattttcaatgcgtggtcctgagcaaggatatagaaagctccatctttgggtaggagtggttgagctgtagtgcacaaactggatgctgttgctttgattgttttgattgttcaagaccttttgactccagcagagctccttgatgagcttctctcagcgtctggacagtgaccatgtgtcacgtgctggtgaacccctggccagggcccaataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtgagtatggcaggaggtggcgcttgctcaccatggggcacagaggtcctggctctcagggtcccttctgtgggacactccctccaagccttcttggaagcagatgagggaacatatagtcaagaaacaaatttctgtgaactagccattatgatccttgcttccaagacatcccacttgaccattttgaggaaaaacattcagagataaaagacttgctcaaacccagaatgcaaacgtcagccagttggctgtggaactgctctctagggagcagagggaggaagagggcaggaatgttgccattgcaagcatcctctccttggctcagccccggccctgggcctggatgaagggcagagaccatgctttaattcttcagtaacccctgttgtgctgaagcccggttctggtcatagtatgctcaaacaatatttgttgaataaataaattctccattagatgattctcaacttc

SEQ ID NO: 132369 - DNA, 1054 bp, Homo sapiens
ctgagtaaatgccatacactggagggtcttgtttttcttttcttcttttttttcttgaggtggagtctcactctgtggcccaggctgcagtgcagtggtgtgatctcggatcactgcaacctccacctcccaggttcaagtgattctcccacttcagcctcccaagtagtctggattacaggcatgcaccaccacgcccggctaattttttgtatgtttagtagaaatggggtttcaccatgttggccaggctggtctcgaactcctgatctcaggtgatccgcccaccttggcctcccaaagtgttaggattacaggtgtgagccaccacgcccggcatggagggccttgtttttctaggacagtttaagctgtgctcacataaacttggtgtttctgaggctccccgttcactggccagccctgcagctccagaccattcactacttcattttaaacagatgtcagaaaagcactgacctagcctgtcctccatatataatagtttgttgatggttgcttagtctgggttatgtagataagcaattatttttcataagacttttctaccaacaggtggcactaacaatttgttttactaatgccccagtagtaatccttgtgtcacatttgaatatatcatttgcactttttgggttgaaacatagctgatttttatagatgtttaaggccagagagagagagagagagagaaatccagcatttctgatcaagtctttagcatatagtctttctcctacactactggctcatagccagtaatctgcttcttccttcattcctagtctacaccttgattggcctttcaagaaagtcagatgaatagaattcatgagaaaaacataggggtaaatataaaatgtttttcttgaggttccttactgtaggggaaaggatgacattcatattgattgcctgtgctggaggaattcaatttttaaaatatttactaaatacttattgcagaactactacatgcagagtactgttctatatattccctgttgaagaatatacagaactctgagaatta

SEQ ID NO: 132370 - DNA, 1047 bp, Homo sapiens
tagccaggtgtggtggcaggggcctgtaatcccagctactcgggaggctgaggcaggacaattgcttgaacctgggaggcagaggttgcagtgagccaagatcgcaccactgcaccccagcctgggcgacaagagtgaaaccccatctcaaaaaaaataagaagaagaaaaaaataaattataactccaaggtgacggcattaggaggtgggagctttggcaggtaattaggtcatgagggttgtacaatcctgaatgggattagtgccattattttaagaaagaccccagagagctctttaccccttccaccatgtgaggacacagcaagaccacagctatctatgaaccaggaagtgcgccctcactagacactaagtctgctggcttctaggatcttggacatctcagcctctagaacaatgggaaatagctttctgttgtttataagccacccagtttttggcattttgttatagcacctggatggattaagacaataaccataaattttgtcaagataactttgcttgatgtagccaagccttcactggtctgcctagttccttaggacattttgatcccaagggtgtttgaagggcctgaaagaaaaaatgtcaagaagcttatccctattttctcctatttatttgttctacccataaaccccggggagggtttccagcttggtgtagaaaacagccaaataatatttaattaccttttcatttcccactgagcccagcggggcttgcttcagctttttctccataacactttgccactcttcaaatcattcagcagctcataagtacattctaggaattgctagtttagaattatgatgtgatgtttaaggcagacagaaagagtaattaacacctcccatggatatgtaaagtgaaagacaagttggaattattattagctcacttggcttaaaaaattgaggaagttgtttttgtccttaaaaactgcaaactgtgattgttaatgtagacggaggtggccattgcttttcccagaatctccttcatgggaagattc

SEQ ID NO: 132371 - DNA, 1027 bp, Homo sapiens
ggaattataggtgtgaaccactgtacctggccttcccatttacttttgtgtttgtttcttgttccacttagtgaagaaagagaacaatctattgctatataagagtttatgccaaccatacctgaagcaactcattgtgtttcatggaaagaaatctgttttgggggcttttcttccctgaaaagttagcaaaacattgtatttttgtgtaagttccctttttggacaactatgtcccacttttaaatgaagacagtaacggtacttaccttataaggttgtggtggaacttaaataaattaacatatgtatagcgcttagaacagtgcctggcacatagcttttctcatcatcgtcattattattaaagttattattgctattgctattataatatgtatatatgcatttttgttttctttcttttcagcctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacaggtaagggcatttcttttcttattgtttcagcaatctattcttgtatagcatacaccacaaaacttaaaggcttagaacaacaacttttttgtgttattctgtgacttgctagacagttccactccactggggagagcatggctagaaggtgcatcgtgttctccctcacatagctggtgaggagctgtgggctgggagtgcatttgaggatgttcactagggccatagtttttctccatatggggctttccttgtagttccttgagcttccttgttccttacagcacaatgtcggggttcagaatgcgtgttcccagatgaagcatggagaagctgcaaatctctaatggccgaacctcctaagttacactgcatcccttccagattagtctatctattaaagcaagtcacgaggcgagcccagattgaatcggggaggggacaacacctgggt

SEQ ID NO: 132372 - DNA, 1296 bp, Homo sapiens
gtttgtgtgtcttgtgtgacttctgcgttttgtgctttggtaatcagctagggagttaggcagagtgctgctgctgatttcgcctgctgtggcctggttattctggctcagccgtggctcccaagtatttcatcctcataacgatcccgttcctgacttgggaaaagcacactttgtttcctggtggctctgctcccttggcagtcaggaagcagggatgaataattgccaggctgaagttcactcccaagagccctatatcctcttcttcccaaccttcaactcatacccacagtcagcttcttgtccaagacatcctctgaggtttgtgggggtctgtgcccttctctctgagtgtagttgacatattgtccgtggccaaaattgatctgcattttgaaagtagatttcggtgtgtcttatatgtcaggaggatgtgcatggactcatatctacttttggggcccctaattctgtgttttgtgttcacagctaccactctgaaacaaacattgtccggtacatgaagaaactggaaaataaagacatttcccttgttcacagcatgattccactggtagttatttgtggccttttttctcatttccaagctaccccaatcccacgtctcttggtcctacctaatatgctccaagagcaacaaaggggtggccatgctgggagaatggagggttgattgatggactatagaaaatcactaatgtgatacattttggatgttcttcttaaagggatcctgcaccatgaaactgaacagttcgtctgaactcgcagtaagtagctcacttctgtaagtggatactcagcaaggggcagtgttctagcttccacctaagcccagaactagtgaaatctactgggactgtgattctgtgattgaagaactattttaataattctttaccttgctattcaccaatcttgggagtaaccctgtatttctcacgacttcatcatttaaatgtatgggtaaacttattattttttaataaaattaattaaatgtatatggtatttatgcctttctatcctatccctcccccacccccacccccttttaaacctgtcatattaaaagcttttttaaaaaaaattgtttatagttctaaatctcaggtagaattacgaaccttaagccgtctttctagaaatcattcctgtatcagaaagatagggattcaagtcaacagaagatttgtgcaactcgctgttgtggttggcaagtatctctactaggccaggatccattttagcgaagctttttttttctttctt

SEQ ID NO: 132373 - DNA, 1050 bp, Homo sapiens
ggtcttttcagtaaaggatcattcaccctttgctttcttttagacttagtgttttcatatgtgggactgaaatgcacatattttgttcataatactcctctcttcacagtatgactgactttaagataaaggctctgataactgatatacaggttaagggaagaaaatctcctcaatatctgataagtgggttaagggaagaaaaagataagcatgtctagcttcaaaaggagtgtcctgcagccatggaatgttagagttcagaggtggctggcaaaactcgaagccttgtgaaacctgggactggtctagccaccttcctctaagccttagcgtggagataattgtaccctgatattttggaatgatgggattttgtttagcactgtctcccctttgacctctcttgggattcctccagtgatgtggagtttagagttgatgttttccattttgtttgtgtttctgtagcttggtatttctcttgatgaaacagtcaatgaaaaagatctggacgatttgttgtggatctttggttgtgagtcatctgcagtaagtaaaataaaaacatgcgttcctcatcataactattggaggtggtagcaaaagtagcttatcccctgagtgtgagggagaaggggcccaagtgtgacactggtagcttgttgttaaaattattccactgactatcccttgctagtcactgctgacagctggaggtcactgctgtagggctccagccagtattatgcacccaggctagttggaaagattgttaatggtgtttcattgaaagtgcctctaggctggggatggtggctcatgcctgtaatcccagcactttgggaggtcaggggggcgggggggcagatcacctgaggtcaggagttcaagaccagcctgaccaacatggagaaaccccgtctccactaaaaatacaaaattagccaggcatggtggcacatacctgtaatcccagttactcaggaggctgaggtgggagaattgcttcaacccaggaggcggcggttgcagtgagctgagattgcg

SEQ ID NO: 132374 - DNA, 1067 bp, Homo sapiens
aaaggaggaatgtgcaactgagtagaacaattttagagaaaatgtagattatgtgttaattagactgaagctgtgcctacttccagagagtatgaggcagtttagaaggtaaaacacagtattttactgggagtaagacagaatttttatttagcgtatatacagcagaaatagaaagggaacagaaaaagcctggaatgaggcaagtgttaaaatgggcagttctagcaaacagaaccgaataaggaacagtcaaaacagtgatgggggggccaaccttgaggagaaattgagtgttgtttggggactttttttttttttgagatgtcgcatacagtacttagtgttggttggatggatgactcttacattttccatatagttattctgtcataaatactcaaacaaaatgagggatttaaactgtaattagagctcttttctgagacatctgtctgtaacatttctctttttcccacaattaggtgaaaatgaaatccttgcaactctgcatgccatttcaagcaaaaaccagatctggagatcgtatattggcatgggctattataactgctcagtgccacagacgattttgcggaacttactggagaactcaggatggtaatgtatttctcagttcaggaacaggatgactgtgatttgcataattctctccatcctccatctgtccccttgcagtctcagagcctccacactgacacccacctcctagtgctgtctccaatgtccgggaacctaccgggtttctctggatcgagaaatgttcttgctcaaatgttgaggaaatagaagtttcttcccacttccagtcccataaaatctactaggatgctaaattgtggatctggtcatctcttcctcttctgcagcttaatttctgtgctgtatttgagtaagatgtgaaacctgcaggtgggcagattcaggcctttactcctccttggagaccctgggacataggctacttctgagctatctcattgagtcattggtggagtctgggagagaatcttggtccactgtcttctctcaggattccccgccta

SEQ ID NO: 132375 - DNA, 1063 bp, Homo sapiens
cccaagagtattatcgtgtctcctaaaaatgactgatacagtttttttaattagtttcctatggctgccatgtaatatagtaccacaaactaggtggcttaaaacaacaggaacctgttcactcccagttccgtagtcagaaatcaagatgttggcagggttggctcatttctggaagctctgaaggagaatcagttccctgcctctctcccaggttccttggcctgtggatacattgctccagtctctgctgccatcatcacatggcattcttcttgcatgtgtgtctgtgtgtcccaattttgctcttcttataaggacaccaatcattggattacggctgaccctaatccagcatgatctcattttaacttggttacatcagtggagaccctattttcaagtaaggttatattcagaggtaccatggggttaggatttcaaagcatcatttttgggaacacaattcaacttgtaacactcctcttatccatctccctcctggactatagtgctggcctcttactgtatctccctgggccggggtctcccctcagtgacctttccacaccatcagtagaattatcttactgtattgtaaaaagaatcatactatccagctttatttccaaaggctaaactcagtttgacagacagagcccttcacagactgttgtcattggagagctggaccaacgcagaacagggacctgtcccccctgcacaggatcataattgaagccggactcgcctacaaggcactgctaattaatctttcctcctactgggcgtctgaatcattctgcccctaagaagattatttgggaggtgattggactttttgcatgattgttcctagggatgttgtccttgcctatcttctcagatgtgggtttattgcatttttacttatttcctaaactttcaatggaagaaggcaagatcatcttccataaggtagttagattatattactcatgaaactaataacttcaagactctctttccttactctactgtggcaaagtaccatatctctctctttttttatttttttttttat

SEQ ID NO: 132376 - DNA, 1032 bp, Homo sapiens
aggagcaagctggttttgtccagttgaaaggaaaagggtgaggaatgtgctctgctgtgagctttgctctggggggaaaatctagttttctttttcccttttcccatttgctttccaaggtttggatggcacaatcaccttctcagaatgcttcttttactactcaggaggaaaaggctgccactttgggattgaaggaccccatactgtttcctctagaaaggtagctcttttccacgggagaagaggtgtacagtggtaggaattgtgtccttagttaggatttggggttttatttagacatcatcatgtcccttaacttggacttagacactggattctgtgaagttcagtttcaggttggttcagcaggtagatctctgatcatggacttttctgtcttctctccttttctctgcatctattgctatcttgacaccaaagttactcaaactctgggcttctaggtacactgggtttgttctcctgcagatctggccaaagtgatatttcatgagtgggtctgagaaatggcaaccagtgaacaaacatttgaaacaattcagacactcactaggctgtatgtttggggaattctttttattatatgtgggtgtggaagcctgaggtcttagattttatcacagtaagaagcagcttacccctctgttcatcaagtcacagactgtcttggcttctagctgggaagtttttgttgggaagttttgtagtgttgggcaatggatgagtgaatggaaagaagcgtgactagggacctactcttaatggctcgaaaatgtccattaacttgttgtataggggacagctcattctattaactcactttgttctcaacagaaggtaaaattgggcataactaccaagctatcatgagaaccaatccaggaaaactcattagtcccaagctggataggggcagagtccacaggtgcttgagaagtttgggtggtcctatagagactagagtatatatttatcaccttagaaacttctttgtctcatgtttgacag

SEQ ID NO: 132377 - DNA, 1117 bp, Homo sapiens
ttgtaaggcctgtttgagtgtcctccaccccaccatcagtcagtgacttggaagcaggaacagagaaatgtggtgactgagttcagccgaggggaggacttcaaggtccactagtcagctcagtgaggttgagagagaggtggggcagccccacccacattctgcctgcaagctcagtgacccgcctcaggaggctgggagtgagggcccgggctgaaccggggcgcgtgctagagaatagggacgtgagtcgctgtgggcgaatctgtgttgtgacttctattcttcatgtcctcttccccactccatcaaatagcactgtgccttgcttaaacaagtctcagttatacgatgtacggataactttgatctcattttgactcaagtttgctttactttttgtaagtccagagtattcatacaaaaatgcaaactgagaattttagtaagaattctcaatgcctgtatcatcaacatactaactgactgaacaatgaagaaataaaattttgggaagtctgaaattattgtagacactgcattattttatacaactttcttaatagctgcaggtttccactgataaatgtttctctgaggctcacacattttgggatgtagttgaaccaaatgtgagaacaatttatgcattgattcatcatcatgagtctgtgatgggtgagttcctgggctagccatacgtgaaagtttaggtgaattttcattgcaacacattgattcacctgtattttctgagcatttactataagagattacaatttacttggtgtgattctcggttggactgcaaatttctccatatgacttttttttgaggcagggtctcactgtcactcaggttggactgcagtggcatgatcatggctcactgcagcctcaacctcctgggccaaacagatcctcccactactgcagcttcctgagtatctggactacaggcatgtgctaccacatggactaatttatttcattttgtagagacgggggtcttgctgtgttgcctaggctggtctcaaactcctgggttcaaaacatcctcctcccttagcctcccaaattgctgggattacaggcatgagccactgtgcccagccca

SEQ ID NO: 132378 - DNA, 2034 bp, Homo sapiens
ggacactctttaacgtgctttcatgtattaatgtatattacaaccctatgaggaaaataccattaatacttctgttttaaaaatgaagaaaccgtgatattcagatgatgcatgacttgcccaaggtcatagctggtaagtgatggaggcagaattcaaacccaggcagcccagctccactgtccacactccatccactactttgctctctcttcattttgtcctttgcaaggtcgtgggtgtacaaagtggaaaacttctgtcctgactcacctggaatatccagtttacagatgtgcacaaacccagttgcactagaatcaccctgccatatgccaactgccccagtggaaacgcagcagcttcctggcagcacagacgtgggaacactcaagcctgctgctagggcaagggaaggggtcacggaagtgcaatactgaagaatgagcagtgatgctctgctagataaatctgggggaggctgctggaggtagtgggattaacatgtataggacagaatggccggacagaaccaggggaggacgggtggttcatcagtcactaaggatgctccccctcttcttggacaattcagaaagtgccttgacaaaatactttgatcatgaactggctgctaagtaagtcattattcagagaaacaagcaaagctattcagttcaaaatcctgtcctgctcaagtgaatcctgcattccccatccacacgcactcaacaacaacaaaaggactagaaggatatgtgtcactggcaacactgatttctctgaatggtgcccttattagtggttttagctttcctttaattactttgcagttttggaattttctgcagtgtaggtattcattttataattaattcaaagttaaaaattactttatgaccaaagccagttacttttagctatggtatgcctcgctgtgtagtcttttcagtgaattcatctcaaggcaactagactgaactagactgaactaatcatagataaactgcagggattaaagtttacacaaaattgcacattgcttgtggaagagagaggagaaactaaaccctccaatgttcacattattcaactagaactgaggagatgagttgtcagaatgatggacttgtgccagctgaatgttccagagtgatttctactaaatggttaatggagggcagtgagcggagggagggagcattgtgtaatgcagctgcaggtgttggctttgtcaccctagttgggttgcgcactctcctgaactgaccccaggggcaactaggccgtggcagctgttccccaggccgaggccacgacttgtctttagccagatgatgcccattgccaggtcctgcctgtaggccccgcagtctgtgacaaggctttcctttggccattcccgactcattcaattcccagcttataggaattattatttcttctttaggatgattccaataaatttccattaaatgactgtaacagtaaagattagctaaatgagagaaacaaaggctgtaatgagcttgctgtagcaagggagtcagacttgcatattggcagaggagaggaaagctttattgtggaaaaaagggaagcctttaggtgtgttctgattggaggttgtttacaagggaagctgtctgaggatttactagaagtcgggcaactgatgtgattggttatgggtacatgtttggcttagcctggttggtcctatgttggaagtgggacaaaaattagggaagctatcagttattaatcgagttctggccatttggggccaattgttagggaagttgttgttcggtttcctggattgtcactagagatagcaatctggctttctctgtaagtctaacttgtagcaggctggcttccttgattgtttattctaagtaagcgggttagtttcctggacaggtgtgggtgaaagttctatttttaaatatggtctggtaattgtctatttgtatatgtagtccctcacagcagaatctgttttgtccatatatatatatatatatactt

SEQ ID NO: 132379 - DNA, 1171 bp, Homo sapiens
aaccacaaactgacttattctctctctacatttgcctattctcttttctttctggttatttgttcaacaaatgtggagattgcctgctatgtgccagacactatgccaggtgctagaggtagggatatgggggagcagaacagacgatgttcctgcccccatggagcttacattctagttgtagcatcttagaatgatgaaataaggacatttaagcacagatccaaaggataaaaataaaccagtcttttcaagatatggggacagaaagaatagcaagtccagcggcctggaggctgacctgtactttgtggctgggaggaataggaaggtggtcagtggacttgtctggctatggtaaggcatttgggattttaagtgtagagggaagcactgacaggcttaaagtgggagaggaagatatggtggctgtttgtttctttcttttgctatttttgggacattattttgaaaagatcacactggctcctacatgaagaatgaattggtgttgtgggggcagagcacaaataaagcaccttgtctgggatagttatatttatctagtgaagagccaatggtgacccagaccagtgaagatgggagaagttgtctttggtctggatatgtttgaaaatatcatcttatcttattcttacgggtgccagataatattcttaaaaaaaaatggtagtgacttaagccttgtgggtgtaagtgacatgccccgagtcataggggtggtcagtgaggtgctgagaactcattgcacatttggatgcataggtccaaagtaagatctttgaaagagagatccactatatgatataattcatcgtccaacttgagatggtttgtgtgtcccttctataatgtaagtctattttaattaaaaaatttcccatggaagaatatatttcattgcacttgtttcaatttattattgttctaaatgttaaatttataatctgggtttctgtagacttgtcaatatcactgcataaatccctgagtcctgacagagtctgctgccaggccgaaccactcagttgcacttatgtaaagggttctccttgaaatccccagctatggaggtcagatagcatggaaaacagaagatagttgaggagagagcttccagaactattgggattggtgttcaactcctcct

SEQ ID NO: 132380 - DNA, 1316 bp, Homo sapiens
gggtgggtgagagagagaggaaacaagataaagagaaaacaaacagaaactaaagcttcgtaatgactttctcagatgagctatccttagtttaacttctttattgggttagctcatcaaaaaaaaatctcatttgggctgggtgtggggctcacgcctgcaatcccagcactctgggaggccgaggtgggtggatcacttgaggtcaggagttcgagaccagcctggccaacatggtgaaaccccatctctaccaaaaatacaaattttagccgggcttggaggtgggcgcctgtagtcccagctaatcgggaggctgagccaggataatcacttgaacccgggaggtggagggcagaggttggggataaccatctcttctcttctctgggctctgaatgcagccctttgtcctgttctctcccacttttgtttccggaaaacatgtactgtgttccactgaaattagtggagtgtcttgtgaggtagggtggcacgttcagtaactttagaagaggaaacagcagctaccctcacaagggagctgcatgcacacagagcacacctgcgtcgctgtctgcattatgtaactgaataaagttaatgagaactatgattacaaaacacacctgagtccagaccgtgcctcatttttaaaattgagactcattgacaaagttggagacattaatttactcaatcctgtgataatttcctattactcattattaggaatacaacgaactgtttcaaatcatttttgccatctttgacgtcaagtcacataagctcagttttacttactttccctcttgttctggaagttgcagtagtagcatatgtataaaactgtaccgaatcaaatcatattataaaaatcaagactgcattaatgaagctggtttgctttgggggctagtcctggggaaccgagccacccatgatgttctttgttaatgcactatttttttttttttttgagacagggtcttgccctgttaggctgggtggtgtgatcgtggctcactgcagccttgacctcccaggctcaagcaagtagcctcccaagtagctgggactcagcctcccaagtagctgggactacccacgcctgggtaattttttttattttttgttttttgtagagatggggtctgctgtgttacccagagtggtcttgaactcctgagctcaagtgcttctcccaccttggcctcccaaagtgctgggattacaggcatgagccactgtgcctggcccgttaatccactattgacaagatttaatgaattggtcttaatttatgatttgaagaa

SEQ ID NO: 132381 - DNA, 1020 bp, Homo sapiens
aggttggtgttgaactcctgacgtggtgatccgcctgcctcggcctcccaaagtgctggaattacaggtgtgtgccactgcgccctgccaatttcatctattgagaggcaggttaacataatcgctcagtgtgaattcaaactgttttaattagaatttcagctcaagtagtctttagccattttaacttcaaattattttacttctgtgtgtctttcaattttatctttaaaatcaagatgttaatagtacctactcaaaatgagtttaatacaagtacagtgtttgggatagtgagtactcaataaattttgctattgaataacatcatattgctttattgcaaatattcatcttttttttttttttttacacatttgtcatagagatactgagaaattcttcagttgtagtttatcagaatacttaaaagctaaattacttggagtattttcaagatgatattttatttcattattttatttttaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaagtgagtagaatcagtttgctatttctgtttccttcaaagatttatgtaaatatgttaagaaacaaagtagacagaggagcttataaatgaaaagcaggagtctcccatgcaatttttcacccttcattgaactgtttctgttttctgttctttaggtggttgctgaacatttgacttaaagaaattgctctttattttattatctcgttcctagcagttataagtggaacttcttatcctatagttgccatgagttttcgtttctacacatgattcatgtttgttgggcagtttttttggtgtgtgtttgataatgtttaagccttaaatgatttatatgtattagaagattagt

SEQ ID NO: 132382 - DNA, 1056 bp, Homo sapiens
agggacacaaacactgcggaaggcctcagggtcctctgcctaggaaaaccagagacctttgttcacttgtttatctgctgaccttccctccactattgtcccatgaccctgccaaatccccctctgtgagaaacacccaagaattatcaataaaaaaaaaaaaaaaaaaaagaagtggcacactgttacatctgccatattctgtttgttacaagccagttgttaagtgtagctagcctacactcaaggggaggagaatgaagctctacttcttgaagggaggagtgtcaatgaatttgtgggcatatttaaatgttgtcacaattattattattaaacttcttttaaaaaattctgatatgataattaaggccccagatgaaagcataaatcttacaaaaacaaaataaaaaaacctgaaagaccaacaaaaaatcatagtttccaaattccctggatgggtgtgaatgagattaagactttgaatgaatttaggtatcttcctttaaaaaaattatatttgacattgtaagcacatgatgctacttgaagactcttatttctgcatgttaaattcctactgtggaacattctggctattccaaagaaattgaaaattttatatttgatataatttgaatcatttcttttgaattttttgggttggtattaatagagttttattctttcagatcttattaatcgagaacatgaaactttcaacaaagattggaagcattttctttcagactcttccagaattcttttataagtgcaatgctgttgaaacaagattgcagaggcaattaaacctgtttacaagtataaactattgactgttttctgttactgtgttttagtacccatttccagtgtctctcttaaagtgttaattgaataggttaggtcattgagtagtaactctgcttggctcctttgatatttcaagggatacttactaaaaactattgttaatactcttgataattgtcataactgccataggaaaggtacaaagtgctatgaggtttcaaaggaatacaaggcttctgtggt

SEQ ID NO: 132383 - DNA, 1604 bp, Homo sapiens
aactttgcttcattatattctcatttgtttctttctttgcttattttcttcctgaagaaacattggtattccttttatgtggtgagattattgttcaaattcctaataatacagagaagtaagtgcttttctgtaatttctatgtgagagataaccattaataatttggtgtacatttctttctaatgacttaatatacaattacaggttttttaaactgtaaataggatatagtatacacactattatgtaacctgatttattcactgtggatagaatttgatgtcagtatcttgaaagagctatcttgttttatattctgtattttttttagctaattactagttgatggatataaacttgtattttcaattaatgctgcagcaaacatcctgggtcaactgttattgtacacatctctctgttgttagggtgaatttctacttttagattttgggtcagatatgtcaatttttaaaaagctttttatatgtttagaaaaattatatgctggaatggttttgccagcttatattcccactctagttgtctaagaggtgtcattattttcttgccattaatatattcagcatttaccaatataataactgcaaaatatcttattttaactttactttcttggatttttagtgagattattgtttgtcagtgtttctctaagtgttatgtcatttttatataaatatgtaaaatttcttagcatagtatagttgattaaagattttaaaaatactttaaagctgaaataatgacttttaaactgcttttctgcttctattgttgttttcgtgaaagtagttttctaataaaatgtaaagtaatattgagtattcagcaatcttaagactattcagatagctatgtaaatcagtttgtatgtttacttgttagaattgacaacatgcagtattttcgttttggtaggattttgttttagaaagtgatttaaatcaatttggtgggaaaaaccctaaaactgacttactggtttgtacatttttgtcatctaccttttacagatattgtactccaagatacttggattacgaagatttggagcgcaagtactggaagaacttaacttttgtggcacctatctatggtgcagatattaatgggagcatatatgatgaggtacattcatatttacagtgagttttgtaaagatcattggatgtgacagttttgttaccatttaagcagtttagaagtgttcttttgttgtgcttttgggtgatccataattcctcaaaggacaacaggaaatattcatcagtaggatttctgctgctggtatttttcaaactgaagctagataatcgtacaaatacctgaaattgttcagtagtaacatggtatgtggttatctggctgatcttttcattacattaaaactttttaaagcaaaaatacattataaaaatgtttggaaaacaggaaatatgatgcatcatactgacaccttaaagcagaagcagtattttagatatatttttccagtactttccctcaatcattaaaaaaatgttatatttgaacaggcttatattgtcctttttttcacagacaaattgtaatatata

SEQ ID NO: 132384 - DNA, 1631 bp, Homo sapiens
agttcgagaccagcctaggcaacatggcgaaactcctgtctctactcaaaatacgaaacattaggtgggtgcggtggcctacgcctgtaggtccagctgtgtggaaggctgaggcataagaattgctcgaacctgggaggtagaggttgcggtgagctgagattgcaccactgcactccagcctgggcgacagagtgagactgtctcaggggaaaaaaaaaaaatgattgttaagttctaatcaaaccagaatcttttcctatcaccttaactcttatagtagtgactctaaccttccctcgctctgccatcaccatccatattgttatactgttataaaactacattattccagcagttttaccaaagttgggataagtatttttaataggcattatgtgtttaaatttttccattaacataagaggtaaatatttatttgaagcatcagtagaagcacagtgatcagtggatactgccaagagtttttccaataattagagtggaactttaaggaaacaatgtattacatgctaagattgaatggatagggatgggagagagatagcagaagatatattttgctgttggtttcttgatgtgatatgtgatggtgaatattacctctaaactaatgtgcaaaaaaatcccaagaaaacccaaatctcaaaaccccaaaaacaaaaaggtgtgccaaggagggagagcacatgccggatcatctactttgaatcagtaattttttgctgacagccaagttgggagtgggtctgtaactttcatttccatttggcatcaggaagctatttggtataaatttctaccagatagttgtatggaaccacattatgctggtagtaatctttgaccaataataatggacatatgtatgtggctcttgaataagagttgttttatttttcagttttcagttagttagaatatacaatgtaataattttggtggatagtggtttgattagtaaatgctatctttcatggtttagtaagatttgatttctctctctttttttctctctcattccagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggcaagttacttgtttaatattcatttactttggagttttgaaatttgggcatcaggcacatattgaagaggattttgttctttgatttggtggattcagatttatgtgagctgtaaggaagtttttgactgtaatagttaattgtcttctattctgtctgggattgtgcttggaaaccataaaccccatggtaactcgtacagtcatgcactgtataacaatgtttagatcaatgatggaccacagatacaacggtcatcctgagtttataatgcaattgaaaaattctttttccatgtttagatatgtttagctaaatgaatactttgtagctaaatactttgtgttaaaattgcctacaatatttagttcagtacaggtttgtagcct

SEQ ID NO: 132385 - DNA, 1435 bp, Homo sapiens
ggttaactggatcaccgatttgagccacccctcagtatccatgaactgttggttccaggttccattcacaataccaaaacctgtggctgctcacgtccctgatataaagtgcgtggtagttacccatgcacatcctcccctatactttacatcatttctagattacttgtaagccctaatacaatgttaatgctatgtaaatagttgttatcccgaattgtttagggaatactgaccagagaaacagtttgtacatgttcagtacagacacgaccgtttcccctccacgtatttttgatctgtgattggttgactccatggatgtgggactctcggtgtggagggctgactgtactagaaaagtcgctttactactgcatgtattatatgttgagtattttggagaggtcaggaaagctttttaaaagttgttcagagttgatatcaactaatttagaataccttttttctcacgaaaaatagtgtgtaaaacactaaattattttctacttagaaaatattcagtagactaggtaatataaaatatattatttcttgaaagtcaagttttgtgccattgtcttactagattttataacaatgatgttaggtaatggtaacttactaatttttctgatcgctcggggaattaatttacatgtatatggttatcgaattgtatttgaaattccagattaaaaagaactgcccaactttccaaagcttagttattcccttcttgtaaggattttttctcactgtggcttccacagttatgactgcctgcacatatggttgctagggtttctggttttcatctgaatgttatgtcaggaaatgggccatgaatggcattaagggtgcggctgagctctagctgagttccttttctcaggggcttttaatctcaggttctgtagggcctcatttcaggcacctcattctccaggccgtactcttagatgcctagcttacaaggcaagaggactggcatttaagtgacacctctttacaaacatgtttattgttactgttttagcttagattacttggggagttcactctgagattgtgtgccagggctttcttgtatagtgctccaggaataatactgctcacagtgggggaggcagaactgggcagaaggggaaggtgaactccagcagagtcctggcagatcctaagggcagtgctggagctgacattgcccttcagaattgccccaaattcaggcaagatggccaagcctttatactcaagcctggaccatcccttgcatgtgggccgccattccctccctcttcaaggggtatgttcttgggggagggaacctgaactcatgaaggcagcaagggccttgccaggagtgggacttggcagcctgcctgcagcatcccctatagccatgctttctgttcctcacgttcatctgttt

SEQ ID NO: 132386 - DNA, 1116 bp, Homo sapiens
caagaactcccttgcatcccccctgaaaaaaacaaccacttcaggtagtggtttgctggtcttgttctttgtatctgcggtttatttaaaatgccattgtcttttgcttgttcattgtaaggggggtttttcccttggaggacagatgggccctgtcacttctttccttttgacatcttcatagtgattgttggggaaacagtgttggaaaatgggtttggagagtagatcttgtactttggagttaagataggtctggggttaggtgccagctctgtcatcactttgcttgagtgaagagatgcctgtaaggaagctttggcttcctcattagttaaatggaggtagtagtagaacttgtattataacatcttagcataagctctggtgtgttatcagtgctcaataaatgatggctgtgatgagctgtaatcatattattggtcagttcttctttttcactgtgtttttgaacactttagtgaaggtagagggcaagtcaggcatacaagcttatgcgaggaatggggccgggggatcattttggggttgttatctgttaaaaaattgtccttgaggtactgggctttcttcttcacaggggatgattgtgagcaaaacagcaacaacaagcagaaacataaataagggaggaaatgactacttcacacggccttagttaggcgcagggagtatagggcaggcttgttttaggactgacctgcctgagcatgacgtgggcctggaaggaattctcccctctgtggtcctggatgtcacaaggtgagtggaagctgggacatctgtaggtgctgcagcccctgttggtgacagtgacagagggacctatggcagctgcctgtgacagccctgtgacagacgtctgggcagtgggacaacagaaaccatttgttcctaaacacacagccccagggctcccaaaaaacaatagggaattttgagggagtgatctgagaagtaggagttagtctttgagaagtactggtaaacaagtaagtggactgagcatattttgaaagaagtacgaagagggcagttcctagagaaaacttgaactagagaaagtagattttcataagtatagatttacttact

SEQ ID NO: 132387 - DNA, 1034 bp, Homo sapiens
ttccatctaaaagaagaaaagtagaactaattaaatcatttggctaagataggaatagctgcacctgggaaatacttgtagaaaataataggccagtaagcctacctaggaggagaggaatgaggagattgaattggtatgattcagatcctaggagtaaactgaggatcagagtaggagtagagccatcttgccttactttttcctcctttctgcagataaggatagctaaattttctgtgagcatatggttgaactttagattgaggagctttaactttaccaatttttcagaaaaatgaatctgcatatataaatatctccatatcctacctttttgttggcaggcatattcatattacatgtatgtgtgtgtgtgtatgtatgtgtgtgatgaggaaggctgaccctcttgtttggaagggacatacccccacacccacacccacacccacacccacacccacaccccttttctgggtatatttgtgatgtaagccaggaattaagaactggtaagaagtggccataaatatacattgggtgatagtcatttagttatgctaaaattttgtcttcccatttcggttggaacaatttcattagcagtgccttaagcaacaggatatatgattgaattttcttttagtgaattgcatagttatattggatccaattaagttttgcatatgttatcagtagcattaaatgaaaccaagtgtggtgttaagtaaaattagttaagttactttagtaagaagtaacttgtactaagtatatattgagctagtaagtacagcaaatagaggtcttcaaaagtatagtttatatgtaaaacatggaatgattattcaaatttattgttaatatcctcattaaatttcctcattaaaatgcctttacaatttagtatttgtataggatattatgagattgttgttttaaaatttcttagcaagtccatagtaaaaataactatggaactagaaatgagtatttctgttctttaagggtgaaaattttttgctgtaatc

SEQ ID NO: 132388 - DNA, 1057 bp, Homo sapiens
gtttcccccaagggttatgtcactgccgacgcccagttcttctgtggcccactgggactggaggtgtgcccttagggaagtgtgaaggtgaatggctctgagtaacaatacacatgagattttgggccttcttggactggcaaaattaaacttactttactgcaggttgcatttttatttttcatggcctgctgcttcttctttagggccagaataaagaacttttctggacctctattgatgatcctgtgcctgcttttgtgtgtgtagacaatgccaatgcaagcagccaccttcctccttcctccttttttttaaagataagccaggcggccttgccctcatctacttacgtatgggaagcagagtcacattcaccccctgccatccttatcttctgttttgctagccacccttccagaaagaagatgtaggctggtagtgacttatttccagggaaaagtggagttccatttgagtgacaactgaggagcaaggccttctgcctttatccaggattgagtcctcagtgagcagtgctcttttagtccagtgcagatctaagtttcattggtgtgttaggtttgccttctattaggaaaagaattttgttcctgccttatatgtgctttcaattaataatgaaatggggacactgagaaacctcattgcttgacttgacagtttttaacagaaactgttaatggcacctaaaggttacttttccctaaattacagaagagtattagaaggaacagttatagtattacattttaagaagcattattataattttgtcaggctaataactataaagtgtctttttaaaaatgtaatacataatagtaataatagcgattgatgtaattgtaatcttgaactttgttagggactgttttcatgaataagttttggataatagattagagtagagcttataagatgattactgtaacacttaactacgtaggaagtgaactttgtgttaagactatattctcaactgtcttcttctctgtaataaaatttttccaccattttctattaatcttgctac

SEQ ID NO: 132389 - DNA, 1052 bp, Homo sapiens
tttctgatataaacttctaatgctttgacgtaaactgtctgaaaatgacattccagaaaatggttaccgtttgtttaatcagtaagaggttaatgaacttgaaggatgaacaagaacttgaaatcagttgcctgtttattcaaaactcttttgcagcaatattttgaggaataaagcagggaaaagaccctgcaagatagtgaaggatttgtatctgatgaccagatgccagccaaaataattgaattctgctaaataattaaaatgataaaataatgcagtgcgaatgatggagcattttagaatgtctagctgatagcaacacttgattcataaaatgaaaagtaggctcagatattttccattatcttgtctgcgcatcataattatcacacttgccttttatgcatgaatgctttcatctttggtttctattgaaatcttgattgactgtggcacctacaaatattttatccaaaagacattaggcctgcatctaataaagccaggagtttgatttcgcccttcagctgctttcttatttatacaggttttccccatattatatagacataaatgtaataaaaatctcaagtgaattgttacaatttttatacttgttatattcgtctgtaatgccattgcattctttctaatttttggtttgatacaattggattgcaaatatggaggagaagagagttataatgttaaatcatgaatgacagtttggaagattttcagtttttaaaatgtctaaatctcacctattttagaaaaaagataatattgctgttatattaagttaggtaaattgagaaagtgtacagatttttgtgaaaagtagtatttcatatttcatttgtcctttattgggaataaaatgctattattttaaaaaactgaaaaggatttactttgaaaattttggttactcgtccaaaatatgtgatttaggactttgtgcagccagttttgaaagtgtgaacaattaggaggaaacttatttcaaaggacagtgtagtggaagtgagtcaattcttttagatcct

SEQ ID NO: 132390 - DNA, 1017 bp, Homo sapiens
acttccctaaatattttctccatttatcagataatagattgaatccacatttgtttcaaattgaaatttattcctaaagttgagtaattttacaggttacaaaaacaacttatggtaaatctgtttgtaaagaagatcaacctttggtgatgtatcctttaatttttaagaattctaactctgactctgagttttagtacaagggctttttggcagaagaggtccatacttgcataagtcaaacagtaagaacactagaacttacacattaaaaaacctatttgatattttctcttaatcgacacagtgccacttacatttattgtttctttttaggttttttcccaagcagctcccaagggtgtgatgcatttcttcgccacaagatgacattgatttctccatcagtattgaagaaatatggtattccctttgacaaggtatgttagtattcatcttacacaaattaattttgtttgtgtaggatttgtatttaagaagtaatgtatctttaacttccagtagaatttttaggatgtgggtagagaaattcaaatttatgttttatagcatatcaattatttatctaaatcctaattagaaattaattttatttcaaatatatttactagagatttcatgttgctatagttcacttataattgtactgaaaataaaatgtagcacattctataaaataagaggaagcacttctatattaaaatcttttttatgagtaacataatttatgtatatgtgatctattttctaaaaatttcagagcaattattagcaatgggttgcttagaatcaatgattatggtagcactatgttgcttgtaaacacatttagacataatacaatcgagatttcattatggataaaattgcctgatgatttaataatctgatattgcttctgcgagttttctgaagattaggttctataaaactcagtagatgctggatcccacattctttgtgtctgtgggtggttattgggtcagaattattgca

SEQ ID NO: 132391 - DNA, 1007 bp, Homo sapiens
ctgccgtgacactcacaggtctgcttcctggccaggttggatcaaagcgccggccggcaggttgtatttcatttttccgtttgctgggatgaagtgcagttgtttgatgttaggtttgatggatttgtttgccactgcattcattagcttcacatcaaaaaactgacaggctgttaaatgaaactttggcttagattttcagcttgactgtttggagacatttgtgaagatattttgtgtttgtgtttcagcagcctcaagcactatgattgtctcgaagggaagaaaagttatttactgtactgattttcttgagtaaaaaagaatcattgtcttggggacagtcatatctcgtttataccgtctgaagcagtgtatttattacagtgtgtgcagtgaaagagacttactgtgtcagaataaatattatcttattggaaggaaaggtaatagttggtgacacaaaaatgatatcttttattttaattttaagtgatcatattaacatgatatgtcagaaagttgaaaaactgtactgcagagctgggaatgttctcttataaactccaggagtactaccttactatctaattttaagacattttgatacttgaatcctcaaatgtttgaacaagtttaaaaagagatgatagaattttaaaactgatttccctttaatctggcaggggtttcaactattaaattgtctagcatgtaagtgccatgatgtgggttcattctattttatatttcaattctctaaaattaagttagatatttcttaaatctggtagcatccttccagaaaatctttaatcttgggcagtctttattaaaacaatcagggatcatttttgtggtgagtctctaggttatattttaatatgcttttgatcacaaaatactagtatagtgatatttctctgttcctgtgacatgtgaaggaaagaaaatgtagactgctttgagtattgttcattttaacagttcttggcatttcaatttta

SEQ ID NO: 132392 - DNA, 2012 bp, Homo sapiens
ctatcagttaaatcttggagattatttatgcaccaccatttgaatgataacttccctgttgcgtagtgctggcctagacctgataaaactttgtgtgaagtctttatagaaaacttgcttaataagatgtgactgataactatgtattcatgagaattaaaggcatagtagattcaaaataattttttctttgaacttctcacctttaccccatgtcttcattttagtggatatgtttgttgttgttgttgatggtattggatgttgtatgtgatgtgatgtagaaaaggctgttcatttgctcctaattttgggttaccttatgagagttcgttaataaccataaatataataaaatatatcttagagtaaatttatctcaactcactggttaaagtattctaatcacacattcattgggttattttatttgttgacaacccaggttttcagctttacagaccttttagcgctcagttcattgacacatcattgtgatgggcaaataatctttccattgcaggcgtgcttccaaatgagcactctttccttttagtttttcttagtacatagttccctgtgaggtccacaaaccattataaccacattataaatgtgaatatatagattctcatctctattcagaagaaattgggtttatcacccattgaatgtttgataatgtaatgcattatcctccattatgtagtgactaagtattcatggatgatgtgttcaaggaccaactctgtgttactgtatagttagcgaaacgtttaacactctccaacccggttgtgtttcagtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaaggtaatgacccctcaccccactgacctgccttgcctgtcgtgttttctcagttaaaatgggtcattggatgtggcaatttacttgctttttctatttattcatcataacttaatacctttctgaaaatgtgagacattatttttaattcttaggtgtgtaataaatacaatataggaagagatgtatatttattttgtttgagaatattcctgaagttgctcgacatggcaaatagaacaatatagaacttgttagaccacttacatgaatgtgttttatggttgtattattcctttctgtgcatttccatattttaatcaataacttgattttccactttttcattttgccaccattttgctttttggctttagtggttatcttcttcatttgtccaacatctgagctactgctctcttctggatgcttatattttactacattttatgcacatggttttattcttttgtaagatgtaaaacacagcatatagcatttctgtaacatgcttatccttgtgaactttattctccattccatctttgtggccaggatcatttcaaaagcttttagatgtgctgtgggcatcttgttgttttaaaacctattgaatagggtgtgtgtggtgttgctcaggtccttaggctaccttttaagggtcttatgttttccaattttatgttaaattttcctcttcaatattactcattgtttttctttcagattataaaagtaatatttgtgcattggaggaaatttgtaaaataaggaaaagaataatgaaggaatcccatatcactcataacctcactatccagagataaccagtattaacattttgtatatatcctttacctatatatttattatatattttataatattatatatctttccaaaattggggccatgctctgttaataatctgacaatcagttttgagtgtttttttcatgtaactgattgatttgctgcaacatgatttttaatgcctgcatgtatttaatcccct

SEQ ID NO: 132393 - DNA, 1050 bp, Homo sapiens
agttctgtcactacatggttctttgcacattgatctccagattttgagccctggcataatacttgagtagaagaactgggttgttcagtatcagagctagtatgtgatgggtacaaatgaggtttgttttgtgtgtgtgcatgtatgtgcatgcgcatgcgtgtgtatgtgtgtgtaagatacagaatcatttgggaatagtttaccaattctacttagtagtaatacagtgcatgatttattaacagtcttctgttttatcctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtgtatgtggcaatatccattttttaccatattcattatatggtgagagcacattttgaaaacaacatgctgtgcactgaaatcctcctttagggcacagataaataacattttacatttatgggtcttaatcatattcattcaataactgggaggtaagcctcctgtgagctgtggctcacatagtgataatttagcacatggagcttatggccacgtgtcgatgcttgattttcttttttttgttaaaaaattaaactctttactttgaggtaattgtagactcgtatgcagttgtgggaaatagtgcacagtgattctttgtaccctttactcagtttctcccaatgctaccatcttagaaaactatagtacaaagtcacaatcatatcgacattgatacagtaaagattacagaattgttctgtcacctgcagaagaattcatctgctgggcactgat

SEQ ID NO: 132394 - DNA, 1036 bp, Homo sapiens
aatacaaaaaaaattcgctaggcatggtggtgggtggctgtaatcctaactactcagaaggctgaggcggtacaatggcttgaaccctggaggcggtggttgcagtgagctgagattgcaccattgtactccagcctgggcacgaagagcaaaactccatcttaaaaaagaaaaaaagaaagaaaaagaaatatacattttaaagacttgactctctaggggtattttatgagaagatctgactagggattttcttttatatccatgtaatgccagtatattgcttggtactttatagctgctctgtaaatgttaattgtaataaattcttgaacccagaatttaattcaatgaagttcagttaaacttttattgagccatgtactatgttagatgaagaaagtaaaaatattggcaaagtagtttctggactgtgaattcctctcataactagaagataatctcatacacataaacctgttttagtattggagcttttaccgtagcagtagagacacggaagaagtaatgtgggaaggagggaacagtgtaattatttctggtagggatagggagggttacaaaatgagggtggttgtctggccgtgggatctgatctagtctttgaggcttgaggaggattataaggcaacttcccttatcctggctctctcaggatgtatttgaaagacaaagtaggtttggtttccggccttaatatcacagattctgtggaatgtttatttcttttgtactcagggtgattgttttccctggttcccatgctcatggtattttcctgccttctcccttaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaaggtaaaggagcctgctatcatagttcccttcactgctct

SEQ ID NO: 132395 - DNA, 1632 bp, Homo sapiens
aacattgtgttttgggttatatttttatttatagaaacaaatattttattcaagattatgtctgtcttagagttccttataaaaataaactgttctgttcagacatttcagagcaagaaaatgtgtgatatctcacattttcagacctttgtaacagaggaaataatttattcccttcatgttttttaatgtggcactggtgagtgacaaacattatttttctcttcctttagtcattaaatttctgggttttaactacttattgattcttatttctatattataatctgtatatttctcaataattaaaaaattcaaactaaaataataagatttgtggagatttaatataaagtaatacagtataaaacataaagtaatataaaatctgtaaggtaattcattacttatactttcaagtaagtactaaactttttaaaatcttttggtgtgaggtgataattttgtttgatacattatcctttcttatttagtgacatgtgccagttctctctcacttgctttcaaatactgcaagtgatgaggcaaaaattcttaaagcctctcttaatactgctgcacagattaaaactggggtctttgtacactccttcaagtgtagcaaggtatgattcttcagtaaatgaaaacagatctgttaactctagtgcatatgaagaagcaaaagaattgatgctttccacgaactaattttggaaagacacagttttagtagccagttgctttcttatatgaacagacatatagaatattgtccttttcctgcagattaacatttgggtgggagtctgaggtggaatattgatttaaaaaaaactagtagtttggtcaaggagaacaacaggaagaacaaaagttagaagttagtgtctggaacaggagttagtggatttgagtgactagaatgatgagctcttttccatgtttttcactcatgtggaaacgttatgtttttcagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagtaaatggatctataattcatcaatcactggcttttcagcatttcacatcatctttatttctcacttttttggaacctgtcagatctgttgcatggactattggcattcttaatggttatatcattctttttcatatttctgctggtaaaagtatgagttggtatattcatccttttttcaccactttcatgtagtatccgtggagagcaggtctggttttttttgttggtttgtttgtttggggtccagttgaggagtcatgatggggttcctttcacatgtttggattttacttactttaagatctagtttataaaaacttaatttgaaagtctgatactgattgatgactgcttttctttgtgacttttaaaagagaaatgaatgttcctttggttgttctgagaattgttgtactgagttaactttttttcattc

SEQ ID NO: 132396 - DNA, 1160 bp, Homo sapiens
ttagatagttattttgggtcaggcgtgaactgaatagacaaatcgaattgaaaatactccttcattgctaactctgaatttgcagcatttgccctatcattgaggttaaaggtagttagacttaatttttgaagcaattttaaattatattaatttaaaaatattaggttaaaatgtatttattatattatttttgacatttccttaaactttgccccatggattgcaacttattttaagatgtctgtgtgtgaacaaattagtagacttgacagtttaaaattttattacccattcaagatgttccataagtattcactgtaactgttgtgttagttatcagtaagactcacattcaccttgcttatgttttgttctatacagtgagaatcaagacagtatggtaggctagtgtcccatttttatttatttcagtactgagatctgcaatattttaaaggtgaaaaagacctaacgcatggatacatactattattttataggttgttatggtattccttctcatgagatctgtgatggatggctgtgtgcccggtgcaaaagaaatgcgtggacagcagtaagtagcttattttagtattgcttaacctttcttcccaccctacccactgtggacacatttaagtctagggaaaagataagattgctcaggtgcttatatgtgcagttctgcacttccttgtgtttctagtcttccctctcaaaagcatcttacctgctggttctatatccattatagaaatattaggtaaatttattttctttttttttttttgagacggagtctctctctgtcgcccaggctagagtgcagtggcaagatcttggctcactgcaagctccaccttccaggttcacaccattctcctgcctcagcctcccaagtagctgggactacaggcacccgccaccacgcctggctaattttttgtatttttagtagagacggggtttcaacgtgttaaccaggatggtctcgatctcctgaccttgtgatctgctcgcctcggcctcccaaagtgctgggattacaggcgggagccactgttcctggctttttttttttttttttttgagatggagtctcactccattgcccaggctggaatgcagtggcgtgagctcagctcattgcaacc

SEQ ID NO: 132397 - DNA, 1102 bp, Homo sapiens
tttcttgtccatccctattttgcaatacttgaaaataagtatttcaagtaacagtcaaggtgggggatcctcagtgacccctgaagaaactgtgttcatatccagtgtttatttttctctttttgagacagggtctcactctgtcatccagactggagtgcagtggtgcaatcatggctcaccacagtctcgaactcctgggctcaagtgatcttcccacttcaccctcctgggtagctgggactacaggcatgcgccaccatgcctgggtaatttttaaattcttttgtagagacaaggtctcactatgttgcccaggctgttctcaaactcctgagctcaagtgatcctctcaccttggcctcctgaagtgctggggttataggtatcagcccctgtgcctgacatcatatctaacttttcaactagcatgaggtctttccccacttactcatccttacatttatactttaatacattttagagtttctggtctgtactaggcattgctgtgaattttaggcagaatatttaataacaaatgatcccctatttagagaccaagaattgacttgacctaaattgtttttctaaagaccttgttaaaaatttaccttactactttcctgcagatttttttgggggcagaagaaaataataataataataatgttataaaagtttagcttacttcaaatctttgttttccattctaacaatctatgtcaactttgttgccatttgattaagttttaccttaatttttcttaaaaattgtctttcaagaggaatcagaacattcttgaaagtgacgaacaatcagacctcagcagtgtatgcctcactcatgatctcagagcaggtgctcagctcgatgatttcagctgtaatagcagcatttactttattcctcaatgatctctaatgacagagaattacacttccttgcaactgaagttaaaaacctgaatgacaatataaagaatacgccttatatgatgaaaatttttgtcatgactgtgtatatttagttctcagtaagtctgagagtggtgtctttctggatgattttattgctggcattcactttggggagtgaaag

SEQ ID NO: 132398 - DNA, 1017 bp, Homo sapiens
cattctctgctctagaattcttgcatatactaggtgtgtggactaggttctctggactgctaggttctctgtgtcacagctttcctttgatgacagtgtcaatttaaaattataccaggttcatttcatgatggttccctctgggagaattttataccctgaaatttgaggggtgtacctctaccatttccccctccgctgtctttctttttgaacttctcagagatagaccttcatgtaattcctgatggttttaattttagaatgaaaaatcaggatctctgagaatatttagatgaatggtaatgacttttgttatgtgggtctggtcatcatgtggtattttcttttccccccaggaatgctgtctctgcaatttgagaggaggtgctcttaagcaaacgaagaacaataagtaagtaatacattaattgtgttgaatttcattatttttctttctccattctagaacctttggatgacagttcgctttacctctcattgtacacgtggtttcaaagcttttgctgctcagatctgaggttggaattctgtgcttcagagacttctactgtttgcactctcatctcggcagggcaagagcagtccaagttatgcttctcttctttgtatttgacaccatgaaaaataacccctcttttactcacagagttttgaaaatggagttagcccatatcatccaggtgccattagaatcctggtgtttaatatgatgaatgctattggtctgttaaaacagggcatacctgagaaagtgaaaccgtgatcttcagataaatcagtcatagcaatgataataaaacaaaaccatttactttttacattagcaaatttatgagaatgtaagtgtactaaattagaaaagatagggagaaaacattgatgttaagatttaaagggatcaggtggagaatatgaagagagtcttgaaagagagtcataagtgaacataaaaggaaggcagtctagtttttatgactgttctgcatggatttt

SEQ ID NO: 132399 - DNA, 1070 bp, Homo sapiens
ggaaaacttttgctacttaaacaagtttgcttcatgacatttgtattattttaaaaggttgtgtgctatacccagttcataccttttattaattgaactaatcttttgccacatattgattagcttaagtactttaagcacatacatgcatattccagcatcaaatgaaataagaaacccacatttcagtattttgcagatcaagtgtagaaaaatatgtgcacgttaataggatagagtcgtgggcctttatcagctcttcatggcacaatgttgttgggcagctgtggtactgagtctgtccaggtatcattcaggaggtttacagttcagaatctgtttgtgatggatttaggcttttggctttcttgctcatctgtgtatttcccatctgtgagaactggcatcaccaagttgaagtatgtaagtttagggaacttttgtttatgtttaatgtctcctttcctgtaggtgggcccatgtcatgtgcgccgttgcggtcccagaagttcgattcactaatgtcccagaaaggacacaaatagatgtaggcagaatacctttacagaggttaaaattggtgagtggcaaagcttcttttttacctcataaattagtgttaatttcaagttctgaatttttccattaatgcacacattcccaaggtatattttctcctagctttcttttatttttctacccttattttcctttagcctaaatttatttattcttacaaattcttttcctgttatattgtaagtttgcatataaccttcctcaatttctgtctgaaatgaggaaaaagatagtaatacatttcctgaattaatgtgaactttcaaactataggttatctggtaagatttgtcagtactggagctgagccatctaactctatttaaattgtttagatttttctctcttgactctctttggttggtcttaacctagcaaaatgtatctaacctaatttcattatctcttcaccaagaagagacacacagagaaataaagaagcttttatttttacgaagatattttctcactcttgaataggtacaagtcac

SEQ ID NO: 132400 - DNA, 1060 bp, Homo sapiens
agaatccacgggtctacagcgaagatatagacagaaagagaacattttcaatatttgtcatttttagagaatatcttggttggaagaactgaattcaagactgacagaacagaaattgttaaatgtttttaaaaacaaacctggatttttttcttttttcaaatccaaatttcttttttgttagcaaagcaataaagtctggtaacatgtgcatatcagctactatatacttattaattatataatctcatttaacaatttaacattacctgttcttatggaaattgaacaaccaaattgaatactaatcaagtttcacctaagattaaaattctgtgatgtatgtgtatatgcacatagtagtcactgagtaaatatttatgaaatgaataaaaggcagcaaatcattattcattatttgcacgtcaggcttataatgactgtggctggaggagtgcgatcagacaataacaaatggcctttgcctttccacggtttctcctttaaatgtaacagatctaattcacacacatgtctgcatattgctctaaagcaaggcattactttacttatctgcatcacaggagacatatgattaaattgtagagcccagcagtactccagagagcctatgaaacatgcatgcagtactcatcttgttggttgaaaattctgatcttggaacttctggtcagctggggattgaaaatgagtggacaagtggttcatccctgaagcagcagcaagggctgcatctcttcagtacccacgaggtggtgctgctgcaccagtttcttatgttgctcttaaactaccacctcccttctctagtgcctaaccagagctctggccacacctgcagagagagagagagagagagagagagagagagagagagcgagcgagtgcccaagggatgacaatagagcatcgaaagtactgctcgtgatgcattcaaagtgttgaattccaaaggacagttttttagtttagtttttcatttaactgtagaaaaagagctgctgtcccttggggcaagttagagtttttctgaataagt

SEQ ID NO: 132401 - DNA, 1091 bp, Homo sapiens
ttcccccagtgctagccagtattgacacatgagtgattgacttaatgaataataatgagcagaacataaatcttacaggtagggttaaaaatcaaaggattctattacgaaccctgtatttaaggacttggagcaaactgaaggttttagcctcgatcctctgacttgcctgcagcaatagtgatgtccgttgagccaaacattgttccctgtttgagctgggagtgttaacttgctgtgtggtgcttagaaaaagtgtccttagggggcaaaaggagaaagaaattagctaatgtatcattatcattagcctgtgacttaatcaggaaacaacaattaaaaagcattcacacctattttggaatacctgcctgtttgtggaagaaaaaaacatcataaaactagcaaaacaaaacaataaaaaatcagaaatcatattaacaggaaaaagggggaaggagatgtgctttgaacctccagctccttcacagttcatcatttcttgatgccctttgccaggctggatgctcaaggaaatctaatgatatacaaagcctcattgccagatacttcattacttcctcaatccattagtagccttaatggcctatgccactggaataagtatggaaatccagtcccccaagaaagtacagtgctctataaatcacacctgcctgaggattctctcagcccttgacactgaagaataggtgaaaaaaaatcattgcacttccttaactcccttgtactagaagctgtcggcatgagtgacaccttttcactttttaaccctgtagcctcttggttctcaaagtgtgagctgtggatcaacagtatcagtatcactgggaacttgttagaaatgcaaattcagtggccccgccaagatgtgctggaatcctggggcggaagagagccacttctgttcttgtcatcagccttgccagaactgtcctgtcagagatacccactaacagcttttggctgggtgatcagctccctggagtccagtgctctctaaccttctttcattcccctccctgcagaacatacacttttcaattttcaattttttcaattttattttt

SEQ ID NO: 132402 - DNA, 1247 bp, Homo sapiens
atttccttgtctttggaaaacttaacttgcccctatgctgtttgggtgtttttgaagaccacatctaatttaggaaagaatgacctgtcctccaaacccatattctacttcttgatgcacagaaagacctgtcatgcaggagggcaaaacagaagtagcttcaacattcatggattatttataggagcacctctggggtcttttcccgagctctgtgcctgcaggagtatgtgcgaaagtgtttggctttccttgctacaagaaatagttaaacatatgtctggcagtctgtgaccgtagcagtgtgtttcctttaaagaaagtagattacattgccacagatgctgtcaccactagggcccctggaggggtcaggacttgttgatgtaatcagttgtttttttttttttttcttctctagtagctattgttctgtaaattgtgggaactgactgggttacagaatgtgaattgatgttcttctctgttttaaccttccagaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtggtaagatgtgccctcccttcctcagtgctaagaccgtgtctggattttctcctgttttagactacctcccagacataatgtgctttattctgtaatatgactcattgttgacatgtctagaccgtgagttccttgagggcagggattgcgcactgttatttcctggtatttgcctaggacctgtcaagtgcctggtgcacgctaggcacaataaatctgtctgagttgaatgagtgaatgaacagatgcatgcagaaaactctccatgcctgttctggtgttggatctgtacacagggctgctgagcttggttgtacacattgtgcactgcacatatccaggatgagagtgagaccatttctgcgaggggatcaccacctgagattatgtagtgaacagtctatgaaactgtacactgtggtcttgggctgttattttatctcctttagaagaaacaaagagcagcagcacagtaaaggaagaggtaggatggccaggagcttttgggactttgctgcctaaaatggcatatgtgagggacagcctggggccctggaagg

SEQ ID NO: 132403 - DNA, 1027 bp, Homo sapiens
tgagtagtgtttttcctgtttcgaggataagaaacctaagttcagagaggtttaattccttgcccaaatagatgcagataatgagtggcaggtgctggaatgtaaatgcctttttagctcatactctattatttggtgaattccaaaccccaaacctcaaatggtgctagaggtgttcatctgaagctttgcttgggatcatacattaccgttttaatattccaaagccctgtggttactgatgactatattgaagttgctattaaagagatccaggtgtttaatcaggacctcattcctcttaactctcatgtgtggttcagtcaagtttaggttactaatgtgtttcctaaatgatgatgaaaaagaaaatagatgagtttgaggtgatttagaaactactgtctcctacagatccactttcagcttggtatactttgtaaagactggggaaaagatcatataatttacaacatcacgtgaggcagcttttcctgatgagggaacaattttagtgttcttaaattgcctttgctacattttctaggtggaagcactgttagcactgtatttcccaagtatatttctagtagctgttacttatccattcttcttccattcgactccaagtacggattcctccccaaagtgtttgggaactaaccagtaggaatttatagaatctggcaactttggttaagaacattgtgatttgcccctattgctttaaatgttctttccttatcaagcatagaaaagttcagattcaatcaaatatttctctttgtgtaaactatcaatgctaagaggtatgcttcttagagcagaaactgtagtttgtctgtgttctcaaccatgcattgattatttgaaagtaataggcaattgccgaatcatagcagtgaaaactgtaaaataaagttcaggctaacttggcagcctggcccagttgttttacagaataatggaggatgcctgtatgatttaggtgaaatgaagtataaacctactgttgcttcaatagagt

SEQ ID NO: 132404 - DNA, 1447 bp, Homo sapiens
gcttaccaaatgtcaactaagtaataaatgtggatgggtgatagagcaggaaaaatcagcatacaccaccattgcagtaaagattatgcacaaaactcaacggacactaattccaaacagagatttaagaggaacaggacatttacatactgatgaaattgtctttcacagattgctttagtataatagaaaaatagtaattaagtggagaaattgaactatactttgatcaggatcaaaattaacattatcattgaggggtaagcaaacatcatgtgccttcagaatatcctgagaacaagagaacatcacctatttgggattctggccaaaaatgtataacctgaatctaatcatgaggaaacttaagacacatgctttattaaaaagcaggaagaggaagaattgtatccttccaaagtagcactaccataaacaaagacagaggaaatggtcctgattaaagaagcctaaagaggtgtggcaactaaatgcaatacttgactctagactggattctgtgcttgggagtttgagggtagggaaggtgaataccataatggccattattggatcatttgaccaactggagtatagatggagattaaagtatcctatcagtgttcagtgtcctgaagttgatatatttgcatatacacatacacgtgtgtatatatatacatacatattgttttctctctctctttgtatatgcatacacacacaaaaccaatggatgaacctgggtaaagagtgttagtataaacaagtagtgtttatactatttgtcttcttgcaacttttctgtaagtttgaaattattcttcaatattaagttaaaaattttttttttaaatcttggccaaataaatgattgtttttcaaatgaatattttttattttacgtcctttcttttcctgttctcttacttcttttcttccttttttgtgtcccttcttttagaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtggtaagtaggcttccttgagtgcctgctacccagagtaatttaaaaaaaaaaaccaaagtaactgagcccttcagaatttttcttttggctttttgagtagctcattcacttggttcatagactttatcattctaaataatatccaggtgaacttagactgatcttcccacattctttttttggccaaacgttatttggccaagaaataagggagcagccctcacgacctaatcacctcttaaaggtccacctgttaatactatcacattggcaacacctgaattttggatgggacctattcaaaccatagca

SEQ ID NO: 132405 - DNA, 1515 bp, Homo sapiens
ctttctaggccttttaaggtttttgcatgccagaatctcacctatttctaatatcataaagatgtggctgctttggaaaatatacctctgaggcttaatgctataataacttccagaataataaaacaacctccgtctctgggacctcagtaccttaaccaagcatcgtgtccactttgggctcatcattggagggaaagtacgtactaacaaagcagcggaccaggcactgtggctcacacctgtaatcccagcactttgggaggctgaagcaggaggaccttttgagggcaggagttcaagaccagccttgccaacatagtgagaccttgtctctataaaaagcaacaaccacaaaaaactagatggccttcaggaattcaccaaataagttttagtgcttttatttttgtgaaaataacagacctatcttttagaaaataggtatagctgtgtatgaggacattggccaagtgtgactggtggaaaaaaaaaaattggctgtttgagtaagcaagatgggcttcatttcagcttaagggacaaccacagcatcttggagttcagaaagggtgtgtatgtgtcctttagaaacaaacaaggccaggcgtgctggctcacacctgtaatcccagcacttcgggaggcggaagtggttgtgcccagctatgttgctgggcaacatagcaagacctcatctctacttttaaaaaaaaattagccaagcatggtggcacgcacctgtattctcagctatttgggaggctgaggtgggagaatcacctgagcccgggaagccaaggctgcagtgagctgtgatagtgccactgcagtcactccggcctgggcgacaggagtgagaccctgtgtcaaaactattaaaaagggaaagtggacagtagacttggatagacttggagtttcccagaatgattagtgtcagtatagaagcagcttggcttgaatcgattaacccagagcctgaaattacaggggtctagaaccagcacagaacacgcttagatacagatacctcagtgtggaagcattccacattttcttctaagcatgttagaaagctctcactctgaaaaagacgcagtcagaagaaggggcacagaattggttctttcgttatacacagaatgtatagtttaggctgcgagataacctcctagaacagcagttcccaccctgctgagcatgagattgcctggaaaggcatttggcttggaccagctgaatcagaaatttctctggtggttaacattagatttatttactgcactagagaaatgagtctgatgttgaatttttcaaagctgatgaaactaagtttataaatagtttatatgcctttttaccaagtaactcttattctaggagtctaagaatagagtcagtaattcagacaaagatttatgataacaaatatacaatagcattatgtatgataggggaaaattgcagtgacctaaatatttaataaaggagtggctaaattagttgtggttc

SEQ ID NO: 132406 - DNA, 1050 bp, Homo sapiens
tgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctactaaaaaaaaaaaaaaaaaaagcaaaaaaaaactcataatgttttaagcaagtttacagatttgtgtttggccgcgttaaagccatcctgggtagcatgcagccggcgggccatgggttggacacgcttgccttaaacgttcagttgtgtatgcagcttttttccagtcagatgggatcctgacagcagagtaactgcatcaggtgggaactgactttcctctcagctgcatccttc

SEQ ID NO: 132407 - DNA, 1876 bp, Homo sapiens
tcagtttagggataggaaggtgtcacaggaattagcaactaggacttcattcagcaagaacagtttcagggaaggggtggggcagaggcccaaagctaagtaggagtaaaggtaacttagagatgactgttgacatttgtcaaaaacagaggggagatgaaaaatgagggaagtttaaaacgagaagactttaatcttgcttttgtttggggaaggtccctggggttggagggtggggagatcctggagaaagtagggctaaatggagccccccactttgggtgggagaggcgagggaaagcccaaagccatgcctggggcccttttagcctgagctggtgacctgggcatctgcaccctaaccccagctgaccgagtcagatctttgtccagtgttctgaagatcaaatgccgtgcccttttgcaatataacaccagctgcttttagtccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctccagtcctgtctctgacttgcttatttgtctgggtttaaaccagtagaaaaacaagtttattggagagctggctatcaggacatactgcggcccaggtttttcagaccctccttctgtcgctgactttttccatggttgtggcacatgcatggcgatatttttggagacaaagtcccctgcctgcctacttcagtaccaatggaagtgttttcttcaacttcttctaggccctgaatacatctcagacccttgagtctggatcacttttcgttccaggattcctggtccgcagctgtcattagtaggaattagaggtcctccagtccctccttca

SEQ ID NO: 132408 - DNA, 1500 bp, Homo sapiens
agtgtagtcatatattttatcaactaatcaagcttgaattttctatctctaggttttgaatggaactgacctgctctctctataatatgccaggaaagtaggcctggttaaggcattaagaggaattaatctaaataggatcatttgttctgtacaagtttgcctgtcagcaagatttctgattggctgccacagggagaaaatgtgcagaggtctatgcgatctcaaatacagctgttttttatagtctcacttaacatatgtgcctataaccaagtacagctgtatatggccttagtaaaatagtgctggccacaaatgcactctggctattgagaaaggcacctttgtttcactgcattctgcataaagtggttattagctctatgaccagacagaccgttaaaccattttcacttactgtgtggcacctcaattgtgattttaatttttttgcgttacactagctgcatgtttagtgtatacgtgtagcataaaatcagctgaagtccttctagtattaaaaaaaaattgcttagctgtgacaattctaatgtaacactaattgcaagccctttctctggaggttaagggattagtaaacacggcctggcatatttcataacattttaattcctttttgtgtgtttgaaatgagaacaatgtgattcttgtcagttaacttttattaaaggacttttttttttttttttagttcaactagagagaaattgagaagaagcatccactgaagtatcacatggcttcttagaatttattacacattgttattgggtcacagtatgtgaaaacatggagaccgagaatacagaactgtgtagaagtgaatgagtctgccacctctccttgtacctatccactgtgaaacaagggcgttcatgcacacgttactgtaaatgccctggaggccttatgaataatcattggagcagtatctgctgcaagataacattgtgctttatttttgcctttaagtaaaaggaatctgaaatgaaacaatcttcatttcagatataaatcagccccataaacttgaagctaaccagagatcctgaggcattctcattacatgaagtaattggttggttgcaagactcaattgtactgcaaagtcttcctgagaattcagatgagcagttatctgaagagttacacatcctctcacccgacatgttgtaggaacacatagcattggccagtggggcgaatgatttctagtctctgatgaggccggaactctccagcaagtgggcctatgactgagaaaccccgggcaactttgaggtccctttgaggaaatgaaacttcatcaaaagcagccaatattaatgatatattgagcatctattgtgtacatccagtcttctagtctccttggtgacattcatcttatttaaccttcccagtaaatcagcaaaataagtaccattaccctcttttatggaataaaactaaaactcacagaggttgagtaacttt

SEQ ID NO: 132409 - DNA, 1048 bp, Homo sapiens
tgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagtgagaatcaaggcacagcacttgggcgggttgggtatctgcggggtagaggaaggaaacggagcagccacgtgggcggggaggcggggaggcggggtgctgccgctggtcaggtggtgggggcacctcaaacaaggtgggagaggaagttgttggaacgcctttctttttttttttttaattttaagttagtatttcttgagaacccttattagactcagcccttttaattctcagaatagctgttagaagtaggtatgattatagtatttactgtggagcaaaccgaggcaacgaggagtattgtgttcatggtcaggaaatgacagtcacttgatcccaggtatatcagatctcaaagcccatactttttctccaggtcctggagaaagcctgagcgagggcc

SEQ ID NO: 132410 - DNA, 1050 bp, Homo sapiens
atttgtttgttggcctgtattcttggcacattttaaactctggcttgccattaagagatgttagcaagtacatatttatgaaataagaaatagagaaacatttttgaaagtaaaagtatatttagaaagaggaaccaaaacctttagaaaataggcaatattcataatacgttgaaacgtagagcttttctgcacatattccattaagatcacatacaactgacaggtctaatattgataagttattttctatatatatatatgtatatatctatctttgtgtatttttgatagacttggaaacattttatcattacacagtaggaaatgacaggaaaattgatgtgatctccagaattatgactactcatggacttagaaatcacctaaaattagaattgactatatatacattttccaaaagctagtgcacattggtttagaaaatatattttgcctctctgataaccagattttttttttattggttttatctctttagattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaagtaagttgattgaaggcttagggctgaaggaaagaattataggtaaataggaacattatatctcaaaattatagaggtcgtaaaagaagatactgcttaatgtagtgaaagattcttctgctcagactcccagttttgctatccgagttcttttacaacgtgtcctagtattcattgtaacacagattttcattaatttaacagtgagtttttaatctgtattgcagggacagtgttatttaggagaaacagaaaaacatatagaacatggttcttactacaaagctt

SEQ ID NO: 132411 - DNA, 1055 bp, Homo sapiens
tagagtttgactgaaagagtgagaagaaatctgccagtttaaacaaggggagaaagagcatcccaggcagaaggagaaacatgtgtcaaggaatcgtgctcattgggtatcccataagcttttttaaagatatgatgagaaccagtgtgtggggttagagagttgggagaagttgtcagagaccagaccacgcaaggctctaaattttaatatttgtagaatttcttctgtttgtcaggcatcatgctaaacactgggcatttactggtgatcagaagagatactatgcttgccattaaggggcttaccgtccagcaggagagtaaaataatggatgaatacacaattgcaaattggataagcactatatagaaaaaaaaaaaaagatggtgcctgcagtcttggaatcttggtcttgtacatttaagtaaagacctgaaggatgagaaggaatcagttggatatgggtagctggtatcagcacgtatgaaggataaaaggcaggaaataactgtgtggtgaacggaagggaggccagcagggctggagggtggtggactgggtgagtcaaaagtgattaagattggagaaaaatggtcaggaggtctgatggctcagggctttggtaatgagattggatttcatttaaggcacaataggagaccatgggagggattgtaggctgaggggtgaaacaatggatttaaaaaatatataaattattctggatgctttgtaaggaatagattgggaggtaacaagagtagaaataggaaggccatttaggaagctattataggtagtctggatgagagatggtggtggcaatgactacaggatttccaactgattgagttaagggtgtggaggaggaggaagattgggaagaaattgaggacagatacaggcctttatctgtgaattgtcagaggcctgtgaaccagagcaactccatcttaaaagctgggtaaaatgaggctaagatctactgtgctgccttcccagacaaggcattctaagtcacaggataagataaaaggtcagtacaaaataca

SEQ ID NO: 132412 - DNA, 1039 bp, Homo sapiens
gctcacgcctgtaatctagactcttccccaaatggtggggggatgggtgggttattaatggtaggtattggggggttagcttgagatgggacttggtcttagaagagagctagttctaaaggttgtttacttttctagggaggagtctgctactagtctaatcagctgttgggtggatcacgaggtcaggagatcaagaccatcctggccaacatggtgaaaccccatctctaataaaaatacaaaaaattagctggacatggtggcatgcgcttgtagtcccagctactcaggaggctgaggcaggagaatcgcttgaacctgggaggcagaggctgcagtgagccgagatcgtgccactgcattccagcctggcaacagagcgagactccgtcttaaaaaaaaaaaaaaaaaaaaaaaaaaaaggtttttattaatactctgaacttaagacctaaaattactttaaaaaatgtgtatcaaaggtcagagttttaaaattaaccccactattttttgttaggatggattttgttggtatacttagaatataatcagttgtcgagtagatgtcctaatgttaaaaacttttttatttttaggcaggagaaaacaatccaagaagagtattgtttttcagtgattaaccagtatctctggtattttagagatgtgccaagggctctctttctttgtgaaatagagcatatcttgtagtttgctttgtcaatgttctcttagactatcaaaacactcaaattttacattttgagcagtatttacgcctgaattaattcacaagtttcaaggtcactaactttggttatattatattgttattttccaatttagccacctctttatttgtataatagagcatacagcagcacataaaacgcaaaactctaggacataaaaagtggcattcggacgatgttgctctgaaatttatgcattaattaaaccggtatatatgtatgcattaattaaaccaatatttatgaagttcctactgtgttacagacgtggatccaggcac

SEQ ID NO: 132413 - DNA, 1033 bp, Homo sapiens
gtgactgttatatatgcattctgcttattggcagcctgccctataccattttatctgagaaacttttgttaattataatgtcttctaaaatactcttgttttcatttcacccgttagtttcattatcaataagggtggatgatttgattattttttccatttaacctattttataatagtttagcctcttctccttgtctgtaagtcctcagagaactatttctgattatgattttataaataataaaatacaggatcttatatttgtttgatgatttggaaaattattttttctctgacaagaaggtaccccgaagttttaaatcagacatgatacataaaataaagttacatggaaaattactcggtcttttatggctttcatgatatctgaacaattaagtcttctttgcccaggtttctaaaatgcttctcacatgcatacactggcctatttagccatatgtttttctaccagttaatctataaacataacttcctagaagcatgaagcagggtgtacttttttaggtaatatgtagcaagggttttttttatagttaggttatcaatacacattttaaaataatacttataaattaagaatgataagtttaataaatactgttatgtatattcagttactgatttaagaaaggactgcttatgtttattttaatccgacttttactatttaacagactcgacctgaatttgatttatatgtaccaaaaaaaaaatattttaggaaaatattaatttcaattttgaattttatcattcaaaatctgttttctctcagttacacttgtattatatcgaggataccaaaatagatactaacttcctttccaccaaattattcactgtcttttcatgttattaggtatcatctgttgaaaggcccccatcttctcatgcttggggtgcagtctccttgtgtttggttttgacctcaccgtagttgcttctgtgctctgcagccagcatgatctttaagaaactcaaatctgatcacgtcattccttgcttt

SEQ ID NO: 132414 - DNA, 1049 bp, Homo sapiens
ctctccagattacattatatagcatcaattataccatgagcttcttgaggacaataattatatcttttcaagtctgcagtcttaatttcatgagtgaatgaatgtcaatagtttaagatcttataaaacattttcttactctgaataaattggcatataagttataaggtaagaacttgtggttttgcaagattcaaataccaaaacaaactgaatatttttaaaatatgcttagtcatgaatgcttagtattttcttacaactttctatacccctatatttttatttctcttttggattgtgtattttgaagtattgttattataaaatgcccaaaattaattttaataaatgttaagatatcatcaactaatatgactttctataactttctcaataatctcttaaaactgaaatggcaagataccacatgtgcactcttttgctgtggtaaagacatacatgttatcaaattttacaggtaggccaacactcaggtagtaaactatagacctgaacaataaaaaactaaaaataaaactgataaattagtataaaacaagaaacaaataatgagctactttgatttatggtattcatttccatttcacataagcaatctatcttaatacatactacaaaccttgcatctgctttattaagtagtacatttcacattcagccattctaaaagagaaagatagtatttgggtgatggagcagatcatttctgtttatcagaaggaaaaatttaagcaaatcttaaaggggcaaatttttatagtactatttgctctgtattattgacctaagtactgtaatcaccattgatatagtagacgtcattaaatcatattttgtaaatttagagatattccattacagattgatttctctatgtatacgtatgtatgaatatgcttcctgaggaaacctgtttaattaaatcccattaatagaatatcctttttctgcattgtacacgcatttatgtaaatatatacaaaattatcttctagtctgaaggcgctatagttcagtgaatagca

SEQ ID NO: 132415 - DNA, 1131 bp, Homo sapiens
tctatactccatattagcataacctcattcccttaaagcctgcctaacagccctaccacttaccattgttcagtgctttaggaagatgctatgttattctttaagcatgattttttaaaccattttagtttaaatgttaaacagttaaacttattgtgtaatatttcatttcaggaatctcaatcatcttccactatttctcatttgcaaaaatggtaagccaattcagcatcaactagaaaatagaaataatatgtgaaaagacattttcatatgtctcaacatgtttgtggataacttttcaaggcttacatctttctttgacattagagtttgtatagcaagaatgatacacaggctcaggcaaagtggaaatattctcttattacaaataagggaggagaatgaaaaatggataggagtgtcagctgaaaattgtagaatgttctgtatcaagaacacataatacttgttaaataataagtacagtgttctgagtacccaaggttttgttaaaaagtatgtacaataacaaacagagaataataagcagagagcttttgaaattagggaagaactataggatagtatttatattttggtgaacacctggagaagagctgcttgatttaggacaggaggcaagaaatcatacagcaaatgtgtgcttaattaaccacaaaacgttctttcaatgtattagcaatatgatagataatgtcagacttattagaatcactatataaattattcttggccgggcgtggtggctcacacctataattctggcattctgggtggctgaggcaggtgaattgtccaggaattcaagaccagcttgggcaacatactgaaaccccatttctactaaaaatacaaaaagttagccaggcgtgatggcacaagcctataatcccagctactcagaagttgaggcaggaggatcacctgagcctaggatgtcaagggtgcaatgagccaagatcgcaccactgcactctagcctggataaccagagtgagaccctgtctgaaaattaaattaaatgaaaatatcttcataaaagcattcataaatattttatgtcagatgagaggctaaaataaaaaagtagatagtttaacttcccac

SEQ ID NO: 132416 - DNA, 1052 bp, Homo sapiens
gttgtctttttattgttgagttctaagtgatctcaatattttattagatatgtgatttgcaaatatttcctcccattttgtgttgtctttcactctatggtattattttatcccaataatgtagaattttctacatatagctttacatctttcagtagatgcattctgatttgatatttttatgttaccagacatggtatttttatattacttgtatatagaaatgcatttgatttcttagtgaggaacctcaataaaaaatcatatattaaaattaataatctggtacattcctttcaatttactatccacacttacacaataatagttttatctagtctattcaaatcctttaactttactaaaaaggcatgcatgtgtgtatgcatgaattcacgtgtatatgcacgtatacattttgcattcacgcatttaccaagaccacaaatacaacactgaatacaagtggtgatactgggcatccttgtctttatctcaaaaggaaccactgctactaagtgtgatattagttgtaagcgtttgctagatatttttatatcataataagaaagcacacttctataagaatgtttataataaagggtttttttgttgtccattacttaaatagttacataattacttagagtgtctttttcttgcgcttctcatctttgctaagttgtatttttctagaaattttattcaaaattctatgtttttagaaaagtaatttctaacatcctctcaacatccttttagtatcatcagggtttatagtgatttaactgacattagctttccttgaatcctctattttttttacttggcaagttgcatcactgtcactttcatcagtttatttaaaaaaaaaagccagttgtggttttgttgatcccctctgttgtatgcagtacaatatatgatataatattttccattatattaccttctgatatttattatttctcttcttttgtatttgagatatatgtgctgggtccttcctaacttgttgagatagatacttatattatttttctgcctttttc

SEQ ID NO: 132417 - DNA, 1075 bp, Homo sapiens
gataaaacaaagtgaatctgctcttatctgggatggaacaaaaaaaaaacaaaagtacctgttaggttaatatttatttactttgaccagaggacacagtttttgctccaggaaagaaaccacatctggaactctaactgttatcaccaatcaattaaatatatgctaatctagtgtccctctttagcagctatcttcactaacccaaatggacaattaaatgaggatgcaataggaatcaccatcctaggtttttaaaatcttaggtggctgtactaatgttttacccttcctagagatatgcaattaatttttattaactgtttgaataagaaatgaccccagaggctttgggttgctccttcctgccaaactagtacttatttcagaaactgatggaccagtaaaataatcctgctggtggctgttatcttttccaaatgcatacttaggaactggtagaataaacacagggtgaattggagatctcactgggctgattatgaggcaaatttgggggcaaaacttcacctgaccactataaactttcaccctgattggtgaatttgtggagttcagggttctcaacagttaatgctaatgtcaatcagagccactatgcaataatccatggtagatctgggcttttttcttttttcatagcatggagattatgataaatttccacactacatacagtgaatgactgttacatagtccaatagtagtacctgtgatttagaaccctgttgtgggaagtcagggaccccaaacagagggaccggctgaagccatggcagaagaacgtggattgtgaagattttatggacatatattagttccccaaattaatacttttgtaatttcttatgcctgtctttactgcaatctctaaacataaattgtaaagatttcatggacacttatcacttccccagtcaataaccttgtgatttcctatgcctgtctttacttcaatctcttaatcctgtcagttgaggaggatgtatatcgttccaggaccctgtaataattgcgttaactacaaaaattatacagcatgtgtgtttgagca

SEQ ID NO: 132418 - DNA, 1079 bp, Homo sapiens
atggaatgaggaagagtaggtttcttgagtgttcattataggattccagaattataatgaattttaaggaatcgacctgtttttctctttgtgatttgaaaacagatccaaaatatgaaaaatggctaccacatattctagtgttgcaacaaaaccagcagctgtgtgggtttccccctaaaattttttgtctctacgtgaaccttttaaatacccattttcccaaaggcatccattttaccaccttgcaagaagctacagtacatacaatattgttggtttaatctcagtattttttatttatatcatccagaggaggatttcctactaagtggcaggcattttaaaatttttgttttgaaataattccagactttacgtaaaaattgcaaaagagtaccaaaagttgctatatatcccttatccacattcccccagatgtaaacattttatattgacctttctcattctcccccgccctcctctctctctccttctctctctctcctgccctcctcccttctttttacacacacacacacacacacacactttttcttaaacatttttcaactttcttaagaaatttgcacatgatatcactgttcctcaaaataattcagtgatcattcccctcctccaaaagaacagttgtggggcataaatgttgtccttcgtccatcgtgtgtacactgttgtcacacaattaatgccacaattaatgacttatgtcactttatttctgctgacttcagacctgtcctaggaatatttttcgacagagctctgcaagtggtcacctcccttaaatcagaaacatacctgaggccagtattcaggtagataatacaagtgggtctgcctaaagcataggagggttgattagaagaacatgcctttaatttctcacctttctattggattaatgccagaaattcagttctcacaaatcatcttttcagccagagcttctgacccatatgaaaatataaaatagtagctgggaggtttgggactatacatggtatttagtaaatatattttgaatgttagatgaagtaacaaaacaattgccttgc

SEQ ID NO: 132419 - DNA, 1010 bp, Homo sapiens
gatatgttcaggccacttggttagggtcagggatgcagcaggggttttattgtgccttttggagcctgatgcatctggcaggaagtgagttttttttattataactcctaccatcagtcagcaattatcaaaaagttcctgacaaccagtccacttatattttattctgtgaatttaaaattctgaactgcagcagacagtccccagatgaatttgaggcctttcgagagtgtaaaatggctggaatatctttcttctctctttgtccataggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgata

SEQ ID NO: 132420 - DNA, 1578 bp, Homo sapiens
gcactcagggctgaagaggtggttgaggcttctggaaaaggaagattattagaatgattgtgcaagtctcttatggcttttgaatacctcacccatgtttgactcatcaatgcattttggtcacaccaatgataaatttagtggtttagtcatgataaaaagacaggtgcaacgttatcttttggaagaaagaacaatgagacccatataatttcaatcttggatgaaaatcaccagttgctaaaataaacaaaatgttttcagacctggttctcatctccttttatatgcaattcccttaaaaattgtgctttatatttctattatctactgtctctatgagctgacactgatataaaatagtttttgattctgttggtgtctacagaacagttccaattaatttgaaataggaagtcatatagcataaaatattattgctttcatgtttcattaagaataactatcacagcgtcctcttcctgcctggtgttggtggtttgttctcagaggcttgtgtcaggactgctgataggaagatgtcttcaggaaacgctaaaattgggcaccctgcccccaacttcaaagccacagccattatgccagacagtcagtttaaagatatcagcctgtctgactacaaaggaaatatgttgtattcttcttttaccggcttgacttcacttttgtgtgccccacagagaacattgctttcagtgatacagaagaatttaagaaattcaactgccaagtgattggtgcttctgtggattctcacttctgtcagctggcatggatccacacccctaagaaacaaggaggactgggacccaggaacattcctttggcctcagacccgaagtgcaccattgctcaggattatgggatcttaaaggctgaagaaggcatctcattcaggggcctctttatcgttgatgatatgggtattcttcggcagatcactgtaaatgacctccctgttgactgctctgtggatgagactttgagactagttcaggccttccagttcactgacaaacatagggaagtgtgcccagctggctggaaacctggcagtgatactatcaagactgatgtccaaaagagcaaagaatatttatccaagcaggagtgagtgctgggctgttttagtgccaggctgcagtgggaacccctgagaacaaagtctcttttgtggttttttttttccatgagtaaaatacaagacttcagattcagccgaactgtggtgtgttacaaggcaggcctttcctacagggggtggagagaccagcctttcttcttttggaagggatggcctgagtcgtattgtggggaggccactgatttgtatgatgtgtcagtagagggcatcaacccattgatcttttgtagtttgtattaaacttgaactgagaaaaaaataaaagaatatcataatgtattttcttatattattttatcagatatttaaattacaaatgtaatacatgctgttgtcaaaagcaaaacaaaataagtatactcgaaaaatggtaaatggactgtactcttactccctccaatcagatttctcca

SEQ ID NO: 132421 - DNA, 1241 bp, Homo sapiens
tgcaacgaaggtaatttaatgcagattcactcagcagtaccttcactggggattatcgtaattataaggcctccatccctagatatcattctaaactcaagtacattttacatcataaaattggtttcctccaaagcaaactcaccatgaaggatcattttctgattggaaaggcagaaccagtttcattttaaaaatgaattaattgtaaagcacagaaaagtcatttgacaatataattcctgggactctaggcatattctctgtcagggaatattccagtttctagaggggatttgcattcctgtaaataggcaatgcttatctccttgttttgtttttttaacctagtgtgttttatgacctgaagaaatataattcaacattgactagaaaactgtcatcatcagtacccatgtcaagggtagcaattaacataagcctgcatgacagtgctcagcagcagtagagctgttggaggtctaatacgctaaggggagcctctgagtggctgggcttcctggagggattttcaagtaggtgcttgttactcacctctcaggtttatataagatctggcatatgaatgtgtttataaatttggttattaaagcaaagttaacattcgtcacttctcattaggtttctcaatctttaaaacataatgtaattagaattctttaaggaggaatacattctttttggagacacattaaaaacaattgttatctctgtaagaattatatatcctaaagaaagaaaaaatggaagcatccataaaacaatgtaaataatttttaaaccagtcatttaaaaatctagtctcaccaggtgtggtggctcatgcctgtaatcccaacactttgggaggctgaggcgggtggatcacctgacgtcgggagttcgagaccagcttgaccaacctggagaaaccccgtctctactaaaaatacaaaattagccaggtgtggtagcgcatgcctgtaatcccagctactcaggaggctgaggcaggagaatcgcctgaacccgggaggcagaggttgcagtaagccgagatcgcatcattgcagtccaacctgggcaataagagtgaaactccatctcaaaaaaaaaaaaaaaaaagctaatctgaaagtatataatgaacaccataaatatttgtataacttacatgtttgttgttggggctgcttatttttgttttattagtaattgttcatttaaaactcttatgtaaa

SEQ ID NO: 132422 - DNA, 1035 bp, Homo sapiens
tttatttttaaatataagataattaaaagattgaggtaaatacaaagtctcttttcccacagtcatgggcccatttctctgccccatccctcagagtcaatctgtgtgatgagtttgatggatatgccttagtaaccaatttttatttgtatttcatttttaacttatttttagatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgagcaccacccagaggtgcttctgtacaggccgtccttcagccaggcctcagagacgattatggggagatttctatcagttctagtaaaggaaatgtgaaggccgaaaaaacctgtatttgttattttaatttatagggcaaatattcaattggatacgggggaggtttcctttgagtaagccaataaatattgactcagcaatattctgctacactggtgattttgatcttgaaatttcaaagtgtttctatcagttcaccagtccttgctacattttaatttcctttttgctgatatccaggttgggttaaacccattttaagaggagtttgagccaggtgcagtggctcatgcctgtaatcccagcactttaggaggctgaggcaggtggatcacttgaggccaggagtttgagatcagcctgttcaacatggcaaaaccctatctctactaaaaatacaaaaactagctaggcatggtagcgtctgtaatcccagctacttgggaggttgaggcaggagaatctcttgaacgtgggaggcagaggttgcagtgagctgagatcgcaccactgcactccagcctgggtgacagagtgagactacgtctcaaaaaaaaaaaaaaagagtttgaaaaattgatactttgtagacaaagtcttctagatgtcaaaaataccttaaaagtgatttcatttatggataagaaagt

SEQ ID NO: 132423 - DNA, 1163 bp, Homo sapiens
tacaaatcaacgccgacaaggttggataatgcccattgtcttgctgttggttgccttttgcaaatgttttgttctttgttactactgtgtctttgtcccagttcactatttgctacatttgggcagggaaaaaaaaacaaaaaaacaaagctgtttggagtgggcatgcagatcctttcttaagcacattttcctgccagagaatatttatttttattgctgaaattaaatggcccttctgaagagtaagggagaatcatgagtccagtgcctttctttcattttggtgtcatttaaaatttctgatatttaaatttttgttagttgccaaatgtatgatactttcacacataatttctttaaaaccatgtgttgatttaaatccttttcatacttctacaaggtgatcataaaagctcttccatgagttaatcactgcacaaataattgtgtatgtgtacatgcaggagtctgttgaatattcatgaagcatgcccatgtaattgcctgaatcaggaaacgtaactgtttcaatgctcgtaaatctatacttggatcttctcattttctgatgaaattataaaaccaaaatcgaaacacaaatttataagaatttatataccataatttgatcatgaaaaggaagaaagccatcaacaatttttttcaggaaacactttatgaatattcatcagacttccatgttattgtaacaaataccatgttattgatatggataaccaaagatgctatatctgaaggaatatgttttctattgctataggaattactgaattcaagtagaattatcttccattgttccccaactaacccttttgctcccacaccctttaaggtttgtgtcagtgtggaattttcgtatgtgggtgtgttacagtgtgctttatgtgtgtgctgtacttgatgtatacatacatggcatggagtgatctcaagtatacactgcatttttgacaaggaaggctaaacaatctttgttaaagagctatattttcataaataaattttaaaaagtgtcactaacgaggcagatacatgatcttgatgagaatgagggtgtcagggatatgaaaacataacacctgattgcccctcaagtaaatagaggcttatattggttttattagtcaggtaggttaggg

SEQ ID NO: 132424 - DNA, 1070 bp, Homo sapiens
tgctaacaaccttacgtgaagaatacctccaaagattccataaatccttctaagaaggtactctgtactcactagtgtagtggttctcctagattcactaagctacttctaggggaagttcatagaacatgagaagaaagcttaatggagtaaccagagcttttaataaattaggagttagtgttgtgaacatggttcatagcattgaaaacatgatgggacagtcattcatgaaatcaacaaaaatgtactttgtatgaaaatagagaatttttagcaaaatataaattttaagattataaaatgggctgtattttattttgcatgtgattttcattttacacaattgatatactactacatgtattattttccattttgcttaatttttctctcaattcttgacgttttgtaaatctatcaagcttgatacttaaagatctaattcattcaatttagttgttgtgttgcatttcaatatgtgaatataccatagtttattcattgtcagattcatattagatagttaatagttatttgctattataataattctgttcagtaaatatatttatttctttatacttacacatgaaaatttatctagggaatatatccagaagtggaattggaattgctggcctgtaagtttatatgcattttttactttcagttgtcaaattgctttttaaggttgctataccaattattattattatttttctgagacagagtctcactctgttgccaggctggaatgcagtggcacgatcctggctcactgcaacctctgcctcccaggttagagcgaattctcctgcctcagcctcctaagtaggtgggactacaggtgcgcaccaccatgcccagctaatttttgtatttttagtaaagatggggtttcaccgtgttggccaggatggtctcgatttcttgacctcatgatccacctgccttggcttcccaaagtgctgggattacaggcatgagctaccacacctggctgctataccaatttttatttctatttccaatatatgaatgttcccttttccccacattcttgttac

SEQ ID NO: 132425 - DNA, 1044 bp, Homo sapiens
agcaagatgcattgtggctacggtgtttctgaatagctctcactgcttaggctttagggctaaggacctccccccatcccctgcctgtcactgaatattttaaggactgtttctaagttctaattcttgtctgtcttctaactctgctttcttcgtcatactctgtcctgttgtatttccaggtcagggctaatttttacctctctgccttgcatcctctggacaaagatttcacttttactatttctctgtcaactctttgacattgtttttaggatctccctcttggagctcttcccaccagtcctaccctagtgtcagacttagactctaggagccctaccctcattcgaggcgttattctttaattgcacaggagggaaattcaaacacaaaaccaatgggtaggacctatagcaaagagattttattctaatagcttaaaaacaaaaacttaacattcaggtccaagaaagaatgagatgttcttggagagcctggacatttgcttgccagaaatgttgcaaagcgcattcaagctcagatggatgactggattagatgacttctgatctttaattcaacatattatatcagttgagacagttcagtattcctgtcaggggagaatggctgtaattttacatactttcttttgattcttcagtttctgtaaatatcaactgaaaacatttattgaatcagagtttttatagccttctctgctttaagaggaatatgtggacatatttctttagaaatccaatttttaccaacagccaaggcacaggccataatcagtttaaccattctctattgtcctctcagcctcatttattgatacaaagtattcctttggactaacaaaatatttcttgatgttgttattattgtacagttttctttacagtcaatcagtagactggacacattttgttacatgcctggcatttggcaaaatctaaattgctacataaacggaaggtgaccttgaacacagacgcgttgtaaactgcttcttccattaagaagtattctgtgcca

SEQ ID NO: 132426 - DNA, 1060 bp, Homo sapiens
tttatctttattttattttttcattgtttaaaatataatcagtcttctttcctgacataatgtattatttgaagggctaaaagcaaatttgctattcaatatatttttgtagcaccatagagaagatgtctttatagatgaataaattaaatagggccagaattggaatgcaactttttcagctagcctagtcttaaatccattgatctgtactttgattcagtttttgacctttgaggtaaaagtgtcacgaagagattcccagaggccccatgtattctgcccaagtgatcagtatgaccaggagagctgatgacctgtgatagcactcacttctatttggattgtgctcctcagcttacagtagcttcacaaaagtgacatcctttttgtggtagagggtatggaggttcagcagtggtgatttaccccatgacactctgcgtggtagcagaactgtgtcttccgactccaaacccaagtgacctcgcactttgaagtgaaagagtgaatgctttctatagaataaccaatatatttgaaattatgtatactcctctttcagtaaattatgacattggtataaatttttattttattacaacataaaagacaatctttttatctttgccctccagtgctgaggttttgtatacttattattttaacagataaattatggacagagggtttaataatctttgtgatttctaatttttagttgcacaaacatgctgtattgagttcagatacagtatttctcttatgttactattcattaatttgaagatcttgaaacagtttactttaaaaagtatgtccaccatgtcagaagcaggacagcaggacagcagtagacttgaattttcatttatcagtttctaaacattacagcaggagtcagcatctggcacagtgtcttccgcataataggcattcagtcagtacttgttgaattagtaaatggccattcacgtgtaaatagtagtcttttctttgagaccaaagtgaattttttaaaattgcttcaaattagtaagagtctttccataaactcaaa

SEQ ID NO: 132427 - DNA, 1008 bp, Homo sapiens
atatttttaaataacctacccaactctgcctggcacacagttaccacttagtgaatggctaaaatatggatggacacagcatttctgtgtggataggtcttacttgtttacatactatccttttaaaatacaataaatttggcccataatgatacatgtcagataattctctgtgacattcaggaactcacattttcctgtttgtttattgtttttcattcattcgtatcatgatgtcaagaaatggagctaatcagcttttctgaggatacacaatacatagctaaagttaggattaggactttgcataatatgtggtccagtcaaatctcatttaaggtatattgagagatgatgttaggatttgatttatagtatattgaatgaatcagtacaatggaataatttggaaaattttgaagaataaaatgcatagtttagtattcatatgggtgattagaatagggtagaacaagaaacataattccaaattttatagcactcaaagtctagtaccctatatgtatccatacatgtttttatgtgtataatgggattattacaataaagcaaatgggtgtcatttgtatctgtggtcctaggctgtgcaataattgattagaagcaaagatattctacaaactagaatttcatcctcataaacacatctttctttaagttatgttcatacagatgaacaaagttgaattaacctatattaacctagtattttgaatccctatttctgtctgatgctttatatatgttacttcatttagtcctcagaaaattctatgagatgggtaactctgggacccagttgatgaatattgctcaatgtaattcaaattttaaatattcaagctgcttcaagctgggggcaaatctgatttcaaatcttatgttttgccactgtgtatgttaatttgttaatgaaataaccatatgcacaagtcacagcattttagaactcttatttgtatagagtatagaacttttgcatatatc

SEQ ID NO: 132428 - DNA, 1050 bp, Homo sapiens
gtggtcccagctacttgggaagatacgatgagaggatcgcttgagcctaggaggttaagattgaaggaagccatgattgcaccactgcactccaggctgggcaatagagtgagaccctgtctcaacaaaaagggaaaaaaaaggcatagaagcctgtgtcctaccctagaactagtgactcattttctggatatggtaccccagaatctatattaaaataaacagaagcctctcaaatgattctagtgcatccctgttaatactggtttccaaagagatattagggtcttactgtcaattccctgataaggtgaatacttattctccattcttttcacactaacaactatacatacacattttgtgaattggtaatacaaatatccatttatttaacatgtaacatgcttttttttttttttaatcacaggtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaaggtaatcctatgttaatctggtttttagttagacctttatattgtctccaattttttttaaattccaaagtaacttactatttcagaatggttcttaattattcagaatgctttttaccctcaactattcattataaaccaaggcgagtaaagaagtgtaataaagtcaggattgactggaaccagcaatgtgtttataaactatggagtaggcttctgaatagagcagatttctttctatcctattcattgtcaccatttctcagttggaaacaggcagtcatttacctttctgtttctgccttacttctggatgtcattgcaatgttctcactttagggggatgctcttctgcctggattatttatgtgaccttcataaaaattctaaatgcccagcctttccttgaaggaatcgactttaattccacatttaga

SEQ ID NO: 132429 - DNA, 1049 bp, Homo sapiens
cacacaaactgctcaataaatggtagctggtctagttgttgttattcttttcctgatagttgaccaaagtgatattttctttctagatgaagtggcaaagctagatttaacttgttgatctgaattcataacattagttctttcagatgtactgcatcctgacttctccagaaattaagatgagccatctctgaaaatagaatttgctaaaaaaaacctgtttgatttaaaatttattgtacgcaaacaataatgtattctctgataagggaaggttcaaccttattcctgcctgatatccctttctgagcaaaaatatgatgatgcctatccctgttttcaggattaaaggaatcgtctctgctataattctttgctagagaattaaagtaggcctgtggctttattttatcatggtttttttgtttgtttgtttgttttttgttttttgttttttttacgtattatttcactgtatatttattgattttattttaggttgatgcttctactcagaaaggtgaagaaagtgagacatttgatgtagaactcactaaaaatgtccaaggattaggaattaccattgctggctacattggagataaaaaattgggtaattttaaacattaagtattcttttaaacttgacaattacctctgatatctatctcttataaaatattgagttgatattacatgtttcaggttgttggataaactggttgaaaacttccttaggaataatttagtgtaggtgactcttatattgtatttaagacagacaaaacaattatcttattctttagcctgtgtttctactagatgatacgtatttattctgaattagagctttatagttggagaatcgaagatggatattctttgaatgtgctttgaaaattgtgaaaaataaactatttctaatcttagaaccttcaggaatctttgtaaagagcattacaaaaagcagtgccgttgagcatgatggaagaatccaaattggagaccaaattatagcagtaagttacacatttaacaatagctttgtt

SEQ ID NO: 132430 - DNA, 1048 bp, Homo sapiens
acgtacagcacccactgctttgggcatcaccctctcctcatccccaacttcaacaccagagttgcgggtaagtagttaagagtagttaatgtgaaagtcagagaaataacacttagatgacgacagtgatgtttacttagaaactagacttactaatgttcctatattagtgctaaagaatggaatgaaattcaaatgtagggatgctttagcactaatgatattttattaatcaggaataatgtgtaaaacaaatgaaaaataggttgcttaaacatgctagattattttacatttttatttaagcagcatatttatgaggataatgttttaaagtatgggtaaaagtttaaaaattatttggtactgatacctaaaatgtttaattctgtctttttctcagttagaagactctctgtaaggtgggtcatagttctaatcattctctttcatcaactttcccattagtatttttgtttttgttttgaatgtgtggaggttgaggagtgggggcaggcttggtgagtatgaataaggcttactaaaaccttttagtgttattgttttaaagtatgtcttagaactgttatcagatttgtaataagtagtcattattctgacccagttatataattttttaaacaaaagttattcttttggtgttataacaaaaactttattcatatgcatagcattccatccttgtcaacttgatatgaaaaaagctagagaatttcaaaattattggaaagtagtgggtatctcagcagatttacaggtcgcaagactacagaggataaatatcaacaaaataatttatccagaagtctcttaaatatttaagaattacacccagtttctagataagccttatagtaaatacacgtcctatattcttttcccatagatgtaaaaaatctatgttttgttctattaaagttttttctaagcagttgctacaaattcttttttaatatcctaacctcctccacaagccctttaaaactttattagaacacttgtaatttccatgattctgttgttttta

SEQ ID NO: 132431 - DNA, 1028 bp, Homo sapiens
gttcagcattttttattggcgtgttatttcataggtgtgattgattgccctgcctatatgattaaaattcagctccgagtttgggcttatatcatgtggccttggggcccaccatgaagaagaaagatacctcatcactcaggaaattctgagaggggaaattctgagagtttagaggttacttcataggatctggggacagaaaaatatatgtgtggatgtatatatttatgggtgtgttttaatgagtaccctgaagttgaaccctggcggtagtttttgaattttcccatctaataaatggtgctgcattgaacatttagtgatgcacacacatctttgtgtattatcctaatgttcatccttgaaataaatttcccaaaatagaattgctggattaaaggatttggacattttgaaatttcatttgtatgtccttgtacccttgggatattttctatgaaatagtttatggaatgtcaaaattcttaataatccctgcattactcttaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccaggtaagaacatttctttctgttagttattgtaatacctgtagtaatttaagaatgtgatcaagttatggataatttgaagaatatagtgacatttataacatctgaaaacattggaacaaaaagtcagttttgtgggagtttagatggttcagacgttttctattacagttttatcatcatttaaatttgagtattatatgttgtattatagaaatattcttcaggataaagtgctaacaattaccttggaaaaatgttattcaatttcttttttttttaacaaagaaatgattctgataagatga

SEQ ID NO: 132432 - DNA, 1051 bp, Homo sapiens
cccaaaagtctcttctcaacacattgatctctttttcatctgtgattgtagaaagctaatataatggttaagttattggtaactttggtaacttaatgagttttctgttttatttttaaggataggtaacaaactcttatgtatagattttggtgacatattgtgaaatattttgatagcttctgtcagtggatgttctttacctaatgttttattttaaatgatatctcaaatgttttgtggataatacaaggactgtatgttttctgtataatacaaggatgataggaacaccgtgatgaaaaaaaatctaggtcacaaacaacttagctgtgtgactttacgtaatttcatcatccttagcattgagatgatacttgaaaggttgttcaggagattggatcagagttagatccttaaaaaatagataaacattttttttctgccaatgtatgttgaacaactctgtataaggcattcttctagagaacgagggcatagtaaaaataaaatagtcaaaaatttccactggagagtttttgcattctagtcggtctccactgactgggatgaaagcttcatgacagcagggtgtggatcaggtggtaatgagtgccatgaattaaaacagggcacagtaagttcgtggagtataatggtgctgtcttagataggaatgcgaaggaggacttttctgtggtgagattaggcacacctgaatgaaataaggaagcatgtggatatttggggaagaatatacctgtttggtagagtgaacagcttggcactttgaggcacagtgaggaggggagcacagctagggctaagtgggtgagggacagactgctaggagatgaggtcagagagtgactcaaaaacatcaatgaagtaagctttctgataagtagttacagataaaaagtcacaatccaggcacccaacataaatatgaaattaggattgactgcattgctttattattatttagatttaacttcaaactcttttaaaaggcacacacaaataattatagaatcatttcccaaagtgg

SEQ ID NO: 132433 - DNA, 1230 bp, Homo sapiens
ctgagcctggctgactttaggcagttgtgcattctgaagcgcatttatccccatgaacccaaacacaagaagaaggttaacaaacgttctacagcagcccaaactttttaccttatcgaagacatcaggtttctcctccatgaacccattgtcaacaagttctgggaatacaaggtgttaatccggaagctcctgaaggcctataggaagagcaagtggaaacactgtagagtatctaaaggacaataagcccaactacaaacttgaccgcatcatcaaggaatggtaccctacgttcactgatgccctgcgagacctggacaacgccctctccatgtgcttcctcttttccaccttcccacggactggcaagggccatgtgcagaccattcaccatggagttcatgcactacatcatcgctgctagtgccctgccacaaggtcttcctgtccatcaaaggcatttactaccaggtcaaggtcctgggacagcccatcacgtgaatcaccacttatgccttctcccatgaccacccaacagacatggactacagggtcatggccaccttcaccgagttctacagcaccctgctgggcttcatcaacttccacctctaccagtggctcaacctccactacccactgaagctcgagggtcaggcccaagaagaggcaaaggccagtgagggcacccatgcattggactctgagagctccatggagaaaatggctgccctcactgccagcctggcccgcgtggtggtgcctgccacagaggaggagcccgaggtggatgagtttcctgccaatggggagatgtcagcacaggaggaagaacgcaggaaggagctggaggggcaggagaagcacaagaagttttctgagggcctaaagttcttcctgaaccaaggggtgccccgtgaagccctggccttcgtcatcagtttttggggggaagtgtcctgggacaagtctttgtgcatcggggccacctatgacatcacggactcccgcatcacccacaagattgtcaactggcctgggcagcagacctccatcattggcaggtgctacatgcagccccagtgggtgattgactcggtgaacgctaggcttctcctcctcatggcagagtacttccctggggtgcagctgcccccacacctttcaccttttgtgaccaagaaggaaggagattacatcccacctgaaaaactgaggctgctggct

SEQ ID NO: 132434 - DNA, 1038 bp, Homo sapiens
gtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacaga

SEQ ID NO: 132435 - DNA, 1055 bp, Homo sapiens
gtttcagaggagatgaatacatagaatttcagatcatttgaccacttagaccagctacatattctgtgcactagtctctttcgcaacattagctaggttataatccagcttgtatggtgcatgaaaagttcactgtctcctgaagccaattaattttgccttcagaccactctgttcaaaagttctttcttatgttaagtcatctgacttcctgtgtaggcaatataatatagtgaaatggccagggaaatcagacagatctgagtcataactgagggctaagtgggagactttgggcaaggaacttaacttgcctcagtttcctcatatgtgaaacagagatactgatggccatctcatgagctcactgagaaaattaagtggtgtagcatatgtaaaacaccaaagatggtaccatgcttatagttaagtcctcagcatggctatcgtctggaagttttgcctttgtgctgttgctacaacctgaagcatgcttaagcggtctacattcctttccacatcaactgctatatcttccctgtctacccttagctgttctgcaatgacataatttggtgagtttttcaataagtaaatgccataaagttaggttttcttccacagtgctacctagaagaaatacagtacttcagaggtagtcttaccaataacaaaatgaagcaggaccatcaccagtaatgcatcttaagctctaaataattcatttgcttcttcccttttggggggagccatgtcatacatttggtcaaaatagcaagaaaatagtatccatgatatcaaacattttatttttggaattttgatttagctcttatgtattcattttataatgaactatctcattatatgcatagtaatagtcattaggatgagctgtactttgtgttaaggtactatcaaattcttttgtgtttttttctgcttgatttttttgcaaagtaattatatcttttcttttttaaatggttatatctactttatattttctaaagatgtgctttcaactttcagctatgctcatcttctctttgcct

SEQ ID NO: 132436 - DNA, 1069 bp, Homo sapiens
cacgatcttgtctcactgcaacctccgcttcccaggttcaagtgattcttaacgcctcagctaccagagtagctgggattacaggcgtgcactgccacgcccggctaacttttgtatttttagcacacactggatttcaccatgttggccaggctggtctggaactcctgacttaagtgatctgctcgccttggcctcccaaagtactgagattacaggcatgagccaccatgcccagccagtatcttggtttgtttcttctctttctatcctgattcagaaagcacataattgataatggcagccatcacatttctacattgaacagatattattgaatctttatggtgagctgtgctaaatgctgtggtgaatccaatgctgacagttcttaaaatctaggtgtgatgcagttcagaataaataaattcaaatgacataggttgctttgctttgttgtagttttcaaaaatggacacaacagagttcatatttgataatacaaatagcccttgtcggtggcatgatagctttatccatcttttttagtttatgacttgtggttatttttaaaacattgaaagaattttgaaaaaagtcataaatgtctgtaacactagcacttttaaggcagataatagacatctaaaatcttcagggcatggctatggctttagaatcatctgaataagttgaaaatatttaagaaatataggtctgttcatccaaagaattaaataatttgcctttgtcacgatggaataaataaaatatcacaggttatttttgttgtggtagatgccttttaacaaaaggcaatccctggagactgttgtagaaaaggacaaagcaaaacgggtgttttggttttgctttattttgattgattgttgtttgttgtcattactttctttgtacaatcacttttccatggtcaccctcttttctgctttatactaattgccctgttgaggtgtttccatgtcaaatgcagctcttgtcggaactgaaaatggcagtgccaagggagctgtgcaagtataatcaaagctggaagatttcctccatc

SEQ ID NO: 132437 - DNA, 1035 bp, Homo sapiens
gacgacccattttgagaacttttaagaaatcttgccatattgcttcccgctagactgaacacatttacttctttgaaatattgaaagtatgtcatctgatttaaaacaaagcaaagtgtacttttttttccttcatgtgagtattttggtccattttaagagtatttatgaccaggcacccgtggctcacacctgtaatcccagcactttaggaggctgaggtgggcggatcactcaaggtcaggagttcgagaccagcctggccaacatggcaaaaccccatctctactaacaaaaattaactaggcatggtggcacactcctgtaatcccagctacttgggaagctgaggcaggagaattgcttgaacttgggaggtgaaggttgcagtgaactgagatggtgccactacattccagcctgggtgatgaagtgagactgtctcaaaaaaaaaaaaagaatatttatttttctttctaatttatttactgatttatgacttctttatgacatatatcctgagcagaatctacatgtctatcaatctgttgatctatctatgtatatgcagggaatttttttcagttctttaaatcataaaatcacttttacttgaaatcctgaaatatgcaaataactaaaacacgtggtttggaaattttagctagtatttttagagcctcatagatcgatagaaaaatgagcaaaaactatctttctaaaactcctgaatcactattacttagtgtgtgcagaagctcgatagtctaaaagggaaagtaaagattcttaatagcctatttctttggccacaacattatcagaaatgtttaaaatagtttatcataaattttaagtttatgataatttatggtactttggttccagtcatcatctggaaattctcactgaaaagcagcaaacaaggtttagtggattactgtgaagaagtcatcttttcaatgtaagatgctgttaatttacagtgtggccatctgaaggttaaaaacgatgattttctactgtgtttccccc

SEQ ID NO: 132438 - DNA, 1034 bp, Homo sapiens
ggccaggaacaaggttctctttccagagaccacagaactccaccctaagaacatatgcagtgaaaacttcaccttcacatctttcttatttgtttaaactgttccaaccttccccctttactgatagcttttttggaagataatcttactttcttagttcaccttttatttggttttgaaattctgggcattttctagacaatagaatttcatattggtatgtgcatataaattaaaggattaaaatgatttatatgagtgtgcatttttgtaaggatatgcatatgatcagttctttttgagagtctatattgttacaaaaataagaattgttccccacctccacatgaaaacagacaattctaacagactgaatttctaaactgagtggcacttggtattttaaatttgattactattgggagaaaaaagcaatttcctatttcttaataaaaaatacttggaaaaattcttacagcattcttaaagctttgaacttagaaaaattctatataaatgaaaggcatgtatttatgtgccacttaaaattaaagttttaaaataaaaaaagagaatttacagctgaattacctaacactgattctgtcacaggacagaaactaaggaatcaccaccccaaactcaaaaaagattatcacctattatgttaaacttatttaaagcctaatgtaaaattattttttattaggaaaactgaattatgctaaaggcaagaatatgtaacatgaccccaaaagaagcttaaatacatgtagtattaaccttttaatatatagagtctgttcacaatttgcttggtcaggaatatcttggtcaaataagattagaaattgattttcttaggaattactatcatggaaatctttggtgaataagtgatttctattttaatgatttaattgcatcccccacccataccatcactttaaaatttcactttatcagggagttttgttagttccaagatgctttatgaccaagaaggtttattaattgaaaaaaaccaacatgaa

SEQ ID NO: 132439 - DNA, 1039 bp, Homo sapiens
agagagatacagtgaacatcactgcatgtaactctgtgcctaatctgattgggtgattcttgtctagttcttttcactgtcccaagtccctagcatactgcctggcatgaagtcaccaagtagaagttcagtgaaattttgctacgggaataaatacattcctactgtagaattactaagttaaatcttatgtccatttctaaggcttttggtaaatattggcatagatcttatcaatttacattccctagagcagtgcctgagtggcttaactccattgttataagccgtaataatttcaatgtagcacatggctctataagcaatttcaaagcatgtcctctgacagaaatttatagaacattctttatggccctgtgactttacccatgcacctcttttttatcatttgaattttatttaaaccatcaaggaacacaccatgtgtcttctccccatgagccaggatagctccatttgtgaagaaaatggagaaattgagagggtattgtacaaaggattgtacaaagctttcaagtaaaggcagagcctgcttggtctctctctcctttcttcctccttcaggacacacaccctcacccatcatcagtcctttatttattaggtaaaacctgttaaagtaaggattgctgtcattctctacatggagatccttagaaataaatacctcaaagctttggactgggatcttaagtatctggcaggctagatgctgccccaatctggccttaatagttgtcttattctacataacactcatacacttataaataacctggacactttcctctcttcaacactgtttatcccagggcaaaaacagaggcagagaaattgtggtctttttagctttcagttggcagtcatcttctctgccttctccttgtcctctgggaacagagcccaaactgtttccttgtctcaggactgactctggatttgtggcctgaagtaaaaatgtcagatttcagctacaaaactcatcccacacacttgatttggtagcctgtcatttact

SEQ ID NO: 132440 - DNA, 1003 bp, Homo sapiens
tatttattatcatacatatgttttcttttagttctgttctagtctttttgccttaagcctagtgcactgtaattgtgattaggaaactctaaatactggtgtggtcttagacaaatcacttaacttcagtaactcttgagttttcccatctgtaaaataacaaagttgtatactaagatttgtgttctaatattttagattttgaatctattggagtccaagaatttgaagatcttcagtacttgagtctttccaaagccgtcattaacatggatcttttggaaaattcagaaagttttctgtttcttaaattattttttgaatgttcattttaaacactctcattgaataacaataattgggctgcttatgtgcttggaggccccgtatattttgctttatacctgaggaatgcgcagttctcacaaatgcatgtcctgtcctgcaccattctggtgcaacaaatgattgatagagattgagttattataacagaaccttgttatggaatcagtgtctcctactttgaaaacaaatgactcagccagacagcaacatttattttctctaaatgactagggatgtagcaatgggagaccattatcctgtgacaatattcggtttcattgacattatctcacaaatgtaattggtccattactaaatagaggttttgttactgatgaatttcacatgatttctaaaaccattaggataataaatatgccatcatagtaatttcattgacagaatgttctttttttcttcatttacatttgttggagaaaaaaaatatagatttaggttgaacttaaacactacaatttataccaattttgactacttttccattaagagcaacagaatattgtgcagagtaatcatatttgcattgagctgctgaactgatgaccttaaaatttttgtaattctttttctaccacactaaatcacatcaaatcataattgttctcaagcaattagtttactacctcagtgtaat

SEQ ID NO: 132441 - DNA, 1046 bp, Homo sapiens
gctaccaattgttgtagttatttatatgacttaattcaagtatgtaaaacaaaaacgtagaaaggatagaattttgcttcttgtattaaataaaaagcatttttgtaatttatgatccagccctcaccaagtgaatgcctaagcaaccaggttttttttaggaaaaaaaaaaataatcaggaaaagcagttctagtcatttaaaatgtatcctgtacttttgggtttcacagtgggcaagtttacccagaggcagtgtgacagcctattagcaaaataaatagatcttccaaacttgtagtcctctgctcttttccctccacttttaagtaaattagcttttcagtgcgtctgggcttgggttgtggtaggatgcattaacttctccccacactgttctgattgcgcagcaaagcgtccattaccaataccatatccaaagtgacgtttccatacaggctgcctgctgtttcattcataaccacaaaacaaactgaaatgactttacttctttttacaacttgcaaagagttaatggactgtgctggccccctgccaaaacctttaagaaactttattaatgtgttatgaggctgggacaccatagtgtgggattttattggttattcatcttaatgaataaaaatatgtatgcacaattaaagccacattctctagcaattgccttctaataaatgttgagtctttgtcagtgcccgtcattgcatttgcttatcgattgtgatccttttccttccaaatcctaaagttaccagtagtgcaattacgtgaactttaaagaaataccagcttagtattggaaacgagcaattattcagtgatgaaaagaacataagcatgtcataaaaatgaattaaaaatatctccatgtcagaaacagtagttataatctgcagcatttttcccactatatatgaaaaaggctgggctgtgatgtattgatgattcataagacagaggcaacataattttgctgtagatcatgtaagaaagtgatagtggaaaaaaataacttgtttactctga

SEQ ID NO: 132442 - DNA, 1097 bp, Homo sapiens
ttaggctgctgggagctgtgctgctgagatagtgtgggtgaaaatgggatgtggtaatgtgtgcttgctgaggagctgagatgtatccagttccataatttgccttcaggaccagctccctaatgtgtgggcctcttgttcaaaaattaagagtttcaagatggtgacagaagagcatgaagccaagcatggggaccacgtaagtggggctctatgtgactgcatgggtccatgctcctgacactggccctgtgtgctttgagatccttgagcatgctcaggacctgtgaggagaagagcaggctggtggggaaggggaagttggtgcctcattcagggatgtgctcagagaagtgcaggttctctctttgggctttccttatctctgtcgcttcttcaggaaggggaattaatggggggctaggatgtggcctatttggggagcagagtggggagtaataaagaagggttgaggagggctctgctagaaatattggaaacgagacctgatgcatagcccgaaggtggcatcgattcttaagtaaaatgatgtgaggtgaaatgaggggactcttccccccttaaatttggagcagtgggagttgggggtatgtttacaaaccacttctggaatgttgagaacagaggcaaggaagcatgtgataacagttccttacagttttaggacacagggaacacattttcctaagagcacagatgagggacataaaactcagcccagcagcttggggtatcaggaaaggcccagaaagagatcctgagcaatgcatctgggtggagacctgggtgtccacatactgttattcatttagcactttggactttatgctaagggctatggggaaaccactgaaggcttctggagagaagctacatcagactttcattttctgaagtatttcggtttcccatgttactgtgtagcagtggttcccaaagtttggtcccacgaccagcagcactggtctgacctgtgagcttctgggaaatgcagattcatgggccctatctggacctattaaatcagatctctgaggatgggccagaaactctgttaggacaagctctctgggtga

SEQ ID NO: 132443 - DNA, 1054 bp, Homo sapiens
tcaaagcatctctctctaagcctatgaaccacaacaagggctttaaaatagcttcagataggcacctttgccttgtttatgaagcgtgtactaattagagttgtgttttctttgtggtataagcctttgcaatggatctacattgtccttgttatcaataataactaatgagattaaaatttaaaacaggtgtctgataatccttgatgaagagaattcaggggatattgttcctgattttgctttctctccacttggaaaggaggtggacgagcccatcagaccacagcctgttgctaggaggaaattccttggctcaacatgcagaaagtgtagtacgcctagattacagtttaccagggacgagggcctgttgctttgatgcgctcccaagactggagttggaaaagtttttttggtgtagttccatcctctcatagtgaagttcttcattttcccagggatggaagctttgttataagagtcccagtgtagattctgatgtaatgattcaagatattggctttccagaggattcttaatatattgctttattcaccatagctttaattccattgtgttaaaaagaatatgccactttcttgtcatctgaagaactcttaatttcttatatcccatcaaatgtagtattatttgctcaagctttctttccaaattttgctctggagtgtttgtagacagttacatttatctctaacattgctcaccatttagtaaaagaaacaaaacaaaacaaaatgccagcaaaagtaactcctccataaaatacgtgtaaagcaggaataacatgtgaatgaacaaaatcctggcttgaatctgttcttttgcaacaaatgtaatgcggttgtaattttgagaaaagaagcctgcaaacaaaaatagttagtagtttaattttaggtttacagttttgacattgtaaccctaaattacatcgtatttggaaaaatctcttcaacttagactttttttttttttttttttttttaccctagtgctacaagatgactctatattaaagtttctctggaga

SEQ ID NO: 132444 - DNA, 1147 bp, Homo sapiens
tttgcattcagaatcatctgaaaaataaagactcactagttatgtttacagagaatcttaaaacttttggtaattgaggtttaacatattaaatatctgatagacatgtggactctgtcgccttttgctggctggtttgccttataggcttaacttctggaattttttttgccttttcaaacaaattcttctggttgaatatcagcatatggtaggaggctcactctgagacaggataatttataaatgaccatttcttgtcttgtgatcttatgtatataaagaatctagagtcatgagtcaaattgggatttttgttcaggaaaaaggttaaaaaattagacatacaattggctttctttgattctgtgtctataaggagaggaagaatgggatttaatttaaaatatatttctgcattgaatactgatatttctgtttttgaatttgcttttttttaacatctggtacacaccagactaacctgtacatattattcctttggaagcatatggttgtgggccctgatccaaaagtagcttatgtatctacatttcagagtgtaaagtttcttgaagaaaggtggggagggaacaactatgagatatgttgttaattattgtttattttctaggaaatatggcaagctgtaaacttaagatgacaatatctgtttttttttgaattatgtaatatgctactttggagaaagtcgattaaagaaaaatttggaagccaattcttacgtgccctaggaaaattaataattcatgcagctacttctgtcctatcagtcatcttttcactgccacatttatacttatgtattatgaactgctgtttttttagttataaatgccacaggtagatatggatgttgatactgatatagtctatttatctacttattacctaaaccttgatgcatattcttgtatttacttagccttggtaatggcctggtccgttatgcatacataactattgaggcagtttttgaggttctggaattattcaaaagacctggccagaaatggttaaatggcaggtaattgccgaatacatttgcccctcatttgcctaaaaggtattcggtgcctgagtgtattcttgccatgtgctttctttctcagctgcggctgattca

SEQ ID NO: 132445 - DNA, 1074 bp, Homo sapiens
tgtactttttttttaaaaaatacccaattaggtaaatctaaccataggttgactttctggctggacttgaaaactcatttatttccagtttgtcttccctcatgaaacacaataaaacaaaacaattccacccccaaacctgctcctcttctagattctcaagggacttaggaatcggggtagaagaaaatggtcaagacagcccacctgatttatttctcttacttatccagatttgttttggaatcacatgccagcttctccaccttcaaatgccttatgatgcagaatattatatattttttgagaaggtaatataagttgctttttcttctctttcaaataattagttatcttttttccacttcatatgctagaagtaaaacaataaagaaacctctgggaattttcattaagtgattggttttcatatattctgtctttctaaggagggagggaaggaatgtcatttaaatttttaaactctagtcttgatgactaaaatgttctcaaacttggttaaatcagctatctctttacataactattggatttctttcagggggctgtttccttaccgacatactgtacaaataaatgcagtttaatatagatatatcttgatgtgtttagatttggtaaaccctcttatctttcaaacatgcatcatttatttaaaatgcataggcatatgttcagaacaaagttattttcagtacatatatattcattagcctgtgtgtgaaagtacatttcaaatcacaaccatttcaatatttgtttttctttccaaactttcttttctctccatcttggtttaattgaaccctagacctgaactctttaaagcattcctatggagccagggtacatttgaatgtctttgactgatataaaataattgctttgttgatcatatacccatgcatgataagatatgcataagaagaaatctggtacagaagtataaataatacttatctttaagccagcatctgtcatctgcttcagcagacagtgcttgctttcttcctagcacaaaaaggcctgaaagatttatggagcagctttgtt

SEQ ID NO: 132446 - DNA, 1001 bp, Homo sapiens
agctaagacttctgtgaaagtcaggagagcagcaagaaggacataggaaagcttgtactggtaggaatagaaagaaggaggcatattattatggatgtagggagaaggagttgggtgtgactgtgatgtttctaatttcgtcacctgggtaaatgttagtttccttaacagaggcagtggaagaaccactgagtttggaggtgagttgttcagtttttttcttctaggttgggtaggcatgacccaagtgttgatgtctgacaggcaaatgaaaatacaggtctgaatttagctgttgttatcccaaacctttgaagccaaagtttgattgaggttgcagagggtgataaagagaaccaggggaatgctgacttttagaagaattggagttaatacaggagaatgatagtgagaagtcagataagtaggaggagaatccggacaccccaatgtcatggaatcagagatgagaaattaggcacatgctgcactaatctaggctgatgtatggccagagacttttatcatgaaagtactgtgtaataataataacagtagcaagaacaacaataatagtatttactatttttttagtacttattgtgttccaggcattttgctcaatgttttttctacatatcccatttgtttcaaactttgagcctattatctttgtttaaatagatatacaaattcaaattcagagaggtcagtaatttgtctaaggccaacggctaataagtattggaactgggcatggtttgtgaactttgatatgctgcaaagttactaagcagttattttattttttggtggggatctgtctatggagattgtggagattaaagttatcggtaaagcttactatactcattcccattagctcagaagaaatgtaattctttcctgcttacatggatgagaaagtatgtgggtaagtttcattcattttgaatgtctctcatttaatcagcagattcagaatgtattagtgactccaa

SEQ ID NO: 132447 - DNA, 1054 bp, Homo sapiens
ttattgtgtctcagaaagcagagagagagagagatatagtgaaagaaagcaagagagagagagagagatcaggcacattggcatctcttctttgtagggatactaaacccgttttaacaggccttcaactttatgacctcatttaaccttaattacttccataaagaccctgtctccaaatgcagttacactggggattgggtcttcagcatatgcattttcagggacacagttcagtcaatagcagggtgatattagtggttttctgtgaaccacacatataccttgatatttcactctagcctgttagcactgtcagtggcaccaaataagagggtttggcataggatgtttcctaatatttgcctgttaatttgggggaaagtaattggaaattactcactgaagttctcatttacagcaaaagctcttcaaaaatgatatggcaaacatatgggcattcactctacaaatccatgtatgagatgtgtggaaatagagctatcaacaaagggactgaaggctcagaggaggacacaatgcagggttgattaggaaggacttcagcagagtgaaattaaacttgatatcccagggtaaatgggattttgcagggtgaagggcagagaggcattttggtggctggctggagcacagtcctgtatgaaggtgtagtgacttcctgtacctaagacaaagggatgtggagagcagtgggagcttcctcccatctaatgggtcggagtttagaataccagtgccttgccaatgcaaggtattggattttatcctagaggcagtggaaagcccttgaaggtcttatggaaaagggaaagtgttaaaattaggtctgggttttagactggcgagttttaagtgtaaacatgttgattagagagcttagagtctaacccacgctgtccctgatatctagaatgccttttcctctctaattctcaggaattagagaggaaaaccacacattcctgttcattgcacacatttgtgcaaccacacattcctgttcattcttcaaaacactcctctagagtga

SEQ ID NO: 132448 - DNA, 1010 bp, Homo sapiens
gcagagttgctaaagattaactctttagctactgtaaatatatcatgtccttcgttatgtgttggtatgcaatcagatgaaagcttggagggaggttctaattcctcattcagtgattgcacctggagttcctctcttgtaaaacaaacacccaaaggcaaggaaaaacaccgtaaagttctttgtatgtatgtttcaaaggaatgccagtggataggtttttcttgaggtttctagtttgctttttaaaacaaaatactataatctttaattatgtaaaatgttagatgttgcattctgatcatacttcaggaatagacatcacctaagaaaagtctctgaaaaactacaagcatttagtatttacttattatgacacatacccatggatttcattttcaaaaaaacttttattaactcagagtattctagaagaaaggaggtactatactcaaatgtcataagtccagagaaaccaattcttttgaataaacgtgacttctcaatggatttatttggttatcttttactagaaaaggtgataccttagtaacttttattccttctctcacatagttaaaataaaatataattgacagagatatacaggttgacttaaaatattctatatactgtaatcccggtgatgaatttggtatgtttaatgttgctttaaactggaatatttcctaaggcatactctcttttctctaggtaactatgacataagcaagggaacaccaaagttctttgatagtgcttcagcactccttcacaaaatcaaattgaggtagtagtgaggccactgtggggatgtagtagccaatgatgtatcatttatcttgggacacacctgaaagttttaatggcaaaagctgaagttttggaaatctgtcttccttttgagctaaggctttaattctgcctcctctttgatcttcccttccaaaaagctgcctttgagaaatggtacaatttctctctcatgtttaagaggtttgtgacattag

SEQ ID NO: 132449 - DNA, 1051 bp, Homo sapiens
tcagcagttaaaactttattactttactgacagaaaaaagaaaggatgaaaaactataaatataatgatatagaaaatctacagtatttttaaatgtcatattttaaagatttagtctctttaaagtgagtttttaaaatgaattcatataaataaatgcaaagtgccatagaagtaatgaggaatattaaaaatatttcaaggtttttaaggcattgggaaatatgttcaagactttgaaaacagagtccaccagccatatcagcccgtttgctattcctgatgtttgtattttcttctggaggaagaaagattaaaaagtggatcttgttttttaattctctgcattagggagtgaaatactttctctcaccgaaagataagggtaatcacagttttaaaaactggctactccttacatgcatgtacccttgcaaatcctgtagcaactgaaaaatctcctgatagatgtaaaaattaattaatgtcttactaccatgcaaagaatgtgggcataggtggataacggtgactaaatcccacagaatttgtgtggcttgcctactaaacctcgagtaatataatataagtgaaagccaaaaccagttttctgttgttttcctctccagcttgttctttataaaagttggacctgtttgttttgttctctaagtgtgccatgtgcagcacgcctgtgtaattcctggtccttggagcagactgcggtgtgcaggatgcccgtgcaggatttgggtggctggaactgacaaactgggattagctgacctcctgcaggaggctccagtggcccctcggccgtggtgagaaggagcagagccttggtgtgtatgtgacctctaacagtgaagtgatgcctagttcaccgataccacttgcagtaacctgaatgactggttattctggtcaggagaaaatagcactgacatcatgtgattctggcaaagtaaaccacattggaacttggcctttgaatacccaaggggctggcagcaatctcaggggttggctgggagccccattgagttcacta

SEQ ID NO: 132450 - DNA, 1044 bp, Homo sapiens
aagttatccagtgtagctggaatacaagacccatgatgtgctggaggccacgtgaaaaaaataaatagagattacttcatggagagccatgaatgttggcttgagagagttttacttactgtaacaattccgcaaagatacctagaggcagcacccaggttattacgtagtctcaaaagagtatttctgacaacttcattttaaacatttttttcttttttttattaaaaaattatttttggaaatggggtctcactgtattgcccagagtggtccctaactcctgagcttaagcaatcctcccgcctcagccacccaagtagttgggactaacaggtgtgagcccctgtgctaggctaaaacattttatttgtgcattatttcttcattgccaaaggatcgaaatctcacttgcttttttccttctgggagttttgtgggctgttttggtctgcttagagaaaaccacacacttccaggctattctgcctctgtacatttccagccttccttgaaacaatcatctcgagaactgtgaaattatcccgctataatctaattggtggtgaccactcagtccctttgcaccagagaacttgtatctagcaagtctctttctttcaaacatttgttagttcgttaaagatgttatgttagcagtaggatatgatgcatctgagaaggaaataaaagaccaggacaaaagacatgttgaatagtcaaagatgagctgtaaccatcagggaacactaactgtagcacctgattttgattgaaaaacatgataacattggctttgaagttgttgcagatctgcttaaactttcttcatggatggaatgaatgaaaattatgaagcattgatgtaaaaataattgtttttggtcttttttttctttgtagaaaccaacctgccttccctccctccctccctcccttccttccttcctccctcctttccttccttccatgcatccatcaccagtcttttcttactgtacaatttccttgacagatggacttcttgtagaagtttacctgagt

SEQ ID NO: 132451 - DNA, 1074 bp, Homo sapiens
gtctttgggtttgttctcatgactgatcttgcagagcgtctcatgttgtcccctgaatctctttctactcacttaacactgttgataataactgaatgtgcttaggctgcagcttgaaaagaaatttcatgagtagacgggtgtcaggcacaggaacatgttaagagggaagtcacggaacctaacttatcctaaagttagattagattattatctgcttgggttgctatcagtgtggctttgccttaggttgggggatagcccagatttcctttcaagttccttattggctttaacgttctctgattggaacttaaaaatgatattttccagactgtttgaaatccttttctcctctacattctagaaatagagtctgttgaaaataagaacagatccaggaaagaagtatgtacttaatattgtaggggacatatagcagatcggaccctttgaatggttaatgcaaagttttgtcttactgtaatctgggtaatcctcagatagataaaaattcatcattgagtgtttttactttcctaaagaaaccacagtaatatgtctttttctcacctaaatgctcttaaatgcacagagagtaggggttcctttggtttctatttttataatagtatcttcctttagtcagtttctttattcctagaacattatttattgggcacgtacttttgaattaaaaaacaaatgacctaaatatagaaataaccttccatggggaaaagaatggttgttgactgggcaggtgaagtaaggccaggagtggatattgaaccacctctcttagtaacagagaggaaggaaaaataaaattggacttttgaaatacgtatctagtcttagtagggatatctatttgctttttttttttggtcaattttaaatagtcgtttctatatttctgtaatattcactaggaaatttgtttccctgaggccagaagtctgggctagaggcaaaacctttgaagtttgtctcctttcttcctttgtacattaaaataaatcaaaacaaaactctaatccttttattatatttgacaaccatgggcaattg

SEQ ID NO: 132452 - DNA, 1044 bp, Homo sapiens
tggaatcttgctatgtcggccaggcgtgatcttggctcactgcaacctccacctcccaggttcaagtgagtctcatgtctcagcctcctgagtatcagctgggattacaggcacccgccatcatgccgggcacatttttgtatttttgtagagatggggtttcaccatgttggccaggctggtcttgaactcctgacctcaggtgatcttcccaccttggcctcccaaagtgctgggattacaggcgtgagccactgcgcccagccctgaatatttagaacctaaaacaggctacgtatttattcatttgaaaggttgtaaagttttaaatgagcacctgtcataccaccgatgttcctaatggctttggatacagtagcgtacaagacagacatggtctctgccctcagggggctcactgtctattcacagggaacaacaaatcaattcaacaaatttataagcaagtcatttccgattgtgttaaatgctatgagaaaactaatagggtcatagataatacatagattaaagtgaaaatggggtatgggggtctttgttggctaaggtcttttgggaaagtctttctgaggaaatgaaataggaaaagatgagaattaacccagtttcctagtactttcagtactcatttgtgacgtcagttatgaatatagctttggttaaaaggccctttgagccatttgcatttattgagataacctcagggacaggttaacctttcataattatcagaaagctatctataagaagcattttgctgtattcctctatagactacttttgtggaatcatgatttaaccttaggttggcttcaccgtgaattaaatatttaaaaatattttatatgtaaaagatccatatgcagatctttgcttttgtataaaactacctttttcctattatgtgttcagtgtcccttattcaactcccctgcaatatatttctctgaaaaatcccttccaggaaacaaattttctttttctgataagttggcatgcctcttttcatcttatgatgagaac

SEQ ID NO: 132453 - DNA, 1053 bp, Homo sapiens
aggatacaaggcctattgtagtttgacatgtagagttacacagataatacacagagaagctgagtttctttttgggattgatgagggggaaagagacggaaaatgtacttattaaaaagagtgccttgatttgctgtggagtttaaaactgggaacatgttttcccagacgagcaaaagctttgtagcattgctggctcgttaatgagtgatcttctttctccctggcgtgccctggctgggcatgttttcttgacttaggactgacactctcaatataatcttaattcatttttagtctaggctgactaaatcttctgatttggcaaagcagactgtcgggattgccattgttatgtttactctggatttatatcttaagttgaggctaagtaacacatttacataaatcaactcagcattagactctaacacaaaattgtttaccgagagaaaagactaattgtattgcttcctgagatttgctttcataatatattaaacctcaaaggatttaaaaatgtagcatgttctgttttaaaattaactcttctgggggttttgcttttataaaaagatagaatttttttttttttttttttttttttttgcgagaattgattatagctgttgctactgtggatgactttcctggaggtagaagataaagtggagcaggccgatgttatttagcaagagtcatatgctttcatagaaggatttatgttttatgaaactggcagcacaaatgctagaaaagaatttaaaaagttcttttaatactaaagatattgcaggaagatgaagaggctttaaatttatagctgcaaacattttcagtaggagtgtttttaaatgatagcattttatgattcatgcaaatatcatgttataatttatttcctttaaaataatggcaaggaaaaatgtcatggctctattgcatgggtcatcatcctattaagtcatgttctatttaaaataattttacctttattaaaatttacttgcattttaaaattacgacaaaaagccagattgaaaaattgggagt

SEQ ID NO: 132454 - DNA, 1969 bp, Homo sapiens
cagtatcttttccccaactgtttttccactgcattttaaatgttttaagtccaaagaaaatttgtgcttgattcaccacctcataccaaaaaatggagtatggcaaacctagaccttttttgcttgacaagacaaaacaaaaaacccctgcagtatctagtcatgtaattcttagtgaacatcttctcatatttcagtataaattggtaatttgtcaagctatccatatatgcttgagagactcttcatttttggttaagggtaagaaagttttttttttttccttcctagtttcagagtttttggtatactggtagagttttgaacatcaacaacttttagtcttttggcataataggattagatagattatggttactgaattcacacaaatgtaaaagaaaaatagagatagggaagtgagggaggagggacttagttcttactgccgtatttatctatttttagtgccatttgaaaattgccacaggaatgtagcatctcttttctcctgcagacttagttttacatcagtttcttagtatgccatataggatagcattatactcatgtccttttagataagtactcacaactaggaaattaagatgccaaggatataagcccctgggtgtgatagggttttcacttatatacacagatatcattcttcaaggatactgcttgtgaatgggatgactcaggagatgttaatgagagtcttcctagcctggcatgatatcctaaccatggcgccgtgcactttttcttccctgtttgcctcaactgcactgatatcgctttattcttcttcttactatgactttatgattgatggttacgaaaatcccagaactgatatgaattcaagtgtgttcaacgattagagtaagagaatgttggctgataaagaagaagttgactttagttgaacacaaagatattgaactctaagttactcatttaaatatgtgacacagaagtagaattcacagaggttaaccccttggagcactcagagaccatgatcctggccttgtccacgtaaaacaactcccttcagaagtaacaagagcaaggtccagccattgccaactgaagcccgttgaatacactgggacgtgggcaaattaagaacttactgatagttcgcccactggattttatcatagatcttatcagcttcatggtctatgactgttgatttgactttctcatgaagtaaattaacttcaaaacaaaacctcactatctcttatctgttgcctaaacaatgtttccaaaaattgaccaccttactatacagttcacttggatttcttaagaaatcagttaatttagctaactggcaaacagaactccaccacctcttctctggttctgaaacaatgtttccaaacgatggttgtcctttagcatgctgtcagagcacagtaggccccaatttttaaaagagataattcttttgtctttaattttgtcaattttagcccagttcgacttagttcttgtgcctcatgttggatagttgctctagagaaatgtgatcccaggaatgctggtgatttgctgttttaaaatggtgctgtgctttaggtttctgttcaaatctaagatttcagaagagtcagtaactgcaaataatctaaaaggggaagagtgaagaatgcttctaacttccctttgaaatgaatagctctgccagagcagcagctattagaaaaacaaaaacgacaaagaaaagctgctcagcccagcacacagaggtaaatttacttacatcagactgaaaaatgagggctgggctttgaaaagacatcccttctgactagaggaaagcttgtaattttggcacggctgccgccctcctaagcccctgagaaattctgaaaaacattacggaagactgttcttaatattaatggatgtcttcgtgtgtgtgtgtgtgtgtgtgtgtgtgtgtgtgtgt

SEQ ID NO: 132455 - DNA, 1069 bp, Homo sapiens
caatgaattgccttattcttttaaggtgtgttataaattgaatactgaccacaggagcactaatctgatagaaaatactgcctctaatctagttttaaaataagtaaagtgtgagtgtagggttagagaagattgaggtatttaaaaaatgattaggataggtcctccttggtaaggcaacatttaagtaaaggcttgaagggggtggtgaatgtagatactcttttaaacacttgaatgtgtgtgtgtgtgcgtattttcatctattccttacatcagccccatgaggcaagatctattagtatctcctttgtacatgtgagggaacgaaagaacagaaaaattatgcccagggtcacacaactagcaagtggtggaatcagcctttggacacaggcattttgttaaactattattttagatcagcccctaagctggcttagtgaggctgatccaggataggactaacctccttagcagactttgtactaaactagatatacaggactcagattaattcctcttcctgggaaataaaatcctggattctacctgtcatttccaaagtgtgtcattttgaagtaccatcttggatcaagttaatacgattggaatgggcacttcagctgctatcagagcaatcccgctggttgtgttgtcattgtgttttggtgctttaatcaaagcacgaaagatgtgagggaaggaaaattgttttagatgagaaatatgcaaaaggaatctaaacatcattcttaccttctgagttcacatcattattacaggaccattgtttacatttgggagctttatggtaagtgtaccttctattgaggtctgagatggcctcttcaaccagttcataataagataaggaaccagagatgaagagtgtgaaaggagtgtgcagaaggagcaaatacagactagcagcagtacatgttgtggcccataaatatccatcctggaaaatatcttaggtgctttgagttgtagatgagcaacatccttcaaattagatttatgttttattgtctgaagtaaattatatcgatctctgttgccttga

SEQ ID NO: 132456 - DNA, 2641 bp, Homo sapiens
gttagagaactctcatgagatctcagtgtagtcctacctacctacctagacaaagaaataattgtatggtttgtcttttcctgtctactgtaaatgtttcttctttctacttgcttagatgtgcatctgtttgtcctacagacactgttcctctgtccctcagtgagctacaagcaacagagctttcttgagtgttcctggatgccaacgcacaacatttaaacatactgactttatatatttgctccctaacgtgaatatggatatttttctcttctgatttcatttcctttaaaaagagcagtgatggctcaggccaaatcaacttgagttcatgcagccctgagcatgatcaggactgctcttgccctgaaagaggagtccattgtcctcaaggacattatgtcagagcccttaactgtgaactttcagtcaagatgctagacttgccagttagttacacagaaactattaggtccaggatggaatgtggcagttaaaacagaggaactttgatccccaagataaagtggatacagacactagtatgcttgcattttaccacagttttgatttgcatagtttttctcaatctaaattccttcaacctgtgtccagtgagtggtgcaatgatacaaatacacaagcgttttgctagaaaacctttaagaatggctgatgcgagtcattccccaagagcccctagtccggagtcacagtgatacccagttatgtcagttcgttttcttttaaaatgtgtgctaaatgttaatctctttaaaaatgtgcactaaaatgtttgctaaatgttaatctctggatttgatatttatgtggttatttatttaatcctttaaccttgccaaacttagccagagtagttctaagatgatagtaacagtaacaacagccgcaacatctaatatttattaagcacttactatgtgcctgggactgtgttaagggcatcacatagcatgttttatttaattctcacaactaacttatgtggaagctattataatcatggaaagtaaagttctcagacaaagagagagccagtcatgaccgaagttcatacaacagtggttaaaaggaggaacaagtatttgaacccaggtgttcaggtctgaagccctgcatgaggagctcacctggctgtgcggcctaattcagaaactcattagtctggtagctttgggaaagtcgccctccttcaggaacctgtttcctgatctgtaaaaaggacaactactcttgccttcctgatcagattgttaagaagaccaaataagaaaggcacattaaaaaagtacactttgaagaaatacgcaaatagatgagactgttttaatgaccttagcacactctaaagactatgtttatcaactgccatttctgtgagtaatcacattagaaagtcacatcacttgtaatttggacttttgcaaagtggtccaccatgtgtaatataacattattttaattttcacatctctactgttactgattgtacaaataattttgtatattagaagaaaagtcattaaacacaatacgattttttatctgagaacatcatgctttaataatatttatgggatatttattgccctcttgatattgcttgttaccactttagtaggggaggagaagactgacttttacaaaaagaaatgaatgcagcatttctgtctgtagcaaataaaatgaggtaaatagttgaatggttactgaaaaaatgttatcagtgtaagggaatggtttaaatatttaaaaattgccctccaaataatgtaacttaaatccaatttatatagtagcagaagtttttgtactgaatcaaatttctgcaattcttcttgccccctgagtagacagagctgtggaatagaatatttttagaatgaacacttaccacaaagtttttcctttaaagtttacattggttttttgaaatataataagattttttaaagtacagatatttgacctatgcagcatccattttttgttcctctgggcatttataaatatgggatttagtcattcttatgttcactgaattaatttccctaaaaaaaacacgtgtggggtgtgcacgtgtgtgtgtgtgcatgtgaacgtgtgagaacacaacctaaggattataatcatttagtcaaggtcataagtgacctgacatgccctggagcatgctgtttataattgctgtggttagttttccttctcattgtttttacctataatgtcaaaacacaactatatggagttggtatgttcactaatagcagtttatctctgcatggtttatagacagagtcaaaagccaacaactgtaattacatccatgtttctaacttagcagcaagctagaaaagtgtggttgaagtatgctgtggatatagtgcagccagtaggaattatagggtaaagtcatttctctacattcttttggttttacaataattgttacttaaattttgttttctggattttaccactgtctgttgtgtttatatgaccacataaagagtgcttgagttacgtgtctctccactctatttttctactccttgccttcctttataaatgtactagttctcctttcactttcttcagactcagcagacagtacatt

SEQ ID NO: 132457 - DNA, 1032 bp, Homo sapiens
cattcctttgtttactgatgtagagattcactctacgccatatagtgattgaagcagcttgctgaagtggaagagaaaaacattgctggtcctactgtttgcaggtgcttgggaaactttgtccctctcagtaactcagtttctgtatctgtcagggaagagaattggcctagaggacatccactatccctgttagctctagcatcctaggaatttggtttctggttatcttggcagagagcagtcctcttcatagtaagcaatacttaataaagtttagcacatgcttgttaaatttagggttttaatacattttatttattaaagagaaatagaaaatgtgtaacctgactcttgagtaacactttcatgttgctcatttcaaagtccaatagttaactcatttggttcaatgtagataaaagcttactttttaagaaagaggtctttaacttgtagaattttagagccgggaaaatccctacagatcttctcactttacagtttgggatactgagtctaagagaggcccagtgcttctttggatgcgttacttttactgctgtaggaggaaaaataaacgtaaattatcaaaaaataatgaaaggttattatttcgtgaaaacatggcagcaatttttaaaggaaaatagaagaaaaataatgattaaacatcttgtattatcatttgtaattaagataaattaattcaagagactaggttttttcttttatacattttcataggaagtattctaacgaaatcaatctgcagccatggtctttctctttttttgtgtgtggatggaagatacactaaattgcactcaactaataccaaaatttgatgctggttgaaaaacagaaaggacccattaaaaatatatggccaattttccaataacataagaaaagatgattgagatttgttataagaaaactttttttttttttaactgaaagtcagatttttaaagaaaaggtcagagctagttatgaggagctgttagaagttctgcttttgggtgtttg

SEQ ID NO: 132458 - DNA, 1011 bp, Homo sapiens
tatcgtgttaagaaaattaaataattaaatgagctccgtaggaaataagttaacatttattactgaaattgacttcacttttgctaagaacaactggaagccaagtggagaatggttacaacatttacttcttacgaaactgtgatttgggatcaccgtgtttgacttcagtagctctggttggttgtgtccatggaggtccttggaggaactagtttcggtgcttgtttccctacggccactgaactgcacccctcactttgcacaggaggtttggaaagtggagagattagctcatatccacaatccctactaggaaaatttaaatcacgtgtcacattgacgtagggtaaaaaggcatcatattcttatatggagcactttataataagtgtatcacgtacctaggggttctagccaggagttaataggaaaagttatttcactgtttgtccattagttaaagggtaactagggtgtacggaaagcaggatcagtacattgattagcttgtttggattctggcacataatttttaataatctgtggcattccttttctttttgataacacactggtgtttagtagcagttctgttcatgggatacacaaaactcgaaaatcatatacatgaaacaaagtgcagccacagtttttaaacatatgtaaactgggattgctgttgatggcagaaagatttgatatgatgtctttctaatgtatttgaaaagctttgcttacacttatgatttaaagttgatgttcacttaaagtgggagcgtatacatggttgttaaattctagttgcctttcatagcctctcagagatgcttgcatatttctttattcctgatggtaaagcatcaacattttaggatatgacttatagttatcatgtaacaatttctgttctatttacagtctccaaataagggaaaagctgcttatagtaatatgaggatcactggtcttacagtaattaaatagacttgttatactacattaatccct

SEQ ID NO: 132459 - DNA, 1019 bp, Homo sapiens
aagagtgcaaagagcacatgaaacactcattaaaatggtcaattattaaatacctgaaaattatgggcaaaggcgatccctggctctgaaactagcttctgggtaaatgtttctctttggtttatgaaagaatagcattttccagtttgaagttgatgaaagtagaacttgcggcacttaaggggttttcctatgtatgtgctatggcggagcaaatgattagccaacataatgttcaaagcaaattttccagcctttttccctccatccttgtgaaggaggaataattttagaaatctcaaggactagtggttatgcgatcggaaacttgagttattacggctgcatgccccagtgccaagcatagcaagaagagacgcttccttctgatcatgctcacttttctgtggcaacgtggtatgttgtctcattttaaagtaaattcttgggaccttgaactccagttttgtgatgcggttaatttaactgaatttagttgttagaatttggcatagagaataaatcatcaaactgcagagaacttgtgaaaactaagtgcgttgtagtaaggagtgagtctgtgggattagcttgtattagattgaacgttagagtgagactaataggacttgaatggttgggctttttggttgttatattattcagaaaattggaagaaatggctaacaagtgaggtggaaagtccttgaggctgaattgaaagccacacatttttaaaaaaccttcaaaatttaattgttctaaaatgggaaagcagatgattacatgcataactatattgtttatagtaaaacacttagatacacatattctgtttatgatgatagcttaaacaggacagcactgatgaatcactgacaaattaaagatctctgaacaaggactatataattaaaaatatggggtgatggatgaagtaattttactatcaaaagttgcctggaggttgtgtattttcagaatcctattttaaggcagttcagaacatgtagtaagtt

SEQ ID NO: 132460 - DNA, 1067 bp, Homo sapiens
catgtttaaaaagagagagagaaaactttaaagaggagacctatgcgttaaggtctgaggtaaaatcagtcattctggaatttctcgattctgcaccacactgttacgaaattctcagtgcacaattttgtacactgggaaaatcaaccaaaagcctaaaataattttggttaaagtttcctagatagttagcgttaatattgcttttcagttaaccaccgttatctcgttaattaataagaaggattagcagttctacccaaagggctgcacagaaggaagtctggcctatgggaggccttgagttgccagactgtgtcctgtctgaaggggaaaaaaggaagggggtggtggtggtggtgggagtcggggggcgggagtgggattggcctttctctgaggcaggaaagcgttttgaagagagaggtcacaacacaccaagacatttaaagatctcaagagatagcaactgttgtcgtgtatgtaacagattagagtttaaaatgagtcaccctaactgatttttggactgtactttgcactcttattaaacatgttttggagtgttaaagagagcccagaaacctcattgctatcctgaaaaagtagtttcctttagccttgttgaacccttaaaattatgatctcttgttgggtggccacttttgttgctttattgttaaatgttataataattgaagtacattttgaagttgtgaaaaatgtgacttatttacaggggaagtcataatcattattactgtttttgaaatagaagccttcctggttgtcacatatcattagtgaggaagcaaatgctaagaattattttcttcctacagttactgaatttcagaatccttttgggtaacaattatttctttatgaaaagcttaagtagataattgtttgcaagttggcagtgtattttaacattttaatagatttcacttcatctgcaggtatttcccattatgggaaaaaataagctttcataattgattaaaatgaggctgctctctaggatgatttggtgtgtctgcactgtgaaatgctctgggaacata

SEQ ID NO: 132461 - DNA, 1527 bp, Homo sapiens
atggcctgcagatagccaggtgacagactgttacctgaggtttgttatataaatgtgggacttaataaactgctatgagctttattattcaaaaaaatcaaaattacttttttgactctgaattctaggccctcactatgtgctttttgtcttgattttcttgtagctttggagataggcttaagtgtcattttagaatttttagtctgattttaaataatggtgttggacattgcacttttagaaatattaccttttcctgaaaaaatgaaacattgcatttaatatttccatgcatttaagaattacagtccaaataatgatggtttggggaaaataatatttttgtcccatgtgtcctaaaataaaactcagtaacacatgacacttatttgattgacagatgtctaggaggtgacactttaaggtgggctgtatatatgtgttggattgactataaatgtgttgtaactgtgttgtgaaagtcaaggatggaagtaaagtttcaaaaagtgggtcatgtaactttttagtgcagggagggaagatttgcaaccacttcactactgctcacattttaagttgcttgaaggctaggttttgaggtgtgcctgcctgcatgcacatttactcctggggaaggcagccagctctcttagttttgatgaactgacaataaagatttgtagagatagattgaaaaaagaaaaaaaacgcataaatgccttccatgttgcaccactggtcatgataactataaagttttaagcaactcttaagagaccatggttttagataaaacattgattttgttgttggttcaacaatctctattgtaagaacttttcattattttatcttgtgtatataacttgtatcctctgctacctgccagtgcatcatcttctcttaacatctgttggttcttcctttgaaaaactcacgtcaggatgcttttgtgttttccccttttcaaaatttatatattcttctttgtcaagtgtaggttaattatgtcattttatagtgcaattgattaaagaaggcagattttaaaagataattctccggtcagttagagggctgcatatcgcgagtgatgactttttatttgtcttctaagtacatgataactcacctaagtctgttttataaatcaggaaaagaagtataaaggaaaacacgaaagaaaaatcagaaaagagaaatgtaatgtttgcagcagaaagagcaacaaaattacgtttccccctttttctctctccccacttctaaatgactgggagaaaaacatgagaaagaacagagagaatgccaaagatggttgccactggcaccaggattggcatcagaccctctttgtttagctcaggatgcctgtgatttgttagttggcatccgcattgcagtgtggagtgatgttacaatatattgacaatttccagatctagaaatgtcaatagtcctcttggttatttatacaagatcacacactgcatctcttctggaagacgaaataaagaccaa

SEQ ID NO: 132462 - DNA, 1046 bp, Homo sapiens
ggctgaggcaggcggatcacgaggtcaggagatcaagaccatcctggctaatacggtgaaaccccgtctctactaaaaatacaaaaaattagctgggcgtgggtggtggcacaggcctgtagtctcagctactcgggaagctgaggcaggagaatcacttgaaccctggaggcagaggttgaagtgagccaagatcgcgccactgcactccagcctgggccacagagagagactccgtctcaaaaaacaaaacagaaaacaaagaaacaaacaaacgaaaaccagtaacagaatgcaagtgagggaggatgatcactttatggggataacatcaaatatgctctaattgataaaggaagtacctaactaaaaagttaaatactttataatattcttatctgacatacctcacagaaatgtgatcatgtgctaagaccctagtagagaatcatcatcctaaaaaatataaagattccctctgtacagagaccatattttccgatcactaaatcagaacacatggtgcaaccaagcatttttttttaaatgattttaagattttgaaaagttttgaaaaacgttttttaaatagtttttaaccgtgttttaataaatccattctatgaaaataacaaatgtataccatctaagaatgatgatccatgtctgttgtaaaattcttagaaatttgcctagaaaatgggatttgatgacaatcactgccatttcatcatcataagcatcctgtgtagtttgtacttgcagtgctttgtttttttagacagaacaccactctctaggttttgctcccaaatggaggtagacctgaggacacacatagagtgccacagagtcaacacggtgaataattgagaagctcgtacattatgtacatgttgagtctacagttactctcttggtgggtgaagaagaggtccatattcaatcaggctccaggctcattcatagatgtgatcttaatggcccatattctaatgaaagcaccctgttaattgggcagcttgggctctctacttcatatatag

SEQ ID NO: 132463 - DNA, 4929 bp, Homo sapiens
gtaatatgtatgttggactgaagtatttctttataaacattctatttgattttaagcaaaatgtatgttaaagcatgtttttacatcagtaaagtcatttgtcgaccttctggaaatgaaaggtttttacctagatactgtaagttacacctccttaacaatcatatttgtcattgttgttttctgcaaacaaaaatgtttatgggcttcatgtaggcttaagattgtaggcaaaaatggactgagttcaggacccttcaagcagtaggcattcagttacagagcagttggtactttgtaacccagacttacagtttaaaaatatcaagttagctgatgtttcattataataaaaatactattttgcttaagagttgtattacaaatatttgtgcttaacattagaaatagctgttttaaattgtagttaacatattaactttttcagaaaaaaagcatggtttatttttaataatgaaatagagaacataatacgtaatgttcagtataacagctgagttaaaacatctgccaggattaacatcagtgcgtttttgccaatgcatagaggcatttttctctaagtatgatggctaatgataactattctttgttacacattcaagtcactcccatacaagtaactagtgggtgatatgtttcactccaaagggtgtattaattctgaatgctaatcatgaagacttaagttaggacaacacttcaaaccaggaagtgtgaactgatttagattatagctacacaattttctgtgtgttagatcatggggtagtttgagtgttttcacatgtattgctataaaatcacaatgtaccaagctctggtttaatatgccattaatactaattaatagagctgctagtctctctctggacttttctctagtctctgcttctcttgcgcttcctgtatcaatagattacttagctcaagtttaccaagtttaataacctatagttactttattgaataagtttctgacatgacctctaatatacatagatatatctagaatttatttgataaaattcacacatacaaacattgagtagtttgctaatagatacaaatattagattttcacacaactctactactgctttaaaaatataagtattggtaagtgtagcaaataagccatgtacatttaatgtgttctacttgctagtattaactgtatgattaatgaatgtgttatttaatgcccaagtttgttaacttttattctagaaatcatcctctgaatttattataaatcacagatttcattgtgctctatatttagtcattctcagttgaattctagaatattccacagtacagtataagaaagtattagaaccaacttgcttgaactattttgaaccagtgttgtaattctatatgttaatcagtatttagcatttctgctccttttgagatgatgatggtttaacttcaggaaagtgacttttctgacttcttttattatcattgtgcaatttttagcaacaaaactcactatatctttgtcagttcttcagatgttacaatactgcctgctaatttgaaacagaaataacaatggtattttaaaaagtcattgatattactgatactttccattatcattatattttttactattattatgttctttttgccttgtccaccctagagaataggtacaaatgagtagtgagtatccacaaacttactaagatggagagaaggctagatggtgcatgaataatcagcatctcagcaacagagttgactggagccagtttctgacatcagagaatctctttgctgtaatcattttagccttatctcttatttataccatttttatgggaagagttgttagtgcatataagcatttagtttgaattatttaacttaaagaatttatattgcggtttctcttcagttggtcagatgccttttataaatattttagttttaaatataattgtgtagagtatgatcatgtgaagtgttaaaaataatgtggaaaactcagctatttaatgcagaggagaaatgaataggttgaccaaagtttgaaaaaactggcaccttttctggaaatctcttattgcaaagaaaagatactgagtgtatagaaaattttgtcaccagaggaaaaataaacaatatataagggtggctttcactttaacatttgggatattttggagttcttgatacctcgaaggtctccatttctattggtattttgaatatctgtaacatgtaatgtcgttcttataacagttcaacactgatttttttggtatcgatagctttatatataaacaaagatgcggacaaaatagcttaacagaagttgtgggcttttttgtggctttgcctgcctgtttgaccaaatacagggtttaattgtttgcaggctgttaactaaagggaaagcttacctgcgtattgcaagctatatattcttgccagtatacattggatgatattttaacctactggtgcctgaagttcgtgttttataacctcaacaactataaaacatcctggtgctattcactttagcattgagtgacatttttaattcctgtaccaaagagttaattttctttttggttgactgagttttcttctcacatcgttgtgtatttataaagtagaatttaatgttactaagaacagtttgattaacagatcttattttttgcatgctgctctggcaatttaatggattttaaatgtttctcatttggatttttttttaggtaggcatgtatggattttaattttgtattttaatatagcttggctactttaaaaggtagtttgataggctgaaattacaaaagataattgaagcacttttcacaagttgttttatttctgcaacaatgaataaaaaggtaagaactctaatttatataaatgaactatatagcttattgggcactttagtgaatactgaaacaaaatactaagatgaagagttaaggttcgttctcattacaaatcgagttcagcgtgtgtgtgtgtgtgtgtgtgtgtgtgtgtgtgtgtgtaatctttagtggctttaaagaataatattgccatttgtctactttgcaaataaagataacagaacacctttaaaatatatgtatgtgtacatatgtgtgtgtagatatatagagagagagatacggagagacagacagacagagagagagacagagagagagatgctttcccaagaggaaatgcatatgtaccttgatttaagcaaaactgataacagaaaattgaacttaatgaaagaaaaaagtctggatatggttactcactttacatagagtaagatttttaaaactaattttgcttagtagttaattttacaaaaatgaagagaaacaccctttaagtgtactcgtaatttaaaacacctttgaaatgtaattgtccaaatgtaatgctgctatgtatattatttgggttccagatttttccctttaaaattctcaaaacactcagtgtccttacaactgcagctaaaatggttaatcattctggcaagaaggtgacagtgtgtatattggaaaggcagacattcacatttgaaaatattttgcattattgttagctaaaatcaacctctccttgaatgtagatacaatatatggttttgcagtcaattctgaatggaaaaaaagaatcaagtctgaaatttatgtgaaatgtggcttcagatcatttgaacgatatgtagaaatctagatgaacatatcattagaggtgaaagcaaaatttgaaagcctaatgagatgaagcaacattatctctctctaatctgccaacaatattccctagattgtgttgccactgtattgattctgagtaatttggcttgtttatgcgtgatttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacgtggatcatgctgtatgagctcactttgtgtccctggaattagtgtttttttgtgtgtgatctaactggcaagtttaatgaatagccaaaatctatgttattcttgaggctcctaaaattatgtgtgaaccccaagttctgtctagtattatatccctaaaatgcttttaatagtggtatgttacaagtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagtttgagaagagtgagtaaaatgggtgaaatgacaagtgggaaccatgtagctgagatgtatttgtttagatgaaaagtctacactggttcttaatgtgaaaatcaaaccatgtatctaccttaagaacaatgttgttgtttttaatttattgtagcgatttagtttttttcacgtaatatttctattttctttgcagattgtttttaatttaaattgtggaatttttacttctcaaaatgtattaagtactgtattttttgaaatcttatttttaaataaatattttttaaaaacgtaggactgtttttatcctcttacctttcttacttaggaaaattaacccaaattctagatttcagcactaccaatgtaataggtcacttttaaaaatttt

SEQ ID NO: 132464 - DNA, 3259 bp, Homo sapiens
atttaaaattggaaagaactggacatacttgagaaatatgtgcatatggtagatagataatataatgatggctttttcttggtgcattgtctgaggcctgtgctaggcaagctaccccagtcttacagtaggggttttccagccatggtagttttcacactaaaatgctgatcattcttgtgccttgtctaactaaagtaagttaaattatttgtcctgaaagtacatcaaaagagatttgctactgtgttgttgacacacattctgttaatcctgagattttcctctgcttcaaaagttgcgctcggttgattgacgacacagatacaatatctgctatccagagttaaaactcagctgcatgccataatgaaagaaaagctgtatttatgatgctgggacacaattcatcagagtccagtaatggatccccagccaatctgtattgttttagctgactgaagtgcaccatgggagtgctgtctttcactaataatgctgtcttctgtagatcgaggccccgaaagccatggcagcagaccttctcagaagtttttggcactcgttggaagatcctgtggttcattcctttcaggcagaggcaaccactgcgagttccctaccactttgccaatcatgtctaaacagatggatggtgggcacagatgggtcctccatgctggcaatgcgttacaggttttatgataatagaactatgacagtcttcaagtcaattaaaatccacccaccagtcttaggcatcataatgtgccccaggctttattttaatagtgatcttgatcctgttgtgggactaatacaagatctatatttaagttttaaagcatgtttactttcaaattagctttccacagggatttcttgaaatgcttttgttattaaactcaaaaggcagtgattaggatgaaataattgtacataatttattttagtactgacagtgttacagattctaatttatggtaaatttcagatgtttatttaaaattttcacttttaaacagtaaccaaatctaaatttaattattcaggttttacaaaagttgatacaccttcttatagtataggtaaattttctttttcaaatccaatttaaaataacctttccttttaaatgtgctgcaacgtttttaaaaatgcagcagcataggagtgaacaacagcaacacaaaacgggcattggtttcttaggagtggcttgcttacgttttcttcttttttcttcaccaaaaccaacatgaaagtaccactgaagtaaaacaccaactacctaccttactataaaggaaatgttaaaatttttttcacaataattttttcaattttcactattactgttgtaattattgattgtgattaaaatatttgctcccaggagaactcctgaccagtgggcatgtattcctattttatcctaagattttaatgagcaaaaaggggagagaatttgcaataacttcacaattaccttttctagtgcagttatattagaatgcatatgtttttaaaatgctagtataactagatagtatataatgtacagtataaagaggaatattgtgcttttgaaaagagtatactttttacttttatttatgtactagtagatgtaaaatttcacattgaaggtttatatatattggccaactcatatagaaattttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacatttagtatgctttgaaaaaaactcagcttttagtttttttccattagaatactgcaaaacccatatatctttttaaaaaatttatgtactcacagtctttcccttgaagagaagattgaaaaagtctactgttcataaaccatgctaacattttccttttagctagttttgaaagtaaggaacaatacctgggaaataattaaacagaaggttaccattgtcagccagttggctatactgtggttagttctttcagaaattgtaaatatcttgtagcatattctgaaataatagagtaagttcttctcagagatgttaatatcatgtttttcatgttctaattagaatactttattacttacaaactcagaaatacgaacagaaatacagcagacgaacatatttattggtactgaaaagagacgtagtaaattaaatagaagaaatatatttataaagcttagtgaaacacaaaattagaatgttcatgtcaggcacaagggtttggattttgtgcaagctaatttggccacatttggcctggtgacagaactgttcataaggaagtaatatatagataaggtaggtagatatcagttgaatgccttatattgtatacattcctttcaaataaagaccttgagaaaacagcagagccaagtgaagatcacctaaagaactttgtggctaatttatacttcatgtagtagcagtgggtactgggcagggtctctttcccactctgatgatttgtgctcttatttttcctagatttacctcatctagggcatattcttttccctcttcctctttacctttcctggtcctgatccctctgtactcagttcccctaaattattggactacaaactaatatactagaaaagcatacacttattttatttgaatgcagaaatgctatctatcagtatatatacataagaatgtatattacagtatatctatatatacttaacactgtaactttcagtattccccagttagcgtacctaactctcctgtgggttttgttaattcttattagactactagagaaaaaccaactggcagtttgctaagcatatctactggtgttgtttctgcgccctcttttggctaattgatgtaattatactggctctaaagatttactgccccataagtaaatagtatagccacattctgaacatatcaaaagtacaaacttaggaggagtgtatgtacaaaaatgtaaaattttatgaaaatgaacatgtttttatgatgttatttctagttcataagaatgtgatgactgctttgcttcatttatgtacgttcccattatat

SEQ ID NO: 132465 - DNA, 1084 bp, Homo sapiens
taaaacctagaaagttaattaaaatttaaagtgtcccttctttttaaatatgcttttaatgtcatatagtaaaattgggtataatattttttagaattttgtatatgataagtttataaaaaactaggttcccccttgccaagggcatttgcttaaataccaagttatatttcatatttacatgaaatactcttttaaaaaaattatcaaaattattttgataattatggtgtgtggaattgggctactctttagcatatgcatgttcctatgtaaaagcatatttatattgcataatttctgtttgctcagtgtaataaactgcttgtaagtatttttgataaaactaattaaaaagaaatctttttctataatttatttatatgtccttaaatcactactgattgcttgagtgattaaatagatgcttaaaaagtgttcgtaaggaaactaaacatttatgggttttccttttactaacaatttttcctagatattcattttattatttcatgatctgaatccacacaaatatttaatctgacattaaaacataggactgcagaaagcagtaaatcttatatttatggtttgcttatggtattttggcacaataatttatgtacattttattgatatattattattccctgaatctcagccaaaggggcatgttaaatgcccatcttatttctactaataaccaaaaatcttatcaaagtataattttggtgttaaaagtgtaagagtagttaaatttgagttttgattataaacagtttttcagctgttccaaatattctgattagtgcgagacttatttctacaaaacattattgtatataatcatccttgctggcttcctctctatgttactatataattatttcctgtatacttgactacttttactagattgtaagttccatgatgctaaggactgtgtcataatagatacttggtaaatttttgatagatggataaatgaatgaatgaatcatggtttacatatttaggacttgttttttcaactggattataagctcttagagggcataggattttatatgtgtagtctcttgta

SEQ ID NO: 132466 - DNA, 1147 bp, Homo sapiens
ggttctgtcaactcccaaagtcatttttccacagaaatcctatcttttctaacagggagagatttgagccaaaaaagtaagaattaactgcagcctgatatacaaaaggattaaggtggttgtattaaatgaggcaatgtatataaaacatttactacaatatctgacaagtaggatgtacttaaatggtagctatttctaattgtaataaaccatatgcatccgaatgtttatatccccttttcatttgtttaattaataacatttcagacaccctgataacctcttccttaccccttaaagctttttaagcattatgtattggatatagctactaccattatgtacttgttggaagtatgtgagtgataattagctgattctgcagaactgctaacagttttggtcaatagggggctctcttgtaatatttaaagaaaatgttcagttgagaaatataatcttcgaaaacaaatgctgcgtgaattctgtattgtatctcattttaaagctgtcacaaaaatctgtgaacaagatattgtatttaattctgttttcttagcattggctctctgtataaatatttaaactggtatagtgtagaatttgacaaatgtatctgtatacatatatgtagtatttatgtttgtatacacatacatgcatatatgcaaatttacataatgagcctcttaatttataattgcttttatttaaaattgatgcaagtggagtttagctttttctaatgttagtctatttagagttttctttatttttgataacttattttgatagcacagttattcagcaaacttctggtggaaatttgtttttttgcatagactgtttaaaaagaagataatttcctgaaataggaaaaagtaagagcattttcgataaaagcattttgttactacataaaaattttaaaaatttctaaatctgtcaacaagatagagtagtgtatgacatatagttgatattcaaaactgtgccttgaatttaaacgtaaataattatttgggaattacttgggaataaagattaattcccaagtaattttcttaagctcagtgatctgtttgctctcacaatagtaatagatttttagaaagctacgtgaaacatgtattcagataattgc

SEQ ID NO: 132467 - DNA, 1021 bp, Homo sapiens
agggatgcttgctcttttagagagtgtcatctatgtatgtttacatccaggaaaaatggacatattttaaactatacttttcactatgtaattttttgttgctgtgagagatctcttccagtgatgaagaaaaatttgttctctagtagaggagaataaaaatagagttcaaaaattaatatttgataattttgccagtcgttttgctggctcatgtacttttctgcttctaatgttaataaatttaagctactctcatatatacttagtgaaattcatgttctgtttttagtcctgaatagaactgaaaaattaaagaaagaaaggtacataaaattaataatattgaacacgttgagagagcacttgtcatttcttttagcacttgataattggcaagactaaaaaattaacattgtcttgaatgtttctctttttaactgtgtagatagcttaccatttgtatttgagattcctttattaaaatgattcttagcaaattaaatagcatgctttatcctgtctgactttcttcattttaatgataccaatctgtcttttgatttttaaattaaaagataaataaatgaaacttttattagtttagtggcctgggcactatttctgttttagaattcatacacaagttagaacataccggatttaaactattaagtggtattacatttgagttctttttttgttttgttttttgttttttttctgctgccccaatatttgcaggaactagggatgagaaactgggggtattcctttaaaatcaagtattccttaatctctttttctttgtttcagtagctttatagctttgaagaacatgggcaaggcctctaagggatggtgccctgaggcttttcaattgattatgaattgttcttagaatgaagtagactgggatataggctgaaaatctgggaatcacccttgacactttcccctgtaacccctaatatctaatcaaccagaaaaacacactggttcgattctagcagttgctcct

SEQ ID NO: 132468 - DNA, 1083 bp, Homo sapiens
tggaataaatgaaatagagcgtcatttaaagaaaatgatgaggaccgtgtcacttttgcctacgaggtactttgtttaataagagaaatctaagcatttaaaaatgcagacatataatcagcttaacaggaagttctgagacaagaatcaatgaatcataacatgtacttcttatttgcctactgcctcatttctttaattcgtaatgaccgattcagaacctgtggaaaaatgcatgaataaaataatggttttataaaatgtgacccacatatagcttgaaaaagaccgtaactcaaatggtctctgcagttacaatccagggacctgttatagtgaatagtaacaagtgcaaactgctgccatccataagccattttcccgaaaacctctttgggttgagaggagaggagtgagaaggtcaataaaggagcagtttattgtttgtcctcctgctagtcttattatatagtggtttagtaaagaaactgcttgagaagttgagtaatgtctcaacatggagctgtttttctggaattgtaattgaatgtgactcagtgaaaacttttttagcataggaggtgacacagtggcagtatcaatactaccaggcaaaagagggaaggcagaggaaaggctgtttttattgccaagagtttgttccctaaattcagttttacttttatattaaggaatgtaaccttttatgttgttttagtaaaacattagggctcagattcaacttttcacatgcattaaatataataggcaatttagcatctagtagaataatcagtgcttaaataactcttattaaaggtaaaaatacaggtgaaattgtaaaacagtttttattgttgaaagtgatttgttaagaattcttgataagtcaagtcagactagtttaaaaagcacattttcatagacatgtgaatcatcactgtgctcattgataggtccctgaacaaaaataccttagtatgatggtactttatgtgtttgttttgctctttagacctaacctaggcaaaattgtgacatttttgaagtttgccttctgcctttcaagctgctttttcctct

SEQ ID NO: 132469 - DNA, 1046 bp, Homo sapiens
gttcctgcacgccccctgcacctgctctgtttggaacccgggggtttctcggtgcctccccgccccaggcctggcctttttcagagcgtcttctgctagagctacagccccttgctaagtgctcctccctcaactgggggtggggggttcctgctctagtcgagacgatgttggctagttatttatttatttattttaaatctgtatcctgagtttctcgcttgtaaactacagtttctctccccgcacccccgtctggagacctgcactgggatcccgggtttctctgtgctattccagagcttttcattcattccagacttctggtgtgaagctgcagagaggacaaacagtttgctcctttattgaccttctcactcctctcctcttgatccaaagaggttttcggaaaatggcttatggatggcagcagtttgcacttgttactgttcactgtaacaggtcgctggattgtaactgcagagtccatttaagttacggtctttttcaagctatatgtgggtcacattttaagatcccttgagagtcagggtggatgtctgtatcaccagggctgagaggacatgaccaattattactttaaaatattgcaatatagcagtctctaaaagtagaagagaaaaaaaaatcaaggtcattgtgggcgggtcataaattatattgtaaagttacagtccaaaggcgactaaggataattaagtgcaatttaaaaagatgtgttaaataggtcctcagcctactatgctaatatatgcacttttaaaaattcactgctttccttgtggtaagaataatattaataacagtcaccatttgatgactgcttagtatgcgccattcctggattaaaaggcttttggtgtaatattaaattcttccaactctttagattttacttattttaaaggtaaaattcggagagatgctctgtttttccttagtttgtgccatctcttaaaagcaaaaagatatttgaagaattgaggtgagaaatccactggaaagaaagagccaaatgagatttg

SEQ ID NO: 132470 - DNA, 2084 bp, Homo sapiens
tagcctaagttagaacacaatgaaattaacaaaataaaaccacaggcaaagatgcgttccacacattaggagtaaatttcacaattctactaacaaaatcacagactgtttggaaagctgaagctgaagccacacactggttgtgcctcacagaaatatgctgatcccttcaacgagggttactgaacctaagtgtaggccaagtgctgagtaggacctagtgcctgctctcaaaaactttacagtctagttggagaagataagaatacatagaaatattatacattgagatatgattgaggacagcaaattattattgaacatatacactcttatgtacgtttttatttacatgcattaactcatttatttatttattttttcactgttcaaggtttattgggggttttagttggtataacacttggatagttagctgcattgtttacatgtagatctttttacattatatggtaatgtacactgctgatacatatagttcacaaaataagatcctttggaacaattatgcacaagacatacgatattggatttacacactggatcccaggatgtgactgactgggaaaaaacgttggactaggcatgttcagtgaaggagccaggaagttatataacacacggtaaacatccacctggctcaaggggcaaatgcagcatgtacagcattggcagtggtgcatcagaggtggcagaactacttcacactaaccagtttaggactacacaagattaataccatccagcatcaggatatagctgtggattttacaaatcattcctatttctaacttgaggagttgatgtttttcccagtccatcttaaaatattactgctttaatcacagatcagataaaaaggacagcatgtacaacctccaactagaatcctgttgtagcctagacagtaaaatgatatgacatcagaagactttaaaattgcagctctttttggatcccccaaagtgtatctgcactcttcttcaaacaggcctcttcctcaggagtcagagtcactttcacaaggtctgagattccattctgtcccaaaatgcaaggaaccctaaggacgacatcatcctttattccatagagacccttaatcatggtgaaaactgggtgcacctgcctaagattcttcactgtacctctgccaaatctgctacagagagtccaatggcccaggatgtgtagcctttgagtttgatcacctcataagcactctcaaccaccagtttgtgaacctctttccactgttccttatgtttatcagtctctaaatctgggtgcggagtcttcagggagacaccagcaacattctttccactccatacaggtgcactggaatctccatgttccccaaggacccacccatgacagcttaatgggtgaactcccagcctttcccccatcaggtaacggaattgggctgaatccagattgcaaccacttccaataacatggtttttgggaaaaccacttatcttccaagccacgtaggtcaagatatccactggatttgaaacaataagcaacttgcagttcgggctgtattttacaacattaagaatgatgaacttaaagatgttcacgttacgctggaccaaattgagacggctttcttcctcttgctgacatgtcccagccatgataattaccagtttggagtttgcagttccattatagtctttgccagagacaatctttggtgttctaaggaaaaggctgccatgttggagatccatcatctctcccttcaatttgtcttcgatgacatcaacaagatcaagttcatctgccaagtccttcattaagatattgatggcacaggccatgccaacagcaccaaccccaacaactgtaatcttattctgggcggtctgttcttcctttagaagattatgaagcagctgatccttgagagttgccacattggacttggaaccaaaaggaatcaggaatgcacatcaggcagtcgtcggggcgtgtggcaatgagatctggaatcagcggcagtggctgcagcactcccattattaactcatttaaccctgacaacaacc

SEQ ID NO: 132471 - DNA, 1749 bp, Homo sapiens
cctcttgcctcaaagattgaattagacatatgttatggtgcctgaccagctttcctatccctcttccctgctaccatttctaaaatcttttcccaccccatgtgattctgatgtgtccacatccaaagcccccactccttcccctgttgttctgtcttttttttttttttttttttttttttttttgctaaaactgttatgaacgatgactctcttctttttggttcacaagtcataggtatgcaggcctacattgctgctattcttctttcccatgaaaaagcctgtgttacactaggagcaaataaggttaatatgcaaagtaatgtggagacagagcttgctgatagagagagaaagaactgatgctattatttaagtccctagatccactcaaggtagtagggttgttgtcagggttaaatgagttaataatgggagtgctgcagccactgccgctgattccagatctcattgccacacgccccgacgactgcctgatgtgcattcctgattccttttggttccaagtccaatgtggcaactctcaaggatcagctgcttcataatcttctaaaggaagaacagaccgcccagaataagattacagttgttggggttggtgctgttggcatggcctgtgccatcaatatcttaatgaaggacttggcagatgaacttgatcttgttgatgtcatcgaagacaaattgaagggagagatgatggatctccaacatggcagccttttccttagaacaccaaagattgtctctggcaaagactataatggaactgcaaactccaaactggtaattatcatggctgggacatgtcagcaagaggaagaaagccgtctcaatttggtccagcgtaacgtgaacatctttaagttcatcattcttaatgttgtaaaatacagcccgaactgcaagttgcttattgtttcaaatccagtggatatcttgacctacgtggcttggaagataagtggttttcccaaaaaccatgttattggaagtggttgcaatctggattcagcccaattccgttacctgatgggggaaaggctgggagttcacccattaagctgtcatgggtgggtccttggggaacatggagattccagtgcacctgtatggagtggaaagaatgttgctggtgtctccctgaagactccgcacccagatttagagactgataaacataaggaacagtggaaagaggttcacaaactggtggttgagagtgcttatgaggtgatcaaactcaaaggctacacatcctgggccattggactctctgtagcagatttggcagaggtacagtgaagaatcttaggcaggtgcacccagttttcaccatgattaagggtctctatggaataaaggatgatgtcgtccttagggttccttgcattttgggacagaatggaatctcagaccttgtgaaagtgactctgactcctgaggaagaggcctgtttgaagaagagtgcagatacactttgggggatccaaaaagagctgcaattttaaagtcttctgatgtcatatcattttactgtctaggctacaacaggattctagttggaggttgtacatgctgtcctttttatctgatctgtgattaaagcagtaatattttaagatggactgggaaaaacatcaactcctcaagttagaaataggaatgatttgtaaaatccacagctatatcctgatgctggatggtattaatcttgtgtagtcc

SEQ ID NO: 132472 - DNA, 1464 bp, Homo sapiens
tttctttttttccctgagacagagtttgctcttgttgcccaggctggagtttaatggcacgatcttggcttaccacaacctctgcctcctgggttcaagcaattctcctgcctcaggctcccaagtagctgggattacaggcatgtgccatcacacccggctaatttttgtatttttagtagagacagggtatctccatgttggtcaggctggtctcgaactcctgacctcaggtgatccgcccacttcagcctcccaaagtgctgggattacaggcgtgagccatcatgcctggccgagttcagcttttattcacattttttccccaaagtgatttattcttcaaagtagacagttatgttctatagagtgttttgttttttctttaagaaaataatttacataaacagagattatggtaaacattttaaatcttaggctgttggttaaatttaatggtttaagcactgttgggttctctttaattaatatttgcagaaggagaacatatgtgtttcactgatatgtatggtccagaaaaattacttaattctcaaaaatatgttgcattctcatattgtgttagggaaaattccataagtagtctatttttttttttcttttgctgactgttaacatccaaacacctgaatgaaaactgactcatttctgtattggtgtttaaaaatattgatttgcagatgttcacagaacacttgcattttttgattcacattgctaaatcaaatgtaaaggcaaatatgtatatttaataaatgagaagtatttttttattactgaaatttattctcaaagcaaatgtattttgtagatgtttcatttgggagattttgctttgccttaaaacatacaaaataaacctgtcttgtggtctgcccacctcaaaacctctgttaacttgacatgtagaaggagttcagaattctttgataatgtgtggttttcacttttgtttggattaaacaaaaataaaattagagtccatagcactttgtaaactaatgtgaagtttcttgttgaatcataaaagctacctgtatgtactttataatttaatgttctgttagtaaaaattgtcagcattttatctttttctcttctcattacattttagtctccaatctttcccactctcagcagtcacagttttgcagagcaaaacatttttagaaactgaatatgtgtgagttctatataaaatgaatgtgttagtaacatccatctgctgatcaaggaggcattggatctggtactagaaggtgaaattgattgtagctatcaaagcattttatcaatgtaagtcaagaaaaaagaagaaaactgtgaacctctgatatttttaacataaaaactgttcccaatgagtgttctcttgctgattttgtgttaatgttattgtctatgatttttaagctaatgctaatataaaatctaaaatttcaa

SEQ ID NO: 132473 - DNA, 1090 bp, Homo sapiens
ttgaggccagcctgggcaatacagtgagaacctgtctttacaaaaaaaaaaaaaaaaaaaaaaatgagccgtgcatggtggagtgcacttgtagtcctagctactagggagacttaggtgggataattgcttgatcccaggagtttgaggctacagtgagctaagatcatgccactgcactccaccccaggtgacagagtgagaccctgtctcaaaaaaaaaaaaaaaaaaaaaaaaaatatatatatatatatatatatatatatatatatatatatatatataaaataaaggtttgtggacacatgttacccatttagagaataatttatttttgaatgtgtatgatacctaagtgatatgcatatatataattaagacattttaaatctcttcagatatttcttcataagatacatgtatctatagatagctatatacaaaactacttacaaataataaatagacattgttttatacagttctttccaaagaaatgcaggatttcttatcctagtccttcctccccgagtccagttatttacatatttttgtctttaagtgttagattgcttgtttctgctgcctattgttggtagttttgtcttttacacatttgctgttagatttagttattttgaaatgttgaacttgaaatgtaatgaaaaggacacatcagaatttatcatcagggaagatatcttttatgttgagcagctgctatctgatcttgacagactgtcctcttagaggactgttgaagtccattctagtcattttgtaacttcataactgcagaaagaaatgatgcaaggactgtttagtggactgagatggctgagcaggttcttggcctgaattatccagaggagataggtggatctagcttcagaggaagtctacaccccattcccttctgcttacaatgtacccatgatatgtgtttagcacagtaatactgtaacaggacatcacatggaaaaatcaaagcagctggctcactgtatttaactgaaaagaatgcctacagattggatatttaatagggaaaattaaggcactttaataacaaacttcattatgtgaaact

SEQ ID NO: 132474 - DNA, 1193 bp, Homo sapiens
tggcgtaatctctgctcactgcaagctcctcctcccaggttcacgccattctcctgcctcagcctcccgagtagctgggactacaggcgcccgccaccacgcctggctaattttttgtattttgagtagagacggggtttcaccgtgttagccaggatggtctcgatctcctgaactcgtgatccactcctttttaaagtgagtctagtctgttgatcttcataaataggagggttttcctccagcttggacattaaaaataatttttaaaaagatctttgtggctaactggaaaatcttctggaattatctaatgcttcattcatttccctccatttctgttttttttttttgtatttatactctgcatatttagaaatcttaaattcaaatacatttagttaaaatgagttgacgaagactccagtgatgttttaataccctaagattttgtgattccttgggcctggaatggatcttagaaaattaccttgccctcatgagcctgtaaaccgtgttgtttcccctcagtcttgctctgtccagtacagtagcccctcgccacacatggctgcggagcacccggaatggcttacagcacatgtgggaatggtgctgaatgctgaggaagcattcactcatacgtgctgcacttcttaaaggcctcccaatagcctgctttgcggagttctggcttttacttgctgtctactatgatcacctgatttgtgcttcacatacatatctgtgaagtttgctttttctatttaaagtgcccttaaactttcatttgatcgtgtttatctgcagatggtcagtgtcattggcatatttgaacattattctgccctccctccgccaaactccttatgtactagattaagaaattttatttttgagatgatgattttaatttgattttacagacattcttttttacaaagtacagttgttagagttatagaagagtgattcacatctttgagaagatagatttcatgattaatatatatattttttgagacagagtttcgctcttgttgcccaggctggagtgcaattgcacgatctaggctcactgcaacctctgcctcccaggttcaagcaattctcctgcctcagcctcccaagtagctgggattacaggcatgtgccaccatgcccagctaattttgtatttttagtagagatgg

SEQ ID NO: 132475 - DNA, 4225 bp, Homo sapiens
ctaaaaagcaatgaaaagcctccactaactcaagacaatactgacaattcaaacataaagatacttcccagtaattccaagactattatctgcactttccctttatgcattaggagctttgcaaagttgcccacattggtggcatttaggaaaatactcaattccatctgtcggtaaactccagtaacatattgattttagtttatgaataatacattttactaacccacatcaagattaccagtgagtagcccttatacctgttcaaaatgaagggctatagaaataagtgccactgtaaagaaagcagttatagctcacccatgggccaaggcagtatgtaaaagtattccatttttctgattcttaacaattctggtaaagggaggtcaacataaatgctcttaggcaggttttaaataatctttggatttctatggccccctttaaagacattggcctaattcttatgtaattattggccaaaccattgatatttacatgtgagaattggaataagtaattttgacgtcattaagtaattctgctgcctttgttgcagttgtttcatttgagtttcttgagtgatcgatcatgtgatcatgctaaccatgtttatatgcacctaccttaaaattttccaatttaaaaaaggaagtctaattatttaggactagttcacaaaatttgtacagcccttctcacaacttcttgctatgcttgtgaatgatttggtaattaagcagaaccttgctactcaaagtatgacctttagatgaccaccaggaagcttctagaaatgcagattattgcagttccccccaaaaccccccaacagaaccagaatctgcattttactaagatctacggttatgtatattagagtttgaaagtaagtaagtagatcagagagaggaatgggagagtggtggtacctggtatataaggaaattttgactgtacaattttattgttattgtcttcaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaaccattcccacttggagtgttttatttttcaatcatcatcattgcccccaactccccacatgtatgtgttgtggcatccagagtgagaaaagacaatttatgagttgatgaatctgggccttatttctatttccattttgaagaataacttgtcatagaagcctctgcagtttaacagaaggagccacatattgggagtcacgagttcatctctgtgggttaatagttccatgacacggagtacgtagctcagcttttcaggggttcagttgccccactatggatagcggtgtggtatttggtacttgtgagggctcaattagataaaacatatgatagctttttgtaaactgtaaaaggctatacaaaagtatgaattattataataattatggttttttatgtctggattacagtatcaacacaaaagtattggctgatactgtggtttgtgttgtaaaatgaaagaagtgtagaaattcaaataccttactgtgtattcatgtgtttgatgttgacagtaggctacccaggttatatgaacctgctcctgccgttccctgccacatggacctgtatcaagcagtgtgtggcttgttttcttcaaggtactgattcttgaccaacactgaggatgtatatccaatgaaagatagatatcaatggcggtagatatcaatgtgttattagtaatacaactttaggtacagacaaaatagaaaataaaattaactgtcattataattagtagtggaaaatacattaaaaattatttgtgtatagctttggaaaaaagttttccaaaaaaagctttttggaaaaaagctcttagaagagctttggtaacattatttttgaaagcgcacactcacattgtgactgtgggtatactgagcatatattcttacattgttactgtgagaagctgcaagtcagtgctgcaagtcagtaacaaattctcttttggggataaaatgaaacagttttaagcttagagtggccatttttattttaactctgcattactaaacaaatataaaagaaattcatctccatttaaaaatcttttttgttatttatattttgttttatttttgtttcctattctttatgcagttacctgatactatggacagtatatccagtggatcttttagtactgtaatatcaaaatgctacaaatatttatgtttcctgctatgttcaagatattgtagtggcaccaacttcttgggcatcagctaatattgcattttggagtcattagggtgttctgtgaagaatgaatactgaagtgacagttttatctagttttttgaggggcatttatgatggggttgggttgccattgtgtctgacagtgcaattcatgtagttcctggcataattgccttttttttttccttaatggagaggcagggttctgattggtgctgtataaatttaagtaactttgtgctttgtaggaatggtgacaaggaaggcatgatttccccctgacaaggaatgaaaggtgaactgtatcagctcttatctggacatatatgttaatgttttctatgctccctgatacaagaagtttccaagttatataggaaaattaagtccattgatcctgtctttatcctcagagggcagaaatgagacaagtggataaaggctgtaggaagctgaattccagattaatcagtgccgaggaagatttttcattatcggaaaacccaacagtctaaaatcaataaccagttcttctgcaaaggggtgagtttaagcagggctaatgtgactgtcatttctgcctgtcctgcaagcttagactagttgaactttgaggtcactctatgattcttttattagggcttcaaatcagcagggagtgtgtaaagaaaaaatgctccccccctaccatttcaaataaaagtgaatgttttctctttcaaagctactattagaggtagttgtgatagacactaacaa

SEQ ID NO: 132476 - DNA, 1029 bp, Homo sapiens
actttttcaattctagctgtttttggcacttgagggttttttcttatgttctggtgagctaagctatgcatttgaaatggtgttagttgtattttttttcattgcttttacatgttttataaccagagagttctcctaatagtgctgaaaacagaagtgttgaccatttctttattggccttttaaagtattataagactttaaaatacaaagggagttgaaccttagtttaaaaataatacaactttcttatttctaaatggagtcattttctgaacacatttgtgttcagaaagatgatcttgccatttctagggttaatctttaaagatccgtatgcgctgatttacttaagagacagcgatcaaccatcagtgctgggtttacattaaggaataaaagattaatataggaaaagaacattatttattgccatagtttaatgagttccataactatacaatggccgcctttctatgataatagacttagtgctgcacatgttttctgaagaatgggaataatatatatttagaaaaatgtgtatttcttgttctgttaagatttacttgattttcctctgctctttcagtgaaaagctactgaagtatgaccactacctagtgccgttcactctatttgaattggcatctttgtataaaagccagggggaaattgacaaggccataaagttcctagaaactgcaaggtaagtgttgaaggcagcttttccttgattgttatggagtcagaaatgtcagtactgctctaacaacagcagtaacattatatacttaacaattaacaatgtcaaattagtaataatgctacttttgctaacttctggttgatttatgctcatggcttttgctgtaattgtgctgtttccaaccctcttactgcctcaccctgtgactgtttacagatatgattatgggcatctatttgaaagatttctaacttattttattctatatcaggggttggccagctttttgtgtaaatggctagatagtaaatatttttagc

SEQ ID NO: 132477 - DNA, 1007 bp, Homo sapiens
tgtatataattgagttttgttctggttttattccccctcagtagcattgatgatgatgtcctgctccattactaaccatagagttgaatcagggtactgatgcctggcccttttctctgtatcacaaatgcagtatttacaggggccagatatgtaaccttacttaataaggccggctgagtggtggcaggaataggattggtaggctctataggtcagggtgttttctctgaagagtgtagccacactcctcagctctatttgattattgctttgcacagtgtgggcccaatagcaataatccctaccatttttcacgagaagcctggaatctggatattatgtaaaatcacctgattttaaaatattggctcaaattttttgaaaatattctgcaagccaaaacaatcacagctatagactgctggtggacatcctgtgctctgtgtcatgtgcctttccatccgtggccacctgatccccttcttcctgacagtattgatgggaatataggaggacttgtgcccctgtaagaataaagagaaaatatctacttcccaaatgtactgtctttagtaatattctgtaattagtaaacatgttaaagaaatatctattgaattctattttattagtgtttctataaggattaaaaggatgatcaaaaggatgacctattgtgctgtttttttgtatgtgaatctcatagtgaattgtttgctcatgtgctttataattgtggattgtgaactcaccttcattggagttttttcttgagattcccatgaggctatactgaagaagagttgctctacagtgattttgcattttatttctgtcaggtaccctaaaggttttttctgcccagggcctctttcatgttaatttcattgcttacttcttggatcatttagacaatgtaaatttgaattgcacattcaatgtgggcaggcctattggttattgatttcctaaggaattcttttttcttctcattgaaagtgctg

SEQ ID NO: 132478 - DNA, 1008 bp, Homo sapiens
tgcccagttcttttcatttaaaataatttcattgtattttatttagtgaggcataacaaatgctaaaaagttttccttatttgtaaatgatccctctgaaactttgttctttctcttaattaagatcttaaggccgggcacggtggctcacgcctgtaatcccagcactctgggaggccgaggtgggtggatcatgaggtcaggagatcgagaccatcctggctaacacggtgaaaccccatctctactaaaaatacaaaaaattagccgggcgtggtggtgggcacctgtagtcccagctactcgggaggctgaggcaggagaatggcgtgaacccgggagacggagcttgcagtgagccgagattgcgccactgcactccagcctgggtgagagagcgagagtccgtctcaaaaaaaaaaaaaaaaaagatcttaaaaagtatttttctttgtgtgttttctttgtatgttttttgttttaagattttaacagcttctctgtggatgatgagtgcttagtgaagttacttaaaggatgttgcctcaagaacttacagcggcccttgcaagctgaactatgttacaatcatgttgtggaaaggtaagaccaaacaataaaaccagcccaagtgcaaattgtggtttctggggaattgctgtgagaaagtgatgcaaaatgcttttatctcttactgctaaactcttacttggtgttaccagaaagaaaatccagtagtgtgttgttgttgttcttcctcgtgaacaaaattatggtctgggtggaacatgactttatgtatttctacttgatgtttaaagatgacttacaaaaactgtatttatagctcaactaacaggtgtctagccaaactctggcagcatcatactgaatctctgctactcattaatttttttgttttttacatatttctttagtttttcttttcttttctttttttttaagagatgggagactttccttgttgtccagactggagtgcaagta

SEQ ID NO: 132479 - DNA, 1904 bp, Homo sapiens
attagagccttagctccatgcctgattcatttttattaagtgatttgcactgggaaggtttttctgtctcacagaactctacagaaaattttctagactatcatctttctttgccttaatacttagataccagtgtatacgtaagtgtatcctgctttgactgttaagaaccatagggaaggttaactccctgcacttctttctccaggtctatggaagtagaatgtacaggaaattggcttgaaatgttagtactgggatttttttttttttttttgtacctaggaattttaccaaaagcctgtttttcataaagtctcagatatgagcttgccctcttctgataaaaagattttatcaataaaaggaatttttaaaagatcatcatcaatttaaaaaagattctgttattgaattgaactcttgctctattagcagcaataaattgttacatgtaaaattgaaggtagagtgtcatgatcttagttttcggtgccataagataaagatacctttgctgccattctacttgagtgtgtcgtcctcatttccactacctcctgctaagaggcttttcaagctatatttttatcatatcttaaaatttatttccaagaagatactaattaccctgcttacttcatacccttcaaaatacgaactgcactatcaggaacattagaaaaatattttcaagcaaaagcacatttgcttttgatccaaaaaaattctcatctggtagcccattaaatataatctgtaatgagaaatcattagtttacattttaggagctgtcattcagccatatggcttttaaatgaatacgttttctgcatattggattacattactggaccgtcacatgtttctaattgtatgaaagatcctaagcccagtgaaatattccagtgtttatatccagtgatattcttggaaacattttatgtaaacaactggcagacatttaaaaatatttttctttacttaaaagtaacaacaaaagtttacattaaacagaattattattcatagtatcggtttaaaatatttatttctgtatctgtattctattaccttccaaaagaattaaatgcttgtagatatttaataaatatttgttatatgaatgagtttaaatttttggtaaaaatatatatactgaattgcttcacagtataaaaggcaaaagcaaaggaaaatgatctgtaaatattgtcctgaggttcctagaaaccgaagcaaaacacatgaacattgtttggggatcataaaggacattgaataacctcatataactgcaaatggttttcatttttcctcattaggaaatgatgtatgtctggaatggtttttcaatagtgagcaaaagaaaagacctttctgaaaatctgttagtaactgttgaaaaagctgaggcagctttacaaagtcaaagtaagtatacacagtaagcaccgaggagcctttgtctctgctccatgactgctctcctgtcttttccctgtgcacatctgccaacattaatttgtgtacatcccaaggacaaagagcttgagctgcaggggtctgggtgattgcagtcaaatgcagggaggaatgatacacactgcaactgcatgaaccttggaaacagcttactaagggaaaaaggccaggccagccataaaagaccacatattatatgattccctttacacgatactcagaatagggaaatctataaagacagacagcagatgagtggttgcctagggatggagtatggaagttaggagttatgatagctttctggggagggaggtgatgacagtgttctacagttgactgtggtgatggctgtacaactctgtgaatatcctaaaaaccattgaatggttactctcagtgggtgaattgtatggca

SEQ ID NO: 132480 - DNA, 1049 bp, Homo sapiens
gagacactgtagtttaaaatccatagctccatattttgcccggaattaacctaacataagcttgactcatattggaggcatattatttcatgttattttttctttcagtgatgtaattgagtattgccttgaattctttctcagcaacttgtttgatgcatccataaaattatgcataagaaagtgctcccaggaacatgtagtctccccatcctactgtcatttttacctgcttatgaatttcataattggaattctgtagaattttaaaaggaagtttctaaacatggtacacatcctaagctgattatttcccaaacaacctgtgcttgggaaacattttcttaaattatacgttaattgttggctgtcttttgagccatattattttatagatctgtgtaatacttgcaaataggaataggccatataccagtgtaccctcttctctctccctgagtatccacaacgtaagtaaatactttggactctttcctgcttactcgtagaaatcgccagttgtatacctagatttcctggactgtgtttgatagatttaagacattagctaagttgactggaaagaaatatgtgtcagtcagtggttctcaatcttgagtgtgcctcagaatcacctggagggcttatcaaaatctagattgctcggccccggccctggagttgctgattcagtaggtctagagtagggcctgaaaattggcatttcaaataggttcccaggtgatgctgctgctgctgctggtggtctgtgaagttcactgtgaaaaccacaggtacaaataatgtatgtgttgccatgacctttctctggggctgggctggggttcttcacagacaggtggacagcttgaagcagagaattgccgggaaatctatccctactgagaagtttgctgtgaggaaggctcggcgttactccgcctccttacctgcacctgtgaagctcatcttacctgccctggtatctgcttttattttcttttcatgtactagaaataaattacctactcacagcagcagggagcata

SEQ ID NO: 132481 - DNA, 1781 bp, Homo sapiens
atatgattttccagtcttgttctctttctaaaaatgcatttaattcccataggagttgggcctcctgcagttacgtgaaggtgcttcaggaaggagcatgaggtctgcactgtgctgcttaaccatcttagcttttcatacttacatctccctaatacttggtaagatctggattagattgtttcattgaacattgattgtcttggccagacatggtgtgttacacctgtaatcccaactacttgggaggctgaggtgggaggatcagttgaacccaggagtttgaggctgcggtgagctatgatcacgtcactgcactggatccagcctgggccacagagcgagatcctgtctctaaattaaaaaaaacaaaacaagacaaaacataaagttgattatttttaatctgagtaagtaaaaatttagaaagatcagcaagagctagtagttcatatctgtttacttttttttttgaataaaggtagaaaatagtgtcctttgtcatagtgacatttagcagaaggagtagggtagtttctttcattaaataattttcatctgttctcagctaaaatttctatattaaggtgatctattttatcatatatgagatttttttctttgcagaaaatgaaattttgggctaaataagttaatattgctgttaaaaccagaaattccaattaggaatctgagacagccacctgcattcttaagaattagtgtgtcctagagctttcttaaactaaagttataggtgagactggtctttattttattccccagatataaaaatgatgaaataatagttttcatcttttccatgagtaggtctttactgtatgttaatgaaatttggagagctggttataaatatccccatgtcttatgaagactgagtcttttcctgttaaatttctaggtacaggagaagtgaatgttgcggaagcagagcgtctcctggcacccttcctccagcagtttccaaatgtacgctcagtatttcaaagtgtatgtttcaaccataattaatcagccagtgttgactgttgaacagtgtgttttcttccttgctctgcagggctcactcgtgttgttttatcatgcccgaatagagttgctgaaagggaatcttgaagaggtaatttattaggtgggaattatttgggggagttgtctgtatggcgactcctacatgagtcgctgtgacctacttattcaacaaaagtaaacttggctatatggactagacaaaaataaagaaaaaaatatataagtaaaaagccaaaacttttaacttgtatatacattctattatataaaatctatgcagtggattactgaatatagtctacatttatacatagagtacattaagcactttagggtaatatataccaaataacaagctcagggattttcaagaaactgtgactgttaccaatttctgcattacacactgactttggaatctagcccctgtgtgacatgcaggtctactacgtgtgggctccgtatcaaaggacccctcaaaaaacgaattccctcaaaaacgaagcgtcgaggtcagaagtagaaaagtaaggagccatttatgtatatacattcacaaaccattttttccacacaaatgggatcaaaatgtatttttctgtgatttttttttcactgtttacaatatgtcttggatctctttccagatcagtatgcctaaatgtctcctattctttttgatggctgggtttcatttcatgggatggatatactatacctattaaagt

SEQ ID NO: 132482 - DNA, 1007 bp, Homo sapiens
tggtctcgaactcctgacctcgtgatccacccgtcttggcctcccaaagcgctgggattacaggcatgagccactgcgcctggccctttgtgctatttttatgatgtatagcagatttacatatattttaaaccctacaatgcggtgtcagactttctctttaatcagttatatgttgtagtcttctctctttacccatattcttaccatttttcatattcttattcaaaatggtaaatatatttcctgtttactttcagactaaagaacttcctttagcatttcttagagggtgtcagctttcaacaaattctgttttcatttatcttaaaatatatttactttttactttttcttttcaagcttatttttgctaactatagtattctgagtcgatgggttttttttccttctttcagccctttaaaactggcgtcctattgtattaaagcctgtgttgttcagtttttcatttgtattattgttcccctatatataatgtgtcttttcttctggcttttttgaagattgactagtttgtatctttgggtctcagtagtttgactatgatgtgcctaagtgtggttttgagaaatttgtggtcataatttttcaaactttttttttctgccccattcttactttcttctctcctgagactcctacttttttcccttcattttccactgtgtaaaaatatgttttaaatgtatattttgatttttccacaatttgtaatagttacttgtgggaaagttaatctgacataagctaccctaccattactggtagcagaaccaaaatttagtattttaagaggtactttcactgaaaatcctttcacaaaactgtgtttcattcaaaatcctggaagggggtggtagatcttgggtacctgacatgctgttgtatagatttctttgtgaaatatttttagaaggtataaacgaatgttaaattcaatgctaattgctgttttagtcatcaaaacctaaaaatactaaagg

SEQ ID NO: 132483 - DNA, 1061 bp, Homo sapiens
cctagaaatgtgtgtgagtaaaattcgcaacattaaaaagactctgactgctaaagtactctgtgaaagaaggaccattgtcccatttactgggtgtaatgtactggaaggtttggccttagagcagattgttaaagtcatccattttacattctgttaaacccagaagaaaattgctcagtagatgtcaatgtttattaaaataatttggaccgcatatggcccctaattggtgaggattacctccttagtaatataaaataatcgaaggattttacaagtattttctttttgttgtcctctaatgtggaagaaaaattaccccaaaaacttttaaatgtaaagcaagagtatgtgttaatttcaaaattatgtcctcaaaatacttttttttgtttgtttgtttttgtttttctaatcacacaaacacacaactgtggggacaatttaaaattttttgctaaataatctaattttttaactgaattattttcaggatgaaaatatgatcaacttcatcaaaggtggactcaaaattagaacaagttaccaaatatataagtaagttaaaaagtaagatgtggtttgtaaataattttgtgctgtgtactcctttgttcttcacagttctcctaaattaagtttgactaggattttttttttttttttttttttttttttttttttgagacggagtctcactctgtcacccaggttggagtgcagtggcgcaatctcggctcactgcaagctccgcctctcaggttcacgccattctcctgcctcatcctcccgagtagctgggactacaggcgcccgccaccacgcccggctaattttttgtatttttagtagagatggggtttcactgtgttagtcaggatggtctcgatctcctgacctcgtgatccgcccgcctcagcctcccaaagtgctgggattacacgcgtgagccaccgcgcctggcctgactaggattttttatttggtgttggtaaaaatgaacttaattttttgttgagtgtgtattcagtgttataggacaacagaatttaagttta

SEQ ID NO: 132484 - DNA, 2495 bp, Homo sapiens
aactttaatcaggaacttcagataatgggattagactagatacaaggtctgacaactactttggtcatggctcttgtgaccagcctaacttattccaaaatcttgtttgctcttggcctttggctggcgaggagagggattattttatataagcctttatttttgaaaaaatatatcagaatctctctgtcaaaaaatacatttccagcggcctttattttagcacttatttcagagccaaaggccgtgtgctgcccctttttcaacagaaaacagtttgcttgcaatctgcctgcaggctgccctcttgtgttgaaatagggaaatgcatattgtccccttcaacctggaacattttgttctgcctgtgtgggtttacattggaaagtccttggtacttgagtttttaagaggttacttttcaccacccatataatttcagtgattatggtgaaggaataaaggttactgtgcaagtcaggacatgcatttactaggatttcttatgatcagtatttccattgaattaaaatgtctgaattccctgtgttcttcccagggctaaggagagtatgtaccatgccttgggctacagtaccattgtggtgttgcaggctgtcctgaccttcgagcaacaggacatccagaacggcatttctgccatgaaggacgctttacaaacctgccaaaagtatgacgagtcattaaatacttaagatgtgactgcaaacttttatgcctgtgtgacaaaaataatgtcatttgcctgaccaaaagctctgtgtttgaaattggccacagttacagaaaagaaattcagcctcgaagctgaaggattcccatttggcatctacatattccacttttctttttgatagcctggggtctgagctacagagatctgggggggatttcggggggatttcagtgggattagcagcaagcatctctcaatgtagatgacattaggtactgcatgccaaaccaagccacacaaggaacattcttgttttaagtgggagatgcaaattcatgagggaatgttttatttgtttaagaaggacctgtttttgaacacttttgtttggtgaaaatgagatagatttttagttttattttaagctttactttgtgtgtataggaagaccctatcaaaatttttttcaaggggtaagttattttgatatcttttaaaaaatgataggtgtttcacagtatggaagatgcttggtttgtggacatttaggaatattcaagaatccaggaatggctggctgcagcaccctgatcagatggatgggaggaaatgacccctgttgctgtcaattgcttgatgtgccccccataggactagggcagaaggttcatgatcagaaggttaacatgggtgaaattacatcctgatgtaattgtgttgtaagctcctcaaatgaagagagcttccaaatattgcactttaacttcatttttaacctgtggagaattttaccacaaatactgattttagttatagggataagggaaggtactttggaggttagttttcattggtgtgtgtgggtttccccacgtggtgttcagtagcacagactgagttcccacaaatggctagccagtgctgcatgtagagtgttggaaaaggatgatctgtgtcctatagacttcagggtttagagtttcagctttttgactctttggtgtgatagtgactgaaatgaacgtcaaatgaaaatgagctcagcctgattttttttttctattttctatctccctttttatttattcaatgtagatacaggaaaaaatacacagttgtagaatctttctcaagtcttctttctagaggatccctggagcaactgagtgaaggtaaaagtcatttaaaagatcacttttttccttgattttaatagttaaatgatcatctcataaaattccatcctgaagtatataaagtaaatggaatgtctttttctcttccctatcatactcaccctctggaagaaatcattgttaatagttcattttgaagccttttctgtgtacatactcaaatacataaataaggtacacataaggtttttgttgttgctcatggattgttcattttttttttgcaagcatagaatcacataataggtgttgtcctacaatgtgaatttgacattgacacttccccagatcgttacatgtgagtgtttaacagctgtgtggtattccataggattgatatactgtactttacttggcttttctctatggtttttattttttcactgatatgaataatggtgtcctagaatccttatacatatggattcatgcattttaaaaagttatttcataagatagattcctaaaagtggaagaaccaggactgacagtttgaaaacttacaatatttataggtattcccagtttttttctacatataggtcagtttatattcttagcattcatctttgagagtttcagttttccacaagctattaaac

SEQ ID NO: 132485 - DNA, 1057 bp, Homo sapiens
gaggacatttggcagatgttataacaggttcaaaggagaaatcaaaacagaacaaatttctgtgaagtaaagtactgttgaaattaatatgcaaattcaggaaaactaacttattccacggtcggggagggaagttagttgaacctctactggccaggacaaaattaacatgcctatagacaacagttattttgcactgctattagttacctacgatttacagagttgtaatttccctgagaatcagaatctaattacctgtagaggtctcctctagagtctcaacagtgcatggttttccaatgaagcacatttttttcctatgtataaccagcctgtcctgtctccagaatccacacacagacacacacacagacacacacacacagacacacacacacacacacacacacacacacactcccttcggacaacttgctgatcgtaaagctatagaaattctctgtgcttttttcttgatctttagttcatcatcaaccaaggtggatctcaagagtggcctcgaagaatgtgctgtggcattgaacttatttctaagcaacaaatttacagacgccttagaattgcttcgcccctggtaatttactttgtctcttttagataaaatatctttcagatgtttctgatgattctttgatgtcatgcttgtaaattaatttagctgttcccatctgaatattgataagctaatttagttcagacctctttactttggtcacttttaaaattcaatttagaaatctgagttttcaaatataattaatagaaaatttctgattgttttgcatattttaatctctcttgttcagatattgtcatcttataagtagttttataaggcttcaattttgctttcttcagtgaaatgtttttatgtttgttccttttaaatattattgagaaaattttcctttgaaatggggaggggaaaaaccagaatatgctgatctcaatgctattaagaaatttaagataagaagactattattggggttctctatttgttcgaaaaacaagcaatttaatttcaattaat

SEQ ID NO: 132486 - DNA, 1170 bp, Homo sapiens
aaataattaggcaagtgagtaaaggggcttattaacagtagtttgtaatgccaaaactttgggagtaacctacatgcctgaaaatgagggacaggtaacaaattatcattatttccagtcagcagcatgttgcagatgctatgataaagcaactctggatttattgagaagaaaagattcagaataattcctatatgtaatccattatactgtataccataacccattataataagtatctttaataaagttttattaaaatatgtatagatttacttgggaaaaaacctggacggatatatacaagatacaatcctatctttgggtggagacctgtggagtaatttcagttaacttattttttgtgtactagaatgaaaaaataaagttattagggctgtatttcaggaatgtttgacacataacagtagatttttgttacttgatttttaaaattgataagaaatggaggtaagatgtataaaaataattggaagacttatgttgtgtaattgcactggtgtagacttttctcacaggacaaagaaataaaaaaccttgctctgcctttttaattaacagatcttctcactcagatatggcaacaagcagccttcactttgcatcatgtgatacacaacaggcgcccagacagcgcggagcgtctactgtcagcaggtcaggaagggttgtgggcattcctgggggaagaggggaggacagtcccacccttgaaggaatataatactgatatttgcatagtgcattgcgtttgacaaaccaatgaggtcaggagaggcctaggcaagtagagtgcccattttataaatcagggaaggagatacggtggctgctcagggactcagtgaataggtggcactgttacatgaaagcaaaacaaaattcaactttggggcacaactccctttcaagtcgcttttatctttaaatatttttagctattatttttattataaaataataaatcacactgccaaacattggggaaaatggaggaaaggagaaacaaccataatgatgatcacttgaacacagaattttggtgtatttccttccagtctttttcctaggcatgtgcttcttgatacagttgtaaccataatagattttttcgtcaaatattatattatgattatttctttcttacat

SEQ ID NO: 132487 - DNA, 1206 bp, Homo sapiens
gagaaacacattgagtagtgatgtattctgacttcttcatgtggagagggccaaaaataataaattatactgttcttgcatatttcttagataactattttgagttatgtgtgataaaaagggatgatcagagggtgtttccttaaattaatatttgaatattcccttcatgaatatagacttaaattactcaaaatatatgcttaacttttttcattattgttaaaatggtacattatcatttttgaaaaaattgaaaaaaaaacattgaaaagtacaaagaatctaaagattacccacgccctacaaataatactaagggttacagttttgattgaggaaggctttgtaagaagtctaagcatagattatttagggagaagtttatctagtttatctattcgccagtttctcgtttaatagaacagttatatcctttgttggtgcttgccctttggcctttttcagctgtttttccttcgtgaggaacagggccagagtggagagaaaaagttgaaagtatattcctttgattctgaatgcactggtgacaggcctggcaaaatgggattggagttggcagtaaaatgatacttggggagtatctttttatttttgggctcttcttgctttctcattgtcagcagcagcacctcctccttcctctgatcatcggccatgagaacagctctttgaggaatcatccttgggcagaatttggtctgggaagcagttttttttagtaagaaagacaaatgttgtctatgtagctaatactattaagcaatagatttccagtggtgtgtcagagtcctgcatttcataattctagtggataccattttttatttttaaagttttagatttgaaggtacatgtgcatgtctgttacatgggtatattgcataatggtggggattgagcttctagtgtactcatcacgcaaatattgaacattgtatctaaaaggtaatttttcaaccttcacctccatcctccctcccctcttttggagtaccaagtgtctgttatttccatctttatttgcatttgtacctattgtttagctttcagaagtgagaacccatggtatttgattttctgcttctgacttatttcatctaggataatggcttctagccattcaagttgccgcaaagatgatttcattcctttttgtggctacatagtattccattctgtatc

SEQ ID NO: 132488 - DNA, 1047 bp, Homo sapiens
tttcaactgttctcctttactctggaactttcatccccattgaggacagaaaagcacattaagtggtcaattaaaaattacatcatctgttcaaatttccagcagtctgttttggagtgactcaggttttctgggagatgtgggaggggtaaatgcccagttaagtaaaaacttaaactctgtatcaggcttatatcttccttcttaaaaggttttccctctctctcctccttctgacatggcgttgggtgcaggaagaggtggtgtacagatggcccctgtctggggactgctgcctggtagagggccccatcctgttgtctttgcattggcctctctccttgctgcctctgccaccaaaggatttctggactgttggtgtgcctgtggcccaagggcttggcattctccactggcattggttggcccacaggttcctgagatccagcggccactcacatttaatcgctgtctctgccctttgttacagaatcatcatgccaataagcagtcttttaaaaaaacatttttattttatgataattccaaacttacagaaaaagtgcaagaataacacagagaacttctgaatgcccttaattcagttttaacattttgccatatttgttttattattctatgtatatacattattaggtattttctgagtcatttgagaataggattttgctccagagaaggtggtctagaaggatgaaccaaaatctttctagtgaatggagctttcatattcctttcttttctctgctttcttccaattcttctttctttctttctttctttttgagatagggtcttgctctgtcacccaggttggagtgtagtgacatgatcacagctcactgcagcctcaaccgtcctgtttcaagcgatcctcccgcttcagccgcctgagtagctgggactacaggtatgcaccaccaggcctggctgatttttcgtattttttgtagagatggggtctccctatgttgcccaggctggtctcaaactcctggactcaagtgatccgcctgccttggcctt

SEQ ID NO: 132489 - DNA, 2226 bp, Homo sapiens
ggatttttctaaatgcaatggaaagctcttgaagaggtctagaaaactggaatggtgtatgcttattcaaaaacatgaagtaaaagaatgatattgttgtcatgtgaagaattgaatggagggtgtcaagcacaggagtagggagaccagtgaggtggccctttggaggtctcgtggcttgggctatggtaagagtggtagggatgtcagagaaggatgcttggaagattaagctgggttgtggtggaccccggatacctggatgaggagcttaggtttggtttttgcagctgtgagggagctgttgtgaatgtgtgagtttttgagtgagtgcatgtgtatttgtatgtgtgactgtgagattgtgtgtgagtcactgtgtctgagtgtggagtgtgtgtgtggtcttctgagtgcatatgactgtgtgcgtttctctcctgttgcagctgtgatcaggccagtggcatgaagcaaagggctatcctgtgtggcacagagtaaactgggggaaaggctggtggcagggagacgagctgagagggtggtgcaatatgtgaaatgaaggcccagaggatgctcacttggctagccatggagaaagaaaagactacatcgggcaagtcctcttatttattttactctatagttgggaagaatgagatttaggagtgaaaggtaacttcataaaagacgtcatagtctctttaaattaggccagtttgatcacttgctgagtattttaccagccttattaaaaaaaaaattaaacgtcactgaaatgcatctgcttgatttctgtaaacagaattccataagcgttaagttgattgattctactgcctgctataccttcctgccaggaccactctccccaatgcgtgtattcattttctcttttagaattcttgagaaacccattgagaattcttgagaaactcattgtattttttatttcccccaggacgttttcgaagatgccttggaaaccatctcaatgtaagtaataacataataaaaagtatgtagtaaggaaaaattgatggttgtcttacataaaaagtaaatatttcattctcattttttggagagtacggcaatggctattttcagaaaaaaaaagtcacttttctataattaaagaggatgtgattatatttaagaaaggatctatctaatactttcagatacatttctgagtattatttcttgtaacaaaataaaatatttctcaacaaagtatttgtttatagctaactcttttaatagttgttcatatttatgtcagtctcattttgtagatttttgtgtttggtttgcacttagttttattaaaagcattcactgtaagcctatatagtttttgtaataattctaaattgctaaatcatattagatcaaatggaatattacaatttacttacctgcttctccattgttagacatttaggttgtcactggcttagaaatgtagaactaagttttacatgtgtatagctttgttatattttgaattatttctaaaggttaacataacaaatgtaggattactgaattaaaagggatgaatatgtttattgttctttgtatatctctaattgccttcctgtattagttaacttcagcttctataacaaaacacaatagcctgggtggcttaatcaacaataatttattttctcacaattttggaggctagaagtctgagttaagggtgccagcatggttgggattctggtaggggctctcctcttggcttgcagactgcctccttgttgtgttcttacatggccgagagagtgagagcaaaagctctctggtgtcctttttttttgagacggagtctcgctctgtcgcccaggttggagtgcagtggcacgatctcggctcactgcaagctccgcctcccaggttcacgccattctgctgccttagcctcccaagtagctgggattacagctcccgccaccacgccaggctattttttttgtatttttagtagagacggggtttcaccatgttagccaggatggtctccatctcctgacctcgtgatctgcccctcttgtcctcccaaagtgctgggattacaggcgtgagccactgcgccctgcctgatgtcctttcttataagggtgttaatcctatcctgaggaccccactctcctgacctcatttaaatccgattgtctcccaaaggctccatatttaaattccatcacattg

SEQ ID NO: 132490 - DNA, 1008 bp, Homo sapiens
gctgtaaatatcccacacccggcttttctctcatccaaaagaggctcagcatctttgacatgaaaaagagttgttgaggaagtatagttagggatcccagccccatctcctgagtctactggttggtcccatatctgagaatttaatatcctgtgaagttgtatttattgagcctgttttaagtcggacctgttctgtgagttatctcacatccttacaatcccagtgggcggctggaatctttattgtacacaacaggaagtagaggattgaaaggctggactcacctagggtcagaggtggagccaggattcagtcccagacaggtctaacctccaagcctaaatttatgctttccgctctactacacaggctgtgtaattaaaatcacttgtgtatttatttatagtgcgtagtacttagggagtagaggcagatttgcttcctagacacttgagcacatgacatggactttgtattgtgactatgtggacacatccaggagtattttgtgcttgtgagagaagggagggctcatgtcatcaagtcatgactaccttgatgggcactggctccatgccaggcactttcccctctgatctcctttggtcctcccaacagcttcctagggtgggtgctatgggcatctctaatttacagaagataactccagagtggaagggggaaaggattttctatagggatactaaggaagaaaaaggaggagagaatgggtgaacagcaggcctgaagcacactcgtgttgtatctggccctcccatgctgaagttgataaaccacatggtgagccaggcaggtgcaattaacccactcctttcttcaagttcattataaccctgctgccaaatccaaaggacttttataggctaagtaagatgtcctactaataacctcttaaatttcttaaatttttccacatagtgacagttgaaatcaaggcacagggccctttatactagcaaactacctgctcccagaggggacttt

SEQ ID NO: 132491 - DNA, 1025 bp, Homo sapiens
accttggcttcgtcatgcccgcgctctctagcttctttccaggtgtgcccagccaccgcagagaacaggcggcaggaaagcttaggaaaccctcccagagggcgtgccagaccgggaaactttatctgggaggtgactccacccacttgggcggggctgccgcccgctgggggccgggcaagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggtacgatccgatggggattgcgggcccggcccctgaagccctggacaggagtccgggagagaagagtgagcccggctaggacggccgaggccccgcccccttggtcccctctctggggtgggctggcgggcgccgggtgggggcgcccggccttggtaggtctgtccccgctggagctaggagggtccctgcggcgcgcggagcggacgcagtgccgaggttcggagcgccggccccgcgagtcgtggggatggaggacccacgtcctgccagcacttggatgggcgtgagggcgcgggaccataggacccgcagctctgagctgttccgggccggcccagcgacgcctgggctttacgaagtctgaccctgaagtcctggcactggctctctgggtgttcgtggaatcatccctcgacctgggaatctcaccttctatggaagtttcctggtggcagaaccgaaaggcttacgattgatgaaaagagggggcagcctgaggaacaatgagtagaggggtacctgccgcgacagcagggcagggctgccaggggctggggctggagggc

SEQ ID NO: 132492 - DNA, 1005 bp, Homo sapiens
tgttaataaagaaaagcaatcagggcaacagcgacgtgtacctgccattgacagacactttgacaatggaggaacctgagtaatggtgaagctgcgggagacttcatcagaggagtgttaaaaccccgactaactggtttcttttggggaccttccgggtattctgttactgaaatatttcttaaaagtgccttatttggggatgaaaatataaaaataactttaatctctttctccatttaacagtactggctgccttcatcggccttttcattataaaatataatcacagaaatcgttgtcttaagttctggcctctctgagccgcctgctggattttatctgacttcgtaattcagtaatgtatttaggaaaacaaccctaactcgctgtgaaccagatgcagagtcgaccttaaagtattgcttttcctttttgttttagccttgataaactgaaatgccttgaggacggtgaggatccagaagtcattccggagaatactgacctggtgactttggggtatggaggacttggtttttatgacctatttatttaaacattttttcaacattatgttttgaaaagttgaaagtgcagtattgattgttgtctgtatacccaccccttaaattcagctgttcttaatatttgaccatatttactttagccgtgtgtatgggatgcctgctgtgtgttttttcattttgctatcccccattcagtaagttagacatgataatttacccgtaaatacataagcatatagcttctaaaagtatcattctcctacataattattgtggtattattatacctaagaaaaccgtaaatacataatctataatattcagtccatattcaaacttgtgtttattttttaatatttttgaatgtttgtttatagaggtaatctacttagatctggggggcaacctaaatactctgacagtgtttttcaaactatttgtggtaaaggacagttcttgtttttaaaaattttta

SEQ ID NO: 132493 - DNA, 1027 bp, Homo sapiens
ggaggcagaagttgcagtgaggagagattgagccactgcactctaacctgggcaacagagtgagtgagactctgtctaaaaataaataaataaacaaataaataagtgatgttgctgaagcttttggaatgacaagtaagttttagcagcacccatgtattaacaattatctctcctattcctaggaattaaaaccaactaagtagtcaaaaaaaatgtcaaaactgccaaagctatgtagtttgctatagattaagggagcaacatgtatcaaggaagaatcaatatctaccaactacctttggtcccttatatgcataaaacgagctctttcatttgatgtgggaaagaaaaagtaccagaaatttattttatgtcataataaagaaatgatgtacttatgttttatttttataatataataatgtgaaattattggtgaggaaaaggaaggttcagagaaagataaagcatagagatacaaatttaggcttttgccacaagtctaatttttttttggcaggaccattaaggttaacaatggtcatgtattaaatacactagcttcacagtatatcaaaataaccccagttgaagaataccgtactgatttacattagattatatataattctacccacaaatcctgtttggagggactagaagaaaccaaagagatctagttgacctagtagtgcaaagtagtcaagggaaataatgtttaagcagtcttaaaattactatttaacatggcttaacaaaattactataaatcaatgaatacattattaactatagcaaaaaagagtctgctttaatatgattatcatcaacgttcttttttcagtctatctctaaaaatcacttcctgagtcttctgaaagtttcatttattccactcattctacaaatatttgttggctccctactatgcaccacagttctaggaattggtaatatagcagtgagtgtggcagatgtaacttaaggaactttcaagtgtagctaagaagacagaaaattaaac

SEQ ID NO: 132494 - DNA, 1816 bp, Homo sapiens
ttaccaaaatgctaaatttattcctatcatgaggaactagcggtcaaacccaaattgaaggacattctataaaataactgattagagctctttgaaattgtcaagatcgtgaaagataaggagagactgaagtattttaacaaactcaaggagactaaggaaaaataacagatgccatgtgggatcctggataggaatctggaacagaaaaaaaaaaaaacgagtaaattaaaaattgtgtgaaattttaaaaaggcgtatagctaataatattgtgtaagaatttatttcctgttcttaattgtctcatgatcaagtaagatgttgacataagggaagctgaacaagagatagaagggaactttttcctgcttttgctacttaaaattagttcaaaataaaaaaacttgaatgttaaatatgtttttgaagcccgaataacaaatgttgaactttgatttttttttttcttttacatctacaacagggttagaaaaaggttcttggaacatcgggaagaaaccattacaatagatcgagcctgcagacaagaaacattcgtttatgagatggtaattaagagtctcatctttttcacccttttctcttaaaacagtaaaccgacattggctgagggttagtaatgacagtatggtagctttatactggatatgcttagttgaaaacaaactagagaaactcctttgagtctgggaactagtgagagaagaggacccttagaactcaagtgaccacatgtttgactttttcagatctctgcctttattcttgtttggttttatcttgctttcggtattaggctaaatttatgccttttcactaccctatttctggtctttttgttctgctcctgattttggtttaaccacattctcaatcctcatctattatctcttgtgtaaaactttgggaaaatttaagatgatgactcttgaggaattaggagctagtagacacgataggttcagaatcaatgtgctaggcactgtgctggcacttgatcatgcatacgggcacctattgtctctcccacttattttacttttattgtggtaaaatttacataacataaaatttaccattttgaccattttaaagtgttcaattaagtggcaataagtacattcacaatgctgtaaatcatcaccatttccagaactttttcatcatcccaaacagaaattccatacctgttaagcaataactcaccagttttccctcctgcagcccctgctaacctctattctaccttctttctctatgaatttgtctattctagatatctcatgtaagtggaatgcttttttgtccttttctgtatggcttttttttttttttttgaaacagagtctcgctgtgtcgcccaggctggagtgcagtggcgccatctcggctcactgcagtctccgcctcctgggttcaagcgattctcctgcctcagccttttaagcagctgggattataggtgcctgccaccatgcctggctcatttttgtatttttagtagagacggtttcatcatgttggccaggctggtctcgaacccttgacctcaagcaatctgcctacttcggcctcccaaagtgctgggattacagtcgtgagccacagcacccagcctatggcatattttacgtagcataatgttttataggttcatccatattgtaacgtgtattagaacttccttcctttttatggctgaatactatctattgtatgtatacaccacgttttgttctatttatccgttgatagacatttgggttcttttatcttttggctattgcgaata

SEQ ID NO: 132495 - DNA, 1031 bp, Homo sapiens
attttttgtagagatgaggttttgccactttgtctaggctgatcttgaactcctgagctcaagtgatcagcccacctcagccttccaaaggtgctgaggatataggtgtgagccattacacccagccagcaatttgagatcttaatcaaataagattagtattaactacatcccagatgctttgtaaaagcctatttattcataagtgcaacttatatatatattaatatttcaatgacaactcatcagaatttatgacacatctatttaaggaatcaagaatatatacactctggcctaggaaagagttctttctcctaagagattcctagatacccttgacttaataatgttctgtattttcatcaaagaagagctgtctctggttagttcaataacttcccaagtattctaaattagtgaacataggctaattcctccattagccacctattctgcaaaaatccctcaagaattagtagaattagaatcattatggatttacatatactttcagttgcttctagtgcagaaatcaggcatatatttcaatactatacctgtaatcctactggatcgagagattgtttgaaatttgaccttatttccaatattccttattagaacagatggcacaagattatagattgtcaactctaaaaataagacatcagataggcagcatatgcttgcatttattagacagggtctcacgctgtctcctaggctggagttcagtggtgcaatcatagctcgcttacaaccttgaattcctaggctcaagtgatctccccacctcagcctcccaagtagttgggattacagatgtgcaccaccatgcctagctaatttttttgatttttagtagagacaaggtctcactgtgttacccaggttggtctcaaactcctggcctcaagtgatcctcctgccttggcctcccaaagtgctgagattacaggcatgagccaccactcccagagtgtttatttttaatgtaagcataggaatatgactcttcaaataattaa

SEQ ID NO: 132496 - DNA, 1122 bp, Homo sapiens
cagccttttgctgggcacaatcatgacagatcacaactctgacagagcttcaaacgagtgaatgaacagcaaagtcatatgctacagtgaggtcaagttacataaaaatggaaaagtgaccaactgcttagaaaattaggtggtcactattgagctgagatggcgacactgcactccagcctgggcggcagagcgagactctgtctcaaaaaaacaaaaaacaaaaaaaaacaaaaaagaaaattaggtggtcactattagcccagaaggaaaagtctccatacaatagtttagaaacaaatgagagatgaagaaatcaaaacagagtctagcctcttctttggaaaagttccggtgataaagggaaggaatgagatagtgtagtttgatggaatcccgcaggagaagaaaaggatttactgggacatttatgaaccagctagagtaatcgctattttcttagcttgttatttccttttgttttatgggaggaaatcaccttactttgctgatgtgctcaggggcttggtcaggagtgttgctgaattcaccaccaatctggaggtcactgacacatcgaattgaatccctcagttgtgtgagtttttgactgcccaacaccagcattgtttggtatggtttgtgttctttgtgctaaaagtcaaagaataaataagtgttcatttagagacaaagcgataaaactacaaatcctgtcatgactagatcaaaattaaattgctggttttcttaattttaaattgtccccataacttgatgctctgtattttcacatccaataattatagggccaaactcatggtcaaaattgtttacatctcccctgtgatccagagccactctgaaaccacctcctttattacacaccaagccactatttcccctggtattccctcaacctcaatccacccagggccaagcaccaggctacaagggacagcccctctgccaccaaacctactggaattgttcgaactagccaatcctaaactgtttactcttccctaccttgtctttcccacagaaaccccaataaaaactgtggtctatgccttcccctctcccctttcagcctcctaaatgagaatgatgcttcttcct

SEQ ID NO: 132497 - DNA, 1042 bp, Homo sapiens
tacaaaaaaatgccagaaaaacatagctcgatgatcattgttactactggggaaacattaaagataggactttgtttaggttttagttctagtatccaacactacttactgctctgtaagtataataaaataatgatgtttatttgatttctaattgggttcctttcatgaatctcaggagaatatacacatttagatcaaacgtagtgattataacagcaatagggtaaaattgaaaatagtagcagttttttaacacatattagtgtgattttatgatatatctattttgaattaatacttagagcaatttcatcattgttaatagttgattttctctcaatacaatctgttttcttgtaggacctatacaaatcagccttcttttattttgaaggaacattttataatgataaaagatacccagaatgcagagatttgagcaggtatagtttccaaaaatcttctcaaagtctttcctatttctagttatcaaagtagtgttatctccacaaatcctattattggcctattaaggacctttgccaaggaattattgataaatcttgtcttttgcattacatacatccaaaaaaaattagccagacacagtagtcccagccactccggaggctgaggcaggagaatcttttgaggccaagagttcaaggctgtatagcatgctataatctcgcctgtgaatacccactgctttccagcctgggtaatatagcaagactctgtctctaaaaaaaaaataaataaatcaccttaacatgcattattagtctctggcctttacatataagtaatagtggcaaattaacctttcactattttttctgcctatccagcatatactattgtttgccctaggtgatggtgatatatatatattgcttaagtacataatataggaaaaatctgtaagctcattttaatgagaccatactttcattatcaatgtcttaacaattacagtatacaagtatatatattattgttgccctttttaaaaaaaaaaaatgaaaaagtctcgttc

SEQ ID NO: 132498 - DNA, 1013 bp, Homo sapiens
aaaagacaaacctaaaaataaagttgcaatgttatatataaatggataagtactatatctgaataacagctatttaatacaaaatagagatactttttaaagtattaacagatttttaaccgtctaatagtaaagtatttcttaaagattttccaaaataatgaacaatagaggatgcaaatggatggaaagagttggtatttgcatggaaagaagacagtatttttgctgctcccaagccaagttgcaatggttattacttttactcctcttatttttaaaaaaactatctctggttttgtactctgaaataaagaaaaaaaaaggtaacaaaatgtcttaagtgctgtcacctaccttatgtcagtaatgacaatgacatgttcacagtctccctgatgacagtataagtaaggaaaacccagtttaatacacaagtcattgaaggtgaaatcttccattctagcagtctgaaactttccatagcctctatcatgggactctgaccactcaatgatagttctgaggggggaaaaggcaaggatatatcatttttccacaaaaacttaaaaactacagaaaacagtttgtgattgcagtaattcacattaacctagctcacccaactaactggacagttgccatcttgagatgaagaccaaaatgtttgacacatgttgagattaggaacgctgaattttcataagggatcagttttctgcaggttacatgatgtgcatcactttagcttaaatgcaaaatgtgtaacaatgccactcattgtgttttgaaaaatatttttcacaaaatgttagtatgtaatgagattaatatttcaaatacttcttagtttcaatgtttaatattataaatagtgatagttataacccacataagcagtagctcattggggtcttcaattatttatagtataaagaaatgcaaggctgggcatggtggctcacacctgtaatcccagcacttcgggaggccgaggtgggcggatcgcttga

SEQ ID NO: 132499 - DNA, 1031 bp, Homo sapiens
caccatgcccagccttgcatttctttatactataaataattgaagaccccaatgagctactgcttatgtgggttataactatcactatttataatattaaacattgaaactaagaagtatttgaaatattaatctcattacatactaacattttgtgaaaaatatttttcaaaacacaatgagtggcattgttacacattttgcatttaagctaaagtgatgcacatcatgtaacctgcagaaaactgatcccttatgaaaattcagcgttcctaatctcaacatgtgtcaaacattttggtcttcatctcaagatggcaactgtccagttagttgggtgagctaggttaatgtgaattactgcaatcacaaactgttttctgtagtttttaagtttttgtggaaaaatgatatatccttgccttttcccccctcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggtaggtgacagcacttaagacattttgttacctttttttttctttatttcagagtacaaaaccagagatagtttttttaaaaataagaggagtaaaagtaataaccattgcaacttggcttgggagcagcaaaaatactgtcttctttccatgcaaataccaactctttccatccatttgcatcctctattgttcattattttggaaaatctttaagaaatactttactattagacggttaaaaatctgttaatactttaaaaagtatctctattttgtattaaatagctgttattcagatatagtacttatccatttatatataacattgcaactttatttttaggtttgtctttttgccaaaatttgaagaagataaaagggaattggaggaagagtaattctaatatttgacaaatgtgaagtctt

SEQ ID NO: 132500 - DNA, 1257 bp, Homo sapiens
tggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttattcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcagtatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaa

SEQ ID NO: 132501 - DNA, 1027 bp, Homo sapiens
aatcaaccaggttactcccacagtttgcccgtgtgttatgtatcagttatacaggtatcccaccaagttcaagtcaaaagaaattcctaactttgtatatttctggagctataaaacccctgatttaagacagcttttctcttttttcgaggcagcttttctttatgcttatttcaatcaaatgtaacacgcctgtcaaattacatgtaacacattagctaatgaagataggcaactgaaaatgttgtcatgaacatgtcaacctgcttggtagttgaatttgacttttatataatagtggatacacatgcacagaagttactagagaagcaatagctatttctttaaacattcttcaggcatcagtaccatttaaggacaattagacattctagttttactaggagaaaggtcagtcatctctaacattgtgttgcagaattacacgacacaaacataaacacatttctgcctattaaaccagtttctttgtttctaaagagtttaatgatacaggtttgctatttccattagagcatcctttttctggccaatcggacaaaatagagttagcaaagccctcacagcaccctatgaaaaatctctgctcttatacaggattagatgcagacctcatcttgacctaacatctgtaaccaggtaagtgtatgagtaggaacacagacagcagtactgtatcagcaaaatctatcatattatttgaaatcactggatataatattaattataaagtgtatggttctctccagttgttcacataccaaatcccagtcagttctcagattcagatagatgtatctgcaatttctccaagcagctaagaaaaccttcaatggtcagttctgcttggtcatggtatgactctttttttttttttttttttttttttttgagatggagtcttgctctgtctcccaggctggagtgcagtggggcaatctcagctcactgcaacctctgcctcccgggttcaagcaattctcctgcctcagcctcccgaggagct

SEQ ID NO: 132502 - DNA, 1017 bp, Homo sapiens
tttggtccttatacagttttaacttacttagatttattctagttaagccataagttcaacgtgtaaacttgttttcattaaagaatttttctatcaaactctgctagtaaattactttcttgctatttacaagagtaagtgatggaattctgggtttgctgccaaggaaataatttcttagttaactggtcacagaggttgtgctgttttgggaaacggggtaactaaacagtaagctcaagatgataaaaaataaaggtaatatttatcttttgttcaccctccctttcttcccatgacccaccagatctatagttttacaaagaagccacagaatattccaattctagagatagagcatcattctcataatttatgtcagcttgtacaggctgaccttgctctaactagttgatgtatgttcgcttcaagcataattgctgtttctttaatcataactctcaagaaatggtgtcataggctgatttacagataacttctcagaactcttgataattattcataagacttaagaactttcaggatcattgaaattgttcattggctcaatttgtgtgtgtggtcaaaactccacagcttgacaaggcaccaaaaggtaattttgagatagataacccccaccccaccccaccccaccccaccccacccctccaaaaagtacgtgtaatatgtatgttttaacacctcttttgggctggtatgtgtgtgtatgtacgtatgtgttttgattactggataaaagagtcatacatcagccgggcgcagtggcacgtgcctgtaatcccagctcctcgggaggctgaggcaggagaattgcttgaacccgggaggcagaggttgcagtgagctgagattgccccactgcactccagcctgggagacagagcaagactccatctcaaaaaaaaaaaaaaaaaaaaaaaaaaagagtcataccatgaccaagcagaactgaccattgaaggttttcttagctgcttggagaaattgcagata

SEQ ID NO: 132503 - DNA, 1409 bp, Homo sapiens
gaagcatcccttctaattctgaaattgagggaaatcttgttgtctatgtgtgtatcaacctctctttttattaagattttgaaatatgttggtatcacagatataaaacattctcatgttctttaaagagaattcacttttatgctagaaatgatggaaagggcttggtccatgacactttgctgagttattttgcttcatctgcatattactttgggaagaagatacaacatggtaaaataacagttttgaagaagaaaaaaataataatgactgttctaataacaagtcaagtttttcttttgtttggttggtttcagtcttttcatgggtttaaaaatataatgcagacttaatgtctttttttccttcatcaggagaaaatcctaattccagttgtacctttcccccttttcttcaggccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataa

SEQ ID NO: 132504 - DNA, 1093 bp, Homo sapiens
tagcttcatcttttattttctcacatgatcttatgagtatgtaaatttaagggataattactggtcattttgcactacctctttttttttggaaacgatctttagaaacagattgtttaagtgttaagataattaacagctatgaaattactgttttgtcatgaaggatgtgaacagatgcattgaggccttggatgaacttgcttcacttcaggtcacaatgcaacaagctcagaaacacacagagatgattactacactgaaaaaagtaagtgatttcaagtcatgtggattctttgaattttgtcattacttcatttaaaaattgtttaaaaaatcaattaggaaaacaattatgatgaatgtatattgttttctcagatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacaggtatgtggtaaaaagccaacaatttcacaccagtttttaaaccatttgccaggactgcttttaaaaatggctttcatacatagtttcactgtgtatacgccacagaaaaagtatacaaaggcaaaatggtgaaaatctgatgggcctattgaaggactagagcagtgtgcattgagaacaaaaaatcatgtcagtttatattcgacttctaaggcagaaaccattgctcatgaggcagatgactctggataaacaatttttaaaaacccatccatcacaatgcctcctaatccctagagtacccacttcctggttgctcagctgcttctgttttcttctcacctaaaaagtaaaatagcgtacagtagccttttaaattaaaacacagcctcataggtggagactacacctgccattacttgatacaggtattctgatgatgctgctgagttaccctgaacagacttcacagtattaatgccatgtcctttttttttt

SEQ ID NO: 132505 - DNA, 4877 bp, Homo sapiens
tgcttaagttgggacctttttaccctgcaaagaatatttgagttctaaaacgaccgtatttgatttcacttccgcaattccatttgtcccagtgtgtctactttttaaacataatttattcttacaaatatgtagaatttaagttccataagagccagggatctgcccatcttctatcttctaatttataccaaaaggatgttctgtgacagaattccttttatgattggatagtgaagacactctttttactttgttttagatttgcctttaaattaaaaattatagcttactgatatctaaaatactattatagttgaatgacaagtatacattgttatgttctctaaaatagcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaaggtataaagtttacatatataaaatggctgttctattcttagtttatatatatattttttgttttttctttgttttttttttgtttttttttttgttttttttttgtttgagatggagtctcgctgtgttgcttaggctggagtgcagtggcacaatcttggttcactgcaacctctgcctcctggattcaagtaattctccagccttagcctcctgagtagctggaagtacaggcatgtgccaccactaccggctaatttttgtatttttagtggagacaaggttttgcaatcttggtcaggctggtcttgaactcctgatctcaggtgaacctcccaccttggcctcccaaagtgccgggattacaggcaccacacctggccatttatgtatttcttaatctgcccagtttaagagcttttaatattttggaggaagtctataaatatcagtggcagttaaaatgaatttgtttacctttttgaatagacttgaattagctgtgttacaaagcatattgaaaacgtccctttattatctgttctctaaattcatctattttacaattatgatctggaaattaagtaaacagtacctttccaataaccccatctgtctagaaaaggtagatgaaataggctgtggccagtgaagacaaatgttaaaagaggtggatttatatagagatttttgttatttacccccaagaagttcttaacacccttcaggcctattgtacattttatcagtggtatgtaaatttatttggacgccatagttgttgggaacctcattaaagctgtgtatccttttgtgtagaaaaataaaattttgtgtatagccttagagatttacagattcaggtcatgcaaatcttttgtttactttcatctgatttttggctcatttcttaatcttttagaaaccaaacattttaaattggataggtcatgtagtgtgcttgtcagtactcaagtcaaatcactctgtagagaggcaaacagactgacatactatattttatccaaaggacatcactcctatagcagggcataaaacaagatgattatttcacggtcattaatcaaagttaaacttgcagagataggtgtaattcaaagactatttttaggttgctaatttgagtattcatcccttttttaaaaactagctgctgcttttcccccaagattataattccataagcactagtcactgactttatagttaaataaaaccatcctaattctcaaaacagaagagaaaaggtgggaggaactttcagactgctcacagaaggaatatgctgaaaggccaacatgagaaagaagcagcagatcgaaaacgcaagcaagaggaacaaatggaaactgagcagtaagtatttttttttttctaaattttgggttctttttaaaggctagcatggaatttttaaataatagactttcattttccagactttatgaagccttttgaagaagtgacttttcccatgtgttagaaaaatcttcaatatatgatgatgatcttatttcaggcttcattctcttctgagaggatgaaattgactgaggcagtcactctgtgaattatttttgaatttaaacgaagtgcagataggatttaattgatactggctttgcaagaagtgtactcatcctcaaccatttgtttgtataatataatacatatagatagaggggcgataatatactggtagacaaagaatgcaggaaatgcccttattcatcacaccaccaagcaggcctcaccctaaagaccagcaaaagtaacaaaagcacatttggaaacccaggaagccagtaaaagtaaatctaaaggctgacagggtgtacattattatgtatgtgcaatataaatcaaattcaaagctgttttctcttaaattttgatacttatagagacaggacttgccatggggaatttctttccccttactatataattttattactagaaggaaaagtaatagcaatgataataatgaacagacttcgtgtctttattacatttgctttcctagttacctttagactgtcacttctgagttctttctctgacatgcttttcttttctcgtgaagcgtcttacattctgactaaattttgtttttttgttgttgttttagtgaggtgatttttaaaacatgctctaggtcaataagacaaagttaatgatgagcagtaaaacaattcttgaacaattttgtactttttttctttatataatatatccgtaagccaaagtctttcttgacaagtacagcgttttactctgctttcttagtttggaggatatacaagtagttttagctccttgagggagtaatttaaataacttatctaaagctcaaaaatattattccctctaatgttagactttaagcacttctgtaaatatttaagttattctttgtcacctatcattttctattctatcttttcactgaaaagctgttggactgtttgttgcttttgactttattgtgatctcaaaattaagatataaaattagttgttactagtatatgtagcccaacccttctttagtatcttaaagttatctttatgtatttcagtttcttttgaatgtcctccaatgtaactttctcaaattctaatatttgtgttttctttccttctcctgttattacaaaactttgtacttggacagttttgctctgtaaagcatttcagatgcagcttgtgtgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaacctgatttttagatattttttgttcttgtctatttgaattggttcataatatggcctgaactctaagccaaggtactagaaattaagatttcaattttaagtggttatttttgtgattgacaataaaatggtaccttttgtgaaatgttagtgaatgttactggacgtcattcaagtttgatgaattggccaaaattttaaaaacagtgttatcttaagtctatttaactttaaagctaacttcagaactcattaatctgcttgttacatgcacaatgattaaattggtctattttaagatgcagctttaaaaaagaatggatgtagaagccattaaacatttataggtgtcatcttcccattgtggcctgtttgtccagtgaccctgaaattgctcttctagcaacacactatttgtgatgtcactgaaaagccagatatgatttaatctagcatgttaattagagttttgcttatatttatgctacggaactgcaccattctaagagctacagtcagttcctttgcagtctaggctattgacttattttaaggaaaacatttttagcttttacatagggattgtgggcatttagtcacaaaattccaatgtgttgaaatatttttgttaacatttgataggcagaataaagatgaaggaaagaagccagaagttaagaaagtggagaagaagcgaggttagttatttcactttctaagatacataaaattatacatggaaaagaagttatatagacataacttttcatgtattggttttggaataattttatactcatatcctacaaatagaatttttcaaatccctaatgggctttatataaattgcattgtattttaagcataatcaagtgaacttgcttgagttgtttatgtttaatgctcattaattatttgat

SEQ ID NO: 132506 - DNA, 2502 bp, Homo sapiens
tctttcctccttttgcagttatgatcagtaccaactgctgcctcatgtttacattttgtttctaatttgtgttcttaacctttgttccattctaatgcttaaatcaataatactgattctcatttggggccattctctccaggagaatcatactagcagttatcaaagggcattagagtttgcaaatggtcagtggattccttactctctgttgtagtaaatcctttcttacgggaaataagaataactcctaaaggagaactgttaggtaacagtctcagtttagaaataaaatgtgtctgtatgaacgaagaattagaaataacattgtgttagttgcagtgtaatcacatactttgttctccatatcgcatcaagaatattagctttatttttacaaatgacttcatttctaagaaattttttgttttttttaagagttgttcactagagttataaactaagtttgaagatgttactcttgagttgattgttgaaaaaacaaaagatcatatagaggttatatctatacttgaactcaacgttaccatagactggcatatttttgccatcgaattaaactttgagtgcctactatttgctaaataagttaattaaatttttgtaattcaggcagaaaaacaagtagaaactgaggaggcaggagtagtgacaacagcaacagcatctgttaatctaaaagtgagtcctaaaagaggacgacctgcaggtaggattactgatgtttaaatatctgtttggcttgtgattaatattccagtccatttaaagtgttgctgcctcaaatattttggaatgaagcaaataggcaattgattatgtgtaacatacagatttcaaaggagataaacatgatttgtgctctgtttcaaagtatttaaatttgaaataaactttgctttatctctgttatgttttccctaaatagtggtaagagaggctgtggggaggttaaaattatcatgaataatgggtttattttacctttcacttaagagtcgtaagatttcaaaatggagttataatcagagaatgagaaatagcatttgattaaagtcattaatattttaaatttgtgcgttctttattgatagggattttgatttttacagtttgcagctctcttcagcattgcctatttaaaagtattttcttaatttggcaaattggaaatattttggaaaaatcttcgtaaaacaaaaccaaaattgagtgaattttttttctactttttaataggattcttactgaaaatggggggtaagatgagtaatacccagaaaagaaaaaagatttttatttatatattttggagtttaatattgcagtggataaaattaatagtgctagggaaactcagtgaattttgatatgaacttccaaagatatgtaactgcataagtaatataatatgtatatgaatattaaatataagtgctgtttcctattctaaaagttgaattttgtgacattactgttaaaacgatagtgaaaaatgttttaagccctctcagtcataataaggacaaattgaggattactctgtttacctctttataaattttttgttgttgctcattttaaccatggtgggggaggtattattttttcaatttagcaataattgtatctgtaataagctactaatattcttaaatagtatgtatcatttctaatatttatatctgagatttgtatcttaaatagaaactagtagttactgattttttttccatgtgtatattagctacagaagtcaagattccaaaaccaagaggcagacccaaaatggtaaaacagccctgtccttcagagagtgacatgtgagtttatttttaatgtataattatgcaataaatgagacatttgactttaaacaagcacatatctctgcgattttatcagttttctcttacaggatgtttgttattattttgatctttcttaaaattacaggaaaaactgggaaaattttgtaaagtaaaaattggtaaggaatggctatttatcatttcattaattaagactcttgggtatatcaatttatatagatacttagataatacaacataaaatatataatagagaaattgggcaagatggtatgtttcaggaattttagaatatatttgaagtaatgtcacaaatttttttttttttttttttttttttaaagatggggtttcactctgtcgcccaggctggagtgcagtgctgcaatcgcacactgtaacctcaaactcctgggctcaaggagcctcttcccactttagcctcccaagtagctgggaccacaggtgtgtgccaccacacctggctaactttttttgatgagactggtctcatcgttcccaggctggtctcaaactcctgggctcaaacgattctcccacctcatccttccatagtgctggaattataggggtgagccacgtgcctagcctacaaatcttttttttatctcctctagaataggtgctt

SEQ ID NO: 132507 - DNA, 1086 bp, Homo sapiens
tgcactactctagcctatgtgacagcatgagaccccatctcttaaaaaaattttttaaaaggaggtatctaaaatttaaaataattcaatcatttcccatcacttctgtaagttccaaggtctttaggacaacatcaggtttttttggtacccatttccctcagactttatggtgtgttaataatgaaatacaatactcaagatgcttgagtaggaatttcctctatgtgaaatggcttcatgtgtccttccctgctccttcatccgcctgacaaaattctgcctgtattttaaaatcttgttatcacaccacttccaacccatactgcacaacaaataagccactgtaattatttattttcatagtttacctcctcatgagatactgaacttttggttttctttgcatctttggtatatgataataatttgagacataaataggtcagaaaagggtgtgaacaaaacttcgtatatggaaggaaaatttcatattaattaaaagcctactatgtacctaaccttgcactgtcactcacactcatttctcacaacgtgaagtaacaacaacaacaacataatggacaacacttatataacacttactagtgtttaggtatcaggatttagcataaacatttcacatatgttaaatcatttaatcctccacaaccttggagtatatatttctacccaatttagagaaaactgaggcacagtcattaaaatgaatgaaaactggtgtattttatttcctttaccactcaagttactttaagggtgctatatcactaagaaagaaacacagatagttttgccaagtaaaacataacccataaaaaattaaagggtttagaataaaagctgaaatttaaggtttcattgtatctactctccctcaacccaattaaaataaaaattcttttcagatccccatggttggtaagtcagtgaaattacctttctctttctcccccttctggcagcttttggagtagttatgtcaactgctttagtcacatcctaaaaaagaaaaaagaaaactgaatactgaataaattattccaggaatgaaagaaaccttgt

SEQ ID NO: 132508 - DNA, 1046 bp, Homo sapiens
gtccaactgtatatgatctgtgtgtaaagatgactcatttagcccttccaggcctaatgaaatggttgttagatgatcttcaatgtcccagccaccctttaaaattcacaattcaaatttatccacccctataattcagaattctagtgtagaaaaagtagttttataaatttaaatagacagacttcctggtgtaccagcaaccatgacttacatttgatctgacagtggaaatgcatttttctcactttataatgttgagacacaatgtttttaatttcagaactctacagagcaaaacagatttccccaatgctttcagttaaacgtgcttgtaacttttagtttaacaaggtttctttcattcctggaataatttattcagtattcagttttcttttttcttttttaggatgtgactaaagcagttgacataactactccaaaagctgccagaagggggagaaagagaaaggtaatttcactgacttaccaaccatggggatctgaaaagaatttttattttaattgggttgagggagagtagatacaatgaaaccttaaatttcagcttttattctaaaccctttaattttttatgggttatgttttacttggcaaaactatctgtgtttctttcttagtgatatagcacccttaaagtaacttgagtggtaaaggaaataaaatacaccagttttcattcattttaatgactgtgcctcagttttctctaaattgggtagaaatatatactccaaggttgtggaggattaaatgatttaacatatgtgaaatgtttatgctaaatcctgatacctaaacactagtaagtgttatataagtgttgtccattatgttgttgttgttgttacttcacgttgtgagaaatgagtgtgagtgacagtgcaaggttaggtacatagtaggcttttaattaatatgaaattttccttccatatacgaagttttgttcacacccttttctgacctatttatgtctcaaattattatcatataccaaagatgcaaagaaaaccaaaagt

SEQ ID NO: 132509 - DNA, 1296 bp, Homo sapiens
ttcaagcgattctcctgcctcatcctctcaagtagctgggactacaggtgcacgccaccacgcccggctaatttttgtatttttagtagagatggggtttcaccatgttggccaggctggtctcaaactcctgacctcaagtgatccacccgcctcagcttcccaaagtggtgagattacaggcgtaaggcaccacgcatggcgatgtaaccatttttaagtgtatagttcagcagtgttaagtacattcacattgtgcaacgtctgtggttttacttaataggattatggatttaaatagtagcttgttactgaatttaataaaagtatttggaattattaattgccctttaacttatttaagatttgtaatgcagtttaggttctgtatttttgataattgtgtaatagggtgtcttatctaataaattatgtatttgagcttgctttgcactcacatcttccccacttcttttttagtgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggtaagtcatattacataaaatttgatattacttatttaatcctggggaataatcactatcctagctgtaggaaagtaaatactaaaagccttgggaatttcatactagtttgttgtgttcttatttgtgaggttgaaccttgggcattttatatcaaaatgaattgacaaaatcattattttatgtagttaaacagatctcaagaaactgggaactattcagttatttaactcctgatagagggtttaatacgtcattgaatataaagctgtatgtactgttctaaatttaggttttgcgacttacatggtgtatgcctaagttttcttattctctttaattaattaattaaatttcttttttttttttttttttttgaggtgtagtttcgctcttgttgcccaggctggagtgcaatggtgcaatcttggctcactgcaacttatgcctcccgggttcaagtgattgtcctgcctcagcctcccaagtagctgggttacaggtgcccgccaccacgcctggctaactttttgtatttttactagagacagggttttgtcatgttggccagactgatctcaaactcctgacttcaggtgatccacccacctcagcctcccaaaatgctgggattacagatgagagccattgcgcgcagcctttaatttctaaatcca

SEQ ID NO: 132510 - DNA, 1067 bp, Homo sapiens
gctttaaaggcaaatcagagctaatttaacagggttattaggcagtagacattaattcaagggggaaatcgtaacgtaataggaaactttaaaatctttgaactttggaaagagtctttaagtctctatttttaaggtagcgtttacagatgctataggtttattttttactggaattgatatttccttaaccaaaaaggaaagtagaaattctctgagcaataagaatgattgatggatgaaaatacataaggaaagttttaataagtgatctgatattcctatacagtaaaataagtgctttttataaggactagttggtacctaatttttggttttatgatatcagatatgcaaactgtgtatattgtggagaaggtgagaagaggaagtctagctagttccctccatgtgtttatatggtccctgaagctctgctgcctctggtgggtatgtgggcagagaactgatgtgaagcaaatttttcaaaaattgcagctgaatgttgacgtatgttactgccaagtgcatgggatcactcaggaggctaccgttaatttcccgaagaatgttcctatgtacctataatttaatggccttagaaatactatataatctggttgattttggacttgaagtttggtgtctgtcataattttggtagtcttgtttacctgggatgaggagaaacaaaactattgctattctgattagaattatgtattcctaagagtggctgcaatggcaatatttggtttaaagttgcttagctactgtataaactttcacacaatgtctttaatagctctattgagatggaatttacatacaaagaagttcacctgcttaaagtgattttcaatagattttagtatatttagtagattttagtatattgactatcataaccttttgatgatcactttcccctctccaaccgtaaacaaccactagtctactgtctgtatagacttaccagttctggacattttatttgaatggtgtcatacaatatttcataataagtttttaaaaaaatacaactttggatccagaattggtttggc

SEQ ID NO: 132511 - DNA, 2351 bp, Homo sapiens
ggccttgcgtgggcggaagggggccgctcgcttctcggaatccctgcctttttctctcccatgcaccccctcccttttggggcttaagctcggtggaaaaagcccggagaaagatggggcgggcagacgggcgatttctggccgggcagcatccctgcttcaggtggtggcgtctcttcggtggcggggtggaggacctgctccagcgcggaggcagcgcactggcgggggaggagcgggaggcggccgtcccctcgctctcccacccccacccgccggttcccctccccctccccttgcggcccctcccttcggggttcttcgctttaaccgccctcggtgctctccctagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtaagtgatttgtagccctcgcgcttagcagtgctaccctcctctccagaggcctgctgcccaccgtgtctctttattttttcttctgtcctttctctccctcgctttagtctcatttgtaacctgacctttcattttagttttttgcccaataatctcccgtgtaattatgaaaatccagacgtttctacatacctgtgtatttccctatggtttattggcagacttggacagattttcttcctaggaaatatttaaatgcgttgctagttaatattccattgtaggtgaaataatgaagagtgaatttttgtttaaaaattagtgaaacattgacatttccatagttttggatcaagtacaaaatatcaatggaatttgtgcagattacacacaaacacttggatgtcagagaagtgcgtatgtgattaaattggatttacagggttttaaaaaaaataccttgtacttgatgaggccttctggatttgcttgtttaatacagattcaggactggatattcttgaaagtattacagtagtttagtaccgaggaagggccagaaaattcatttctccttttttatttgagatgtttatgaccttgaagaagttgttttacctttttgtttccaataggcaaaaaggaggtgtggaccagattcctcagttcacatctagtggtacagagaaatgattaaggacccaggatgttttgtgacattgaggaattgagactgtttaaagatctacgctccatttttagaaaaagggttctttttgtttatggtggtacccaggctctcaaacagagatagataggacctaagatatgttgcaatcaattagattaggtaaactcaagatcctttaaaaatatacttacatggggttctgaagttttatttttccaagccatttattttcgactaatttactgtcctttgaaaatgtatttcttaaaaataattaaattctgtagttttagttatgtcagcaggggaatggtggaaaacacccattagataacggagtcctgtctaggagctgagagtgccatccaagtgtaaaacgatcactgttccttgactttcttccatctagctgctctacgtaaactcctgttcacaagtttccttccaaagcttttttccttgcctataaagtctgccttttcggtgcagtcttacttgaacaatccttagtcataatccttgtctgtatattttacattctaatctattcctttcgtgataatcttttgttttaattcttaactctgtgtatgctttgacctccaaatatattgtgagaccgagggcaacaaccttaaatggaatttgtttataccctccatagtccgtagtatatatgatgcacctataaaacacaattcacgttcaaatggagcctagggaaactgatcaggtttaaggcccctctgatatactttttcatggtcttcgaggtatccttgtttattttgaggtgtttgaaaatatgaggttgtctaatagatctatattccgatttgcatgccacagtgaagttaaaagccaaaggaaatgtttaaaaaatctcccaaatcaccctccccacgctcatatgttaagtgactaagagtgctactgaaaataaaatagggtagcctttggaagaccagagtgttttccttatttaacaagttctacatttaacaagttcatttggattggaagggaagtgtttgtcttttcccttttccccatcattttttctgagaaacacctccatttagtgttggtgta

SEQ ID NO: 132512 - DNA, 1057 bp, Homo sapiens
ctgcctcagcttcccaagtagctgagattacaggcatgtgccaccatgcccggctactttttttgtagttttaggagagatagggttttgccacgttggccagactggtctcgaacccctgatctcaggtgatctgccctccccggcctcccagagtgctaggattacaggcgtgagtcactgtgcccaacgtccagtgggatttttaaaaaaaatcactagatgacctgattacttctcatctcagatacttggtttgcttctttcttacatctccatctccagtcttggttaagggttctcttacccacatgtgtatatgccatactcctctttgactctgctgcctgattttgcctttttccctgcttcatcttattcctttgtctacattctttctcattttcctccgtgttcttactccatgattttggtgtgtgaagtgtgtagctttgaaagtagaatgatgtcttgctctggtcaatagacctaccaacctactgatgtcttttattgtctttgtaccattgattcttctaggtcagctttctcagagtgttttatgagaacagtagtatagcttgagaagttaaaaggcctaaattagggaaaaggaaattctatagacaagtgaatttgagaaacgcagagtcaaagttgcatggctttctttaaagtaagacatctcagagctgttaatatattaaatttgctttatgaatttctaaaatgggtttttagccatcagtccaaagttatttgataatggaactcccctttcttttttcctggaaaaccgtcacctaggactagtgatggtaaatattgtaccatgcaacattttggcgatgtgctttcttatgagcttattgataagcaggggatgtgaggttgagctctgatagccagacagacaccagaggctttactttaaatgcaaatttaatgtatcttaatatttagaaaaagtaactcaggtgctcgatgttcaattacagagaaaaaactaatagttaccactttgatatgacataagaaaagagagcacagactttgg

SEQ ID NO: 132513 - DNA, 1038 bp, Homo sapiens
tgggatgttcgaaaaacttactcaggttgccagattaagtgatgtacagttgatgtggctcagactgttaatatgttcctcttaattttttcatctctcttaaactcatagctttgcgtcttattttcttccatcttcctcttctttcttcttccctgttagctttcttttaactttttctgttttatgcttattagagctgctgttctctatttctttacctgaccataatatgaaatttaagacctgtttaatgaaaatgtctttaaatagtaagtacaatgtttttctttttataaattactattctgtcacttttcctaaatatattcttttcttgtacatattcctttattgacttttctcggtagattagtggcctttgggggaaagaaggcttgcaaagtttctcttgaaagatgtttctcccaaattaaaattttaagccataagaaatgaagtttttctagttctgcattcacagtctggctgttatttgtgctttcaattcataattgttgttgactgaagacagaatgacttatgaggaagattttcccttttgcttttggaaacgaaattgttttaatgacatgccatgattttacataccctagtgtgtcttttccacaattatatttcttttgagcataatagtttcagtattttacagactatggatgggaagcataaattactaacaggtaatttttcttcccttttgaggtaccagattgttttctagtttaggtcatgttcatggtcattatttaaatcttggtctttattttctctgttacattggaaaagaaagttaaagtcactatcctctataggtttactcgtgagatcaaggtgttattaataagatacaaagacttgagcaaattttgagacttacaaataactttgtatgtgttagtacagcatagccttatgctgtatcctgggctagatacagcagcagagctgttagaggctttagagatcatctagcccaggatacagaaagtcttaataaaccagttggaaagtgat

SEQ ID NO: 132514 - DNA, 1131 bp, Homo sapiens
ttagaaaatgaggattttctttccagagtttgaatgtgaaacaaaaaatggttagaacattctgctttatttcatgtaaactgtttgcagatttttaaatcttacttactttttttcccattgagatatttgaatagcttgagctttggttccagaagtaacagtatctttctcaatctcaatcaaattaattatagaataagtaacttcattagaaagagaagatgaaaaatttgccatctaaatatacaagtaacacaattttctgctaacgtgtggcagtttacactgctattttctttttttaaatttctttatttacattttatgttaaaatttttatatgatcttaaggaataaaatatagtaggacattttgggtattttattgggggagatgacacaaagaaatagcttgtgagcatatttccttctctgttgcatctccccgtatagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacaggtatgctacctttacaaagagctttaaaaaatgggttactcagtgtaaccattagaaactttttttttttcagtagcagtgctaaatcagtttaaacttcttaagaacttcgtagaacttgtttagatacacatatatttgtttagatacacacacatacgtgtgtgtgtatgggtgtgtatattaaggattgtctttcatgtaagtttggaaatatatgggtttctgattaaaatatcccaaaatgcattggtcagttaattaaatgcgaaaattatatttcctttatttatttttaaaataaaatattaaagtatttggtaatgtattgtcagttttagtgtaggtattcctttatctggtttactccatttgtggaggttcctatgtgaaccatcatttaaatttatttggggttaaaatctcctatgcctgctgatattatataaggttatattatataactgatattatataaggttatag

SEQ ID NO: 132515 - DNA, 1050 bp, Homo sapiens
accgtctcagtcaatgttgctcttcagttgttgaattatatgtattcttataaggataaaacatttttaatttggtaagactagctgaatttgctttttgtgcttatgatgtaaagacaagatttaaattaacaccaacagcagaggctcttaaaaatgtagaatgttatactatgaatttaaataatctttctgtgcttgtcattttacattgatagtatcataagacaagtaatgacagattaagacctacctagcagagggaaaactaaattacatggctttattaaggcgtaaataaacctattaaccattatctggaataccaattagtagaaagagcactgacaattttatttatcaacattaaacacaattattaattacagacctgatgaatctagcagtaagcaggccatgttggatatgctgggaccttaagtccattatatgagaaggatgattaccaaaatcctgtggggaaataagtaattgtagttgtaaaattttaattgccttggaataaggcaaattatattttcttgtctgagaatataaatagtatggcatgaaggtaacaagctttggcagttgtaaatagaaaatggatttatgttaggttttaaaacaaagaaaagagtgatgaatttttagtgtcatgctattccatgtgaatggcatactgtaaatacatgcagattttttttgatgtattctttagtaggtgagctattctctgaattcctttttttcatagtgaaaataatgtgggaaggacctttttgaatgaattactacaggtgaatgggaattatataattaaaaaatattttcattatgtgattagcagtgttgtgaaatgcacaagagacaattcacatttttgtgcctttttttctttttctttgaagatccaaattccagaatttgtggacatttactcataggtgcagccaagaattcttttgcaaaactcatggataaaattagtctggtaatggaatgtatacctctgcacagtagcaggagtattacatatgtagaaaaaga

SEQ ID NO: 132516 - DNA, 1060 bp, Homo sapiens
ctatcttcttattttatattctcgtagtttctcttcactctttgtattgaaatgctttttattgtagtaatattttaatttctaagaattgcttttaatttctcattctcttttcatggcatcctttttaaagtttctgtgttttcttatagtttttaaaactggtgtttaacaagcaaatattataataaacaattatttaagttctctgaattctctttcgttcttctgagatcttcatatttttttcatttgtttttgttgatcctttttttttatgctgaaggccatggaagattatattttccaaaaatggccacagcaatatttctgatcccacaagtgcttctagaaccttgctactcccatatcaagatgtggagtctatttccctctttttgaaattgaatgggcctttgtgaagtgacagtgcatggcttttgagactatgtcataaagacatggcttctgcctgattttctttctctctctcaattttctctgttggaaaccagccatcattctctgggaaagcctgggtcacatcgtgaactagggataatatgctcagctaacagctcagctagggtctcttgcaacaagctagcatctcatgcaacaagctagcatcaaatgccagacctgtgtgaatgagccttcagatgacttcatataccagccttcagctgaggctccagataatagggaacagagactagcagtccctgctgtgccatgctctatttcctgatccatggaatccatgagtctaatcacagtagtttgacaccattatgttttagattaatttgtcgtatgtaaccctggaacacatgacatattgttctaaattgtaactggaacaaaggctttcatcaaatttatgaaaagctttgtttgatcattcacatttaagaatgaagaaaaaaatgctaactaggagctctttgtatatagttaagagttggtggctggttggctttcctttaggatggatgggctatgagcttgctgttaggctgggcaaccctcaaatgaatatgctggtccttcctttttg

SEQ ID NO: 132517 - DNA, 1086 bp, Homo sapiens
taactctaattctatttggaataaaattgactctaaatttcatgtgctttctcccctgaaatctttattttttcatcattaaaagaaagtacaacttgagatttttataatcagattatttttagtaagaatacaatttgccttgcagtatttgaaaaaataaaatggaactgtattttgtaacaatttcccaaaccttatcagttctatcatttctaattagtacgtatataaaatttttgcagaaaatttgttaaactttgatgtgtaatgacccaagtctacttctcagtcagtctgtattcttctttgtttaatagcctatggcataaattgaagttaattatcagggctgacaagtaactctgttttctgtctgcttgcagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaagtgagcatttggaccttggggagatcacttaaaacagacaaaagatcaattcttactttcatgctccgggttttagccctggataatacagtgttagaaaacaaaagtacagctgtctttctttgaaattctctgatatatcctcaaaaaagaaaaactcttaacatactaaatgtatattttattgagaaacctcagaaaagtataagcttctatgtaacctctaattatgcttattttgggctctgttacagtgttacatgttagaaactatgttttattaatgtgaaatgtaagactctaaaagttttgcatagtatcttctgttatacattcctattctcttctgctccactgtctccgaaattttgttctgcatatattattatatactaatattgcgagtaatatttccataaagaaatgttagcatacaatcagcatgtgtatcatagcatttaaaaaatacaataaaacatattgaccatggaaaactcatttaatttttatagctgtatattctaatattttaagtagaaaaatatagttttcag

SEQ ID NO: 132518 - DNA, 1018 bp, Homo sapiens
ccctattttccagcttgataatttgatttgaatagtcagttttttagatctttaattgggatgtagccagattgataatttgattcaagagatcagtttttttatttctgtaattgggatgtaactataatgtgtggtgtggttgtggtggtggattttgccctcttttctggtgacagcagctggcagtcatgggagagttctggctttgctccagagttgtagattaagttaaataacctgccagcaaaagagggctagttgcttacctcccacttttcaaattatgagtttctatgcttgctgcagtgccaatggaatgcctgcttctgctgagagagtgtcaaggtctctttccagtaggtgtggaacacagctggaactgttgcttatatcctgggacattgtggtttggggatcctccattatgacattgtgatcattgtataaggatgattgctacacaggtaacttgtttcttagtgtaataattgtgttcatgtgtgtacacgtgtgtgtgtgtgagagagagagagagagaggatatgaatgaatgaggatgcccacaggtgcaaggaaactattgaggaaaataaagatgtttaatattcattgattatcacaaaaccacttttatgaaacaaacattgttgctaagattgccagacaatagatataaagaaaaaagatagggaaatggaagtaccaaaatcttaagtaatttcttcaactgttaattgttcatatatagatattaaaacgcattattgtttggcgctaagagcactagacttagtatcctcatattagagatggcaataactatttcacaaggtgggtaacagaatcaagtgacgtagtatggagagtacggttgtcccttggtttccttggggattggttcccaaaccttctgtggataccaatatccatgatattgaagttcctgatataaaatggtgtagtatttgcatataatctatgcacatccttctgtacactttaaattgcttctaga

SEQ ID NO: 132519 - DNA, 1049 bp, Homo sapiens
tttgaataattgccatttcagtgatactcctcataccttccagttttgaaggagacttttgtttagaagagcatagtatattttatacatattagtaacatgaaacctgctttctgtattgatcattgtaccttgctgctctgaaaaagtatcatatgcactattatacaaattttattttgtctctcaaaatactactttaagagagttggaatgtttaagatttgaaatcctaagaaaaattggattattatattctttttagtgttataaagaagtagtatgtggtttatattaatatttcgctgaatattagaatttagttattaaaagtagatcaaggaagagttatccactatataaaatttctgacattacttctcaaaaaatttatttttaaagggagatttgaaggaatatcatttatattatttattccttttagaatgtcataaagatgaaattcataaaatgtgtttctccaaggttagaaaatgggataacttttaaaatgtggaacttttaatcctaaaatattaaaggtcaattctcttgtgacttacagtgaaataataatccaggagcctattactgatggaagggaactttcttaccattcaataagcatttatgcatgtttcagccttttatacattttaggtccttagacaataaaagtatatatctaagaaccacatatttcagattgtctcatttagattttagtggagaatttaaaaatagaacaatagtaataatactacaatgaaattcaatagtttaccatttttagagtgctttcttatattaaatgcaacataggtgaagggttaagagagtgagtttgcttgagaaatacttggatttgtatcctgaccattgtacaactaattgtaaacttggactagttatttaatccctccaagctcctgtgttttgctctgaaaaactagattaaaaaaagtatctactccatatggttactgtaaagataaatgaaattaagcatgtaatatgctacatggtccctgcacttcagtaaatcccta

SEQ ID NO: 132520 - DNA, 1049 bp, Homo sapiens
aggcaaatgcccatttcccctctcccctcacaccttgcctggcttcttccatgaagtccttgctgcttttctgcctccccaaaggtgaggggaaggggctggttggggatctgggaaagccagttctctgttctctcctgctggtgatggactaggccttttagaactagcaagatccctcacacagctgggagaacacacacctttcttactccagacccattggtgtgtctccagtaacaaaattattggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatttgtatcaaaattcttgtacaatttttatattaaagatttatcagtcactgatctcttcttacctttctgatttcaagaaacctccacacgctccagtagatctttacaaaatacaccgagcagcccttcagctcacagtgtaattcaccttatttaagcacacttgttggtgaactcagagccaagctcaaccactgtattatttaatagatttctcaggaagaccaagctcatcttttgctcagatggcaaagctgggtcagagctgcagaggtcctggccgctcccaatggagcacagc

SEQ ID NO: 132521 - DNA, 1044 bp, Homo sapiens
tagaagtgaatgtgcttatttgatacctagtgaaagctgaatcaattttaaaatgctttcctttttctcacctttccccaccccccatccacgtacccccccttccctcttgttttcctagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagag

SEQ ID NO: 132522 - DNA, 1044 bp, Homo sapiens
gatttcatgtcttctgtggttgcatggtaaagttttcatcaaaggaacagaaaaagactggtagtccactttagtccagttagagtacttccactcagcatttcaaagaagaaggaagtttggttctgcagcaccctcccctcagtccaaggttttgtaactttttgcttttaagggtgatattggtctttaacaagcttttggtagattcacagtatagaaagagtacagaggtttaaaggaagcatttgtagttccaagcatagcccaagttacagggctttttcaagccctaattttgtggcattcccttataacatactatggtattaatagcgtcaggatcaccgtttgttttgtcgccaccacctttccttggatattctgttacatgagtcctaccttgggatcattgctttcttcccttctacagtgtattttgggaaatactttttgaagactcatgcatattattgatggaagggaaaccaatgtacttttaagtacctcctctgtgcaaagtattctactttacgtgcaggacacataagattgagtaagatttagttatgttcttgaaagtgaacgtctggggctaaggtttggaccactgccttaatgattaccactgcacttcttaagaccaagtccttaccccttatacctatgaactcattttctctctgcattccagtcactttttttctgtaagaggaacttccttccatatatctttcttgccttccaaatcaaagcaagtagaaacaacctttctactgttcatgttcttatagaatgtaagaagttctaatacagtcttagatatttgttattgagtattcttccctctttcctagagataaatattcagaacactaaatctgtttctagaaaaaccatctctgtcgctggagagctcaaaattggttccttgttggattctttgttccaattgttacatacaactgagtagggcttcctctgccagggagtccccctcctgtttccagcactctctggccttcctgccattttagggtcttc

SEQ ID NO: 132523 - DNA, 1647 bp, Homo sapiens
tcttactcttccttatgaaattgcctgctattaaatgatactaaaatatagccactcaaaaaaaaaagatacagtttagtaacaaggtatgaggggtagtgctactttattcatctttttgattcagaaattcacataactcctatttaaaggaattttcatcattgaatccagtgtcatgtctgcttatgttgaagaagtaaatttcacaagaagtacttaattccttcctatagtatcactatttaataaggactaaggtaccatttttttcatttatattggatttcacagcaagagttcacatcttatactaatatatgctaaatagttgcatagtatatagatcattgttgttaaaaaagcagtactgaaggcattttagatcacagagccccagtggtctacattttgtttgctttgacattattaaactcaatctgtttctctaactgtgactctaattactacatttgcatggcagaaaagtttgctttgtgggttgacttttattaacagtgcttgcatgttgttttctgctcttgctcagtgttttatgagcacacagagcaccttcagttgcattgaataattatgcacaatcaataagtttttgtgtttgtctttgttgtttctttgatgtggcctctaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccc

SEQ ID NO: 132524 - DNA, 1023 bp, Homo sapiens
tgtgtttgacagttttcataggaatggacacccacatgcacgtactcacacatattctttatgtaaaatggtaggatgctaggagtgagccttacaaaggggggcacataactatcagagcttttttaaaaaagtaattcaagtaaatgccaaatacccacttaatcaaactagctgtgatgattcagaccatagggcagtgtttcagagagaattttacatccacaggttgaggagagacttttcccttgcaaaagcagtacagatcccttatgcctctcatcatgcttcccctagtgtaacatcctacataaagcacagtggctgaaaccggaaaattcagatgggtatactactactagctaatctagagactttattcaaatgttgctaattttcccactaatgtcttttttctggtctaggatcacacaattattttttattagtcccctctaatctggaaccattcttcattttttataaatctttcctgaactttacactttgaagagtactatctactgttttgtagaatgcccctcaattttggtttgcctgatgatttctgatgattgagttgaggttgtaaaatttttacaatgtgtttgtccattcccatgtactaataaagacatacccaagactgggtaatttataaaggaaagagttttaatggactcataattccacatggccggggaggccccacaatcatggcagaaggcaaaggaggagcaaagtcacatcttacatggaagcaggcaagagcatgcgcaggggaattcccctttataaaccatcagatctcatgagacttactcactgtcataggaacagtacgggaaagactcacccccatgattcaactaacttccaccggctccctcccatgacatttggggattatgggagctacaattcaagatgagatttgggtggggacacagccaaaccatatcattagaagaatgccacaaaagtgatgtcgtgcccttcttagtgtgtcctaacaagcggaac

SEQ ID NO: 132525 - DNA, 1027 bp, Homo sapiens
gaatcatagatttcagattaaaaacaaattcttctaaattatctgcagttgatgcagtctgtcttttttaaattattatttaaagatgctcattttgtcctaattttccctgtaaattttatcagagcagatgtggtcactgtgatgcagcagtggcctaaactaatttcactgatgtaaacattgttaaacaatttcaaatgcaactttggaaacattgtttctgaacctgtttaataatgtttaaaaatgcatcaatgaaattggcttagcctgtggcctttattacattatctgttctcaattacaaagattctgtgttttatgtctggactagttataagtcactgaaaaaaaatgatgccagctgaagagtgtggcttatacctaacccgtttaatttgatttaaaattgatgaaccttggaaaatacttccagaatgccatatcagctatcaaaataataggaaatgtattcaggtcatcatattggcattacaattttagttaccctccccccccgccccacctttaacttttattcccattgcttttcacctcccattcacccccatttccattgttgtgattccactactaaattccaagctatcagctctgaaatgcaacatagaacattaaatatgtttttactaattgtgatccgctaaaatttaagctctgtgccaaagcctttttatttttatttcagaagtagtatttaagtgatgacatgcagtaatttgttcattcttctgtcagtataatttacaaggcaatggcagataaacatagcaatacaagattcatttacggtgacacaatggcagatacacagagcagaaccctgcctatgagataaagtggactgagtgacttatgcagtaattaggggataattgtcattaacctcacaaacagtagtttacccatattgtttaaaaggctccaggatgcataatgacaaggtaatctgtcaaagcgctagggggaaatattaataagatttgtgcaagcctggatagaa

SEQ ID NO: 132526 - DNA, 1056 bp, Homo sapiens
ggccattttagtcttaccaagtcttctgtaaaagatgctctctaccacttctccctctgccccacctgcagatgctgatatatctcaaactctggccaggactcaactacatattgttttggttaaagtattttaaatgtgctaatattcagtttcaccattgggcagttcagtttttgcccacaattggaaattgcctctagtctatcagcttttaaatgtatattcatttctcacatttgcacctggggctccgtttctcatacttagtctctagtccctgcatttctttttctttccaacttgtttttctgagatagccactctttttctctcttgccatttatttttacatttgaggaaatttaagtttttgcccttaaaactataaacaattctgtaacaaatgaactaagaatcataggctcaaccaaggtcttaaaatattttcagaaagatgaatatttacttgtattagaaaatattaatattcttatttctgagtatattatgtaaaacttctggatatctacatttgcaaatgtgactgcctaatcagacattgaaaaacaggttttaggctcacactggctgtttttgtttgttttattttttagtaaggatgtcgctaaagaaggtagttgagtttacagaagtaacaagtggttagttttcaacagaaacaaattaggtataagaacagcataattcataaaaattgtgttgtgtggctcacgcctgtaatcccagcactttgggagactgaggcaggaggattacttgaactcaggagttcaagaccagcctaggcaacataatgagatcccatctctgtacaactaaaataaaaaattagctgggtgtggtggcacatgcctgtagtcctagctacttgagaggctgagccaagagtatcgcttgagccaaggagtcaggctgaagtgagctatgatcacaccactgcactccagcctgggcaacagagtgagaccctctctctaaaattaaaaaataataattgtattataaatgtgatggttttagtaccatccaagc

SEQ ID NO: 132527 - DNA, 1049 bp, Homo sapiens
gaatacaaaatcaaaaccaagatatttgttaatatcccaatattgatttttgttattagaagtaaattttagaagtaaatgttgaaaaggaccacaaaagctgcttttccagcctctaatggaccagcagcctcttttgggaaatgattagttgcatcttccaataaataacttttgatatattaaatactcatttgatggctgctctctaaaggaaatgaagctagcatggtcccttggcttccatgagccttaatctcatgtatctgttattgcacagtttataatggtaggggttttcccccttaggactgactatgttttcagtaatgttatttttttttaactcaacctaactggacaccgtagagggcactaataaatcacacctctctgtgctcaaataaagacagacattctacctctttctcccacctacccacccattcctggatcgagcaacagaactgagcttaaggccacctagagccaccatcacagaatctctctttatgttggatggcagtggggatgcagatctgaaacactagtgcatctgaaacaacaatgggaaggtgtggaaaaaagggttagcaggcctgagactgccctctttagggaggcctgcttgccaggttggcccttggctggcatccaggaacttggattttgggagtattcccaccatttcctcacctgatgaaagagtggctcattgcttctacactgtaaataatatgctttatgccgaacacgcgctttccttctgggaatctggaattttggtccatgctaggcaaagcatgcctacgtgaccactcccacaaaaactgtgggcactgagttgcaaatgagcttcccttgtagacagcacctcacacctgttgtcacaatttaatgctggagaaattacatgcatcctatgtgactcctctgggagcaccactggaagcgtgcacttggtttcccctggagtttgctccatgcatgttgccctgtgctgatgctgctttgtatcccatcactgtagtgagtcttaggtgtgcgta

SEQ ID NO: 132528 - DNA, 1139 bp, Homo sapiens
gcatttgtgaactgcatgcacatgagaagtgagcaggcttccagctcagtggcaggtgcaagatgatgttagaaacaaaataactcttatacttgaataaattcacaagaaggttgtgagtccctgacacagtaggtatgtaaaaccacgtagctgacatcaaggcctgttgcacttttgtaacctccttgaatcactggagcgagcagtccctggtgatgcagcgtgttgcagggctctgtgccttgatagggagttgcacctgtgatacccgaaacctccttacaaactccccccgccaccccccaccacgttgtcctggatcattggaatgcaggcgctggattgaaacgtttattcatagtagattaagagtctaagtatctgtgaggcctcacttaggaggctcttagaggattaataaaatatttacaaaataacctatgcaattgcttcattttaaagatatttgcctcttatcacagcataaatcctcattcaagtggcttctctgttctgtgaaggaagttctgtacttgttcttctggagaagcagaaacagattcctgccatactttaattaaaaacatggaagcgcctggtttctccacacgtgcacattcttgttcttacacacacagccccaacaaagagatcaacagagggatataaaatgatcatttttgaaaaagacttactgattcaagtgagcggcattcacatgtaaaatgttccgaaaatttattctgttatttatgataaagaatcttatccctgcatgttttacctataaccaagagagcctcaattgatcaaagtatagtttttctagtaattaaaaatgaatattgatgtaattaaaaatgttatccttaaaagtctattatggtacttactgtatactatcttgtctgccgtcttggtagatcaagttgtacagtcatatttctagatgtaggatcaagatttcagttaatccttgggtttatgctaaggccacaagtatgtattatctgtatgaacaaccatttatggagtgcctgccatatgcctagaattccgtgaggcctttcacgagtactgctgtgtcatttaattcaatcctgataataacgctaaaaatcagggatttctcatct

SEQ ID NO: 132529 - DNA, 1034 bp, Homo sapiens
gtttatctttggtatcaaagacccagagaatttggagaaacatcacacagcttgaaaagttatttagacaagctataatatcacatgactgccccctgagtggtaagacattgcccagtggatctgaaaacacttttaagtacttaatcatcatcgtatcttttttaaattttttatttcttatttatttatttttgagacagagtctcgctgtgttgcccaggctggagtgcagtggcacaatctcggctcactgcaacctccgcctcctgggttcgagtgattctcctgcctcagcctcccaagtagctgggactacaggagtacaccaccacacccggctaatttttgtaattttagtagagacagagtttcaccatattggtcaggctggtctcgaactcctaacctcaggtgatccacctgcctcagcctcccaaagtgctgggattacgcatgagccaccacgcccggtcccatcatcgtatcttcatgagatagtcaggaatggaatttgaatactttaaattggaacatggagaggtgaggtgactgtctaaggttgctttgacagtggtggagctgggatcaacacttttatttttatattttaaaatatacttcctcttagccttttaattcagaaaagttaactttagtttcttaaaggaattcataagtgctacctcatatccctgtatagcagtcttacctttacagagcactttccggtttgtttcttgttagaaccccacaagggaaaaaagtaggatccccttctgaagatgagaaatttgaaggatggtcggttgttaaagaatctgaattcttctgactcttcgtccatggcattccactgtataatgctaattaaaatagtttcttctcttctgcagagatgtaaggttccactgtgacaagtgccattttgtctgcccacacactaggaacacctcaatagggaaagaagtaagagccacctgatttgctcttcttgtatcatgcttagctccaaagtagtctcccagatgtgt

SEQ ID NO: 132530 - DNA, 1074 bp, Homo sapiens
tcatctgtttgcaggatatggaaagatgcaggggcccgctcaagtctttttctaaggagaaattttagttcctaagcacctaaaaaaagacatgctgagaagttcaaattgggggccaggtacccccaccggaggagactatcccctttgttctatgagttgcttctaaagtaggagccaaaggaagtttccctccaggcctactctgaggatgcctgtccttttgaaagcattcaagaaaaaacacctcttgattcaggatcatgatacaaagaaatagagatatcaaatttttgataaaaaagaaaattctataatgttaaaactgaaatgaaatataattatatatgtttccccatgaatatttttaaactttttttagggttataaggaaatagtctagatatattaaatgtctaaatgaagttcttagcttttcagcaagaagaaatagctaaaaatttaaagtcaggaagcttacaaaacagatccaagagagtaagagacaaataactaattctttttgaaaaaatgtttaagtttgccattaataaatgattgtctaagtgagacagctttggctgttgcttagacattttaaaatcttgatttgttaagaaaatcaaggactttttttttttaatctccttgtcacattgttatcaaggaaagattttctttaaaagccaatactagaccctaaaggtaatcaaagagtattccgaagctgcatgatagttttaaaattttctctttttaaaggcagtgtgttgctctgtcacccacgctggagggcagtggagtgaccattgctcacttgggaacctccagctcctggcctcaagtgatcctcctgcctcggtttcccaaagtgctgggattacagacccaaatgatactttggctgttcttcagggagaggtctttttctctcttgctccttttcttcctgtcctctccttttctaccctgatggagcaacatggtggtttgggacacttgtatttaagttctcattgaatatcggggttcctcttgaaggctcttctggatcctacattacttctgacaccc

SEQ ID NO: 132531 - DNA, 1092 bp, Homo sapiens
tttataccaggatactagaagacacaccactgtcttatacagattggttcaaatactgatggttagttactagttgtgagacattagacaacccaataaccacctgtctcattcctgcaaaaggactttatttaggtataaagcaccaacagatagtagtagtgtactcttaaaacagagtgatgggtgtgtcctattttgccactagaaatgcttttttcacatctgtattttaaaatgattaagggatgatcattattttccctccctcatgcctcctgctccatccaccctgaaaaactaaattctttggccaaaatttgcaagcgcatatagaagattggttagcataactcagacttgcatttatgactgtatgggcaaggacaaagtagactctgtaattgtttagtcatatatgagctatatatatacttcaagtgagtgaaatgttttgttcattctagattttttttatttatgtgttttgggtttggaacccttagaaaatcaaagaaaaaaattgtttgttcttgctatcagctttcatatggttcccgagacaagtgctatacatttagaaaattaaaagggtaaacattaaataagaatgcaggagttggcaagaagtcaaatgaattggatgttcattaaatgcccagggtttggggacaggcaaggttactaaaaactggagcaggcttaatgagacacatcagacttgagttgagtttggtggatgggtaggattctgaatggtgaggagaatagtcttgaaaaggggtagaggagagagggaatgtagtggaaaccagggtagagtcagcatgcatgtggctagagacatgtttcagccagtgggctgggctgcaggaattgaggaggagttgggagtagcaggccactaggctaagaatctgggagtttgtgaattcccagctatgaaatggggccccatttcatagtctgggattactgaaggtttaaagtggaagaatgaaatccagaaagctgagttccaagagccttagtatgatagtagtaaattgagtagttagaatgaagattgatcatattttcttagccaggaga

SEQ ID NO: 132532 - DNA, 1548 bp, Homo sapiens
tgatcaagtccaagatgtctttgaccagaagtcctgaggacctatggagcagaataagtaagtctccttttagggtttatagcagaatcttaaaatttgttagtgtgttgaattatggacaaagaagcaatgcggacctttgttgcagtacttaaactttatatgctgttgttacctgttttatctctctcactagacttcaaattccttgtggcagagaaagtatttcttgcttatcttcttatactctgtgcctagtaaaatgcttgataggtcatcaatactcaatgactaaaattttctgtaatttgcattctcattggtagtgaagtattataataatgaacgattgttatgtactgttccatttaactctattttggaatgttctcaatagtttggccgctttaagcaagtgggagaatattctcaattatatttgggtttgtactagtgctatgtgtaattaaggttcatttatttattactaagtgtttattatggacctactatatgagcaagttgttgaatggaagcgtagaagaaggaaataggccaggcgcggtggctcgcacctgtaatcccagcactttgggaagccaaggcaggcggatcacaaggtcaggagttcaagaccaacctggccaacataatgaaaccctgtctctactaaaaatacaaaaattagccaggcatggtggtgcgtgcctgtagtcccagctactcaggaggctgaggcaggagaatcgcttgaacccgggaggtggaggttgcagtaagctgaaattgtgtcactgcactccagcttgggcaacagagtgagacttcgtctcaaaaaaccaaaggaaaaaaatgagctaggtgtgggggcatgcgcctgtagcctcagctacttgggaggctgaggcaggagaatcgtttgaacccaggaggcgtaggctgagccaagatcaagccactgcactccacactccggtatgggcgacagaacgagactccgtctcaaaaaaaaaaaaaaaaaaaaaaaaagcaaatggacacactgccctcaaaaggcttgtagacaagggagaaagatgagatttctctattaataactgcactgtttggtagaaaatactatgtacaatatgagatgtctagatataaagtgctgtagaagtttttgaaagtaggaaaggttccttttattccagaaggtcaggcgggccttatagagaagtgtaggctgggcttggtggctcatgcctgtaatcccagccctttgggaggctgaggtgggcagatcactgaggtcaggagttcaagaccagcctggtcaatgtggtgtgaaaccttgtctcttactaaaaatacaaaaattagccgagtgtggtggcatgtgcctgtaatcctagctactcgggaggctgaggcaggagcatcacttgaacccaggaggcagaggaggcagtgagcccagattgcaccactgcactccagcctgggtgacaagagcaaaactccaaacaaacaaacaaacaaaaaaaaccaaacaaacagcctggc

SEQ ID NO: 132533 - DNA, 1016 bp, Homo sapiens
acagaaggaacatgaaaatttggtttgaaacctagtaactctcaggctgcatggtctggagacaatagaagtatttcatcccttgaaaccagacgaatcttgagtaatcaggtgaacctgccttgctggctggtggtgcttcactgaagggttggaccagggtgtagaaaggactttggtggttcagatttccactggaaaactgtgacatcctgccatctcagagaagaaagttgcaggagatagccacacgtataggtgattcctgcttatctggctaataatattcttgctaatatttttgaaaagaaattagttttgggccttcacggaagctaacatttaatctcatagggcataaacacgagcgtagggtggaataacagcctaatgttttgaaccccatgaatttgctaatccataggaagttccattaagaaactccctagttcatcattcatagtatttcacctgtagctctaatccccaggcccatgactgcccttctctcttctgagttgtgtgtcagtcttcaacctacggtccttcccgactatggactcatgtacaactctgaatgaaactagcatctttcaaagaagagtctagttttcttcctggtcctgtacccctctgtgtttcgttgtactagagaaatttcttatttattaagaaccttttcggcctggcgcggtggctcatgcctgtgatcccagcacttgggaggccgaggcgggaggatcacgaggtcaggaaatcgagaccatcctggctaatatggtgaaacccgtctccactaaaaatacaaaaaattagcggggcatggtggcaggcacctgtagccccagctactcgggaggctgaggcaggagaatggtgtgaacccaggaggcagagcttgcagtgagccgagatcgtgccactgcactccagcctgggcaacagagcgagactctgtctcaaaaaaaaaaaaaaaaaaaaaaaaagaaccttttctcatgtcttagacccgtgtc

SEQ ID NO: 132534 - DNA, 1033 bp, Homo sapiens
cagagacatcaaagagaatgtgtactggatcaaggtgattttttttcgaccacatcattgccagctgtggtgtttatgattagagacagacgttccagacacctccgagtcctcactaagcgtcagatctttaacgggatccatcccaactgagtgacactaaacagacagccagaggggagttggtgggatagaacagggaagagggcgggtgagggtgagggaggctttggtgccgggtgcattcaccagccaagctccgctaatgccaggctgcaggctgcccagaggccccgtagcattcctttcagcacagctttcattagccaaggggatgactggagcccagcaaacacagtcattgatcctcttctcaccgggcgcagggatgcagtgttcaggtcacagcccagtcggctttgaagcggctccatttcagacactgacagccacagactattggcttcttggagctgacatgattccctctcggatctccatgctctgctccatgcagctaatgatgttgaattccctctggatgttgcttccacttgcaatattaacacttgttcagtggtcctattgatgcaagaattatgtaaatagccaacagtactgatagctgtgcattaaagggagttctctttcctcccgtctgttcccttctgggtcagtgtaactgccagacagttttgctggttccagaaaccagaatatatatctggaatcagtaatcaatgtggtggtttggagttcaataattggaatttttaaaatcaagatgatctgcttatccagtgattgccattagcaatgaagaaagaaatggttttgttgacaactacttatttctctctccatgtgaaagtgtttttttgtttgtttgtttgtttttcaattctgtcatcatcgagacgtggatcccttgctaacaacagttcctggtgactatagaaattaagactccttagaagaaaaatgttattattacaattcaaaaaagaaacaaatgtgctcacctgttggtggg

SEQ ID NO: 132535 - DNA, 1066 bp, Homo sapiens
ctcaggaatgatatggattcagataaattacttagattgggctgctgggatgaaaggagtctcccttggtctacactctcttatgtgctgttcagagaatgtcctatctcttgctctccaactcttgctatctatgctatcattgtctaaacacaggaagaagacagatttaggtagtgaaaaatgtctgtgcatgcaactacctgcaatattgcagaggaataggaatctcatgctctccattcagattgttcttacaccagttcctttccttctcgattttgtacttaaccattcctgcttttctttttgaatctttggcttctttcttgttcaaggttttctctcttgcttctctccctttccctcaaaatcactcacataatgaagcactgaccttcgatgtttccttttctgtgacccttatgacaagaatgcttcaagctggaagagcccaagtgtcgggttggtgttcagcagtgtgagatgattgttttactcttgcctgagagtcccatcaagaagcacgggaaaggtttcctcgtaggcctcctggaactactgtgcgtgtgcatttagctggaagagaagggagcagacatcatcctgcagaagtcagattatggtagccaaaatgtgtcggtatctgcccattagagtttctcaagaaggattcttaaagataatttgatttggtccttggattctgggccttgccatgtttggtcccaggaactatggcactggtccctgccagtgtctgttgactgtctcgtgggtatggtcatctgtcctccactggaacataactcctttagttctacctggaaggaggccaaacacagtctttggtgttgtttcaaagtctgattctttctcttgccagttgtatgacttgagcaaattacttaacctccatgaacctcacttttctcttctgtgaaatagaaatgataatgtctaccttacagggttgtagaaaaaactggagaaaatggtagttaagtgcttagtacctaatgagaactccacaagtagcagctatttttgttgtcattgtctgcta

SEQ ID NO: 132536 - DNA, 3300 bp, Homo sapiens
tctcatcctttttccacctcttacctgagctccaggatgacattgccttcctgggtgaggcagcgttgcagcatctcatctctcccaccttaatttgtagcgatgcgttgcatttgggtgacaggcagttgttcgtgcttgaataactcaggatttgaattctacagtttgtggcatccgtgtaatgcttagcagtaggtacagctgttaactattcgcttataaataatcttttttgcctctcaacctgtctcccaggtagtgtacctgtcaccattaataactctttagccgctccctagtgatttgacctatcagttgtcgttcacagaaaagtggtgctctggcctgctattgaagcttatgcaggttctttcagctcctcagtcaccccagcagccatatacttgtaggaagttgtgttggtgggcttcacaagcaggcagctgaacacttcgtacagtttgataaaggtggcattacattttgaacaatagatgataagactcccatttagaccgcaaaacagtgccacaggggtagacaggggtctgggggagataagatgggtggtgaagatgaccaacagcaaataaactttcctgtctctttgatgctaattatctctttgcacctaattatcatggcatcatcatcatcctctgatgtttgcaaactaagagttgatgtgtttgatcaggttagtgaatctgtcaggtatggcattctgcctgtttctgaagcttaagaatgagaagccagtagctatcatgcggaagatgtgaactgccccccagtccttgtcctttagcagtgtgtcattcctctgtttggacatgtgctctcttgcttcctctcttcctctctctgttcctgaagtgtgctgcttccaacacttccccaaattaattcctacctgcatttaggtctcaacctagccatcactttttcaggaaactgctactgctctctctatttggcattgactgtaccaactaaaatgcccatatggcagttttcgtttatttcttattatgctctacaataactgcttgtttacttgtctttttctcctactggattgtaagttttttcatggatggtacatagtgttgtttgctatatccacgttctgggagtgtcatagaatctcaataaatttatgtgaagagaatgagaatttattttttatgaactcactttccattgacatatcatggtcatatcaatggggagttcaggcaataaattatggcatatattgtctactgtatactgtgctggcaccaggggttcagataggaaaacatttcgattgctttttacccttttagtgagtgactaatggacatttctttgtctgaggatatatcttggcagtacaggatttcttcagacgtggctcaggaaatggccgagagtaaggtgaatcacaaggcaaaaaaaaaaaaaaaaaaaaaaaaaagcattaaactatgttgggaagtaatcccagcattggtggacacacattatgtttttaaaaataaatcctccaaggaggtaaatcagttaggtattatgttggtttggttttcatttggaaaggaatttacctcgtaaacgatctttgttatccttatctcactgggtgtaaggagttagcaaatgatcacatttttaatacccagaaaaataccatattctttgccacacagatgtacgcatatgccacatatacatacatatatgtgtatgtatgtgttcctttatatataattaaatacaacagtgatctgaaaagaccaaaaagagtaagaaacttagcattttagggagaacaaaaacaaaaacccaggatgaagcattttagtttacctttataaagatcaggacaggttatgtctgtaggaacttatatacagtatctagtagatagaatgataaaataagaaacaaaaagtatttagtcataagttcaaggatagactcttgattgtgctgtatcaaatacacttttaaagttaaaatgtattctaaaaaggaatacatgcctttagcaaaaaaaaattatataaaggactgtggttgaaagtaagtgatattggggtatagttctagaaatagtctgtgcatgtaaaacacaacatatctttctgtgtgtttgataaaaatggtgaaggggaatatagtgagcacattattctgcacttttcctttttcacttaataatatatcttgtaaacaacttcatatcagcacataaagagctacctcattcttttttaacagctgcattgtatggatgtatcgtaatttgtgtgcctattccttcatacactggtagactaggtgatgaaacatatttttgatctttggtattctggttgttgataggggataaatggtagtacattgcttttatttgcatttctcttaatgagtaaggtttaccatccttttatgattatcagtcatttctgtttccattttttttctaaacgtcttttcaggttctttctatatttctattgcgttgtaaatccgtttcatttttagcacctttttgtatctaaagagtattagcccatagtatatctgtattgtgaatagttgttcatagttggttttcagctctttaccttgtttttgcttttgcttttcatttgtttttgttgcgtagttggttttctttttttaagttttgtgtggttttattaccttttgattgacttttgattcttgagtctggcttagaaagatcttcaagtccttaaaacaatgtgaactagttaatgttatctagttatcaatgttatctactagtattttatgtagtaattgtattcagtgaatttcaatctccttccccccccctcccccactccgggtctctgtctgtcacccagctggagtgcagtggcgctatcacagctcactgcagctttgacctttcaggctcaagtgatcctcccaccttagccttctgagtggctaggactgcaggtggtgccaccacacccagctaatttttgtattttttgtagagacagggtcaaactatgttgcccaggctggtcttgaactcctggcctcaaatgatcttcctgccttggcctcccaaagtgctgggattgctggcatgagccactgcatctggcctgaatttcagtcttactgaataaaatttttcagccaggattgttattttcttaaggtaataaatgttgttgtatagagcttattattaataagatttttcattcatctattttttcttccactgtattgttattttaatgacatttatttacacagagt

SEQ ID NO: 132537 - DNA, 1276 bp, Homo sapiens
taaaaggacagggaaaataaatattttcattacaaagattacaaaaataaagattttcattgcaaaattattcttatttttttttttctgtatgtctcttggctgttgtatatctcccacttgaataataagcagatcctatagtcagtgcttcctaatgccactccagtatcaaggataagctacttaaatagttttactcaacaggatatattgataatttatgtgttaacagaaagtagtagctgtgttgttaccaaaaaaaaaagaacttaaatctttaaaaatttaatatgcgttagcaactgagataacgaaatgaacagtgtggagttaaagaatctcatgcaacaaatggcagaattttaagtgcattttgtcaaacttccccatttaagaagagggtgagctccttcctatattactattggcagcttatcggtggtgttagtcaagcattttgaataaaataatatgttaaaaaatataattgatttctttgggggaatacaggagatctctagataaattcatttagatgggttgacaaaactaatggtgtgcatgattaagaagaaaaatttgacatattctgtgtataaccctttgagtattaattctgaccagatcacactgtaaataatgttaactgtcataaaataaacacagccggagtttgcaccatatgttttataattattttgcagcttctttttttttgtttgtttgtttttactgaaaatggaacctactgataactctgtgaagttatgtttacataaaagtaaattatacttgcacgttaacaaacttggcttcacagaccagtgtctctaggtttttgtttaaaaaaaaaattaaatgaaagaaaaacttctccctctctcgcttggttttttgtttttttttttcttattccctcagaaacatcgtctcaaacagaaatctgctgtagcatcttgtcgccgctttcttgtttttgcacatgtgaaggagaagcctttggaatgccacccagaggagggaaaagcctaaccactgaactcacagagagtgtttggtttaagtagccctggagtggcctttcagactgaggctactgtggtcttctagtttgtttttgttttctaccttcttccttgcaagtgtttaacactgccagaaataaaggctcccttagaacatttaagtaatttttaaaactgttattattttcataatcaccatctcctcttgatctcaggggaggctaggcatccttgtttatctttaatag

SEQ ID NO: 132538 - DNA, 1079 bp, Homo sapiens
ttcctagtttcatttctctgaactgagcagctacctaggatttttggaaacttagttttataggtgatgaagattatttttatatgtagaaatgtcaattgtgacaaaagttaaaaatttggaaatcattttattatctacagatctacagaaaaaaataggcagatttttctttccacctagatttaattttaagaatatgaatatttgattcatccacattttcatcttaacagatactgctacatgtttaaccaaaagattaggatttttgaatggtttgctatttagttacgtttcagagccaaagtataaaagttttgattttttctgccatttactttgtcatctaggttaaactcctccaaactgtgaatgttttttaaagaaatcatatctaggttatttatgaaaatatacaaaagccatcttcctgctgagtaaatagaaaactagtttgttcatggtttctctgtacttcttatagatgggtggagaatcatttttttgttaaagagtatacctacctacaaaagacgataaagagagatacttggggagaaagcaacttagtgcattatttgtttccagaagacaaacatgcaatttataatttaaattaagatcagggtacataaactattaagtatgataaatgacaatgtatttcaattttatattatgtcagtttagagagacggattaagggaaagggtaatgaaggaggaagagagacacagatttttagaaatgattttctcatgattttttatgatgtggttttgcaaccatggtacaaatcagaattaggttgcacagttagatgtccattcctgcattactattgtgtgattctctccttcacgggcagtcttatttactgtaaaactaaaacagggagacttccacaatgttagatcgaggaagaaaaccataattgataatggtaagaaagcttaacagtgccaaaactagtaatcctcaaaattgcatcttctaatatcacatctagagctctttgcattgagtaatatttctctttaaatcataacagtagtaattcattcaggataggacta

SEQ ID NO: 132539 - DNA, 1042 bp, Homo sapiens
ctatatagccgaactaaccttgaggagcatacagttcatgagtaaaacaaacaggtaataaaaactgcttttgtttatagaaatttggtttaggacagaaactaaaatttggcttagataatgttcccataattttctcttatttccttccaaaatatatctttggaagaaagagcaaaaatacgaagattcatctgaaagattattatattttctcttttcatttaaagtacattattagcttgagttagaattctatgaaatatttatgggatatatatacaaagctttatttaatgttacagttattgtagacagggcttaaatacaagactgaaggagaaggggaattttttttctccatgtcaaacaggctgtccaatttatgaaaagaaagggaaaaaaataaaaacaaaaggctgtgtttttgtgagtcttaaattgtgaggctagaaatacatttagatagaataaaaactcacatacctcagcttattagtgattgacttttgagaccttctacagaaaagaattttgctgaacttcacaacaagaaagaccacatagggtattttagaccacttttattaaatttagttagcatttttaatttttccacaatgttgcatgcctttaacaaagtccattctgaaatatagaattgtctataaaagatttggatgaggtatagaaaggtatacaagaaccagagcaccaagggcgtttattattagtttaaagagtttcatttcactgaaagctgatttttttttaaagtgagtaaagcatatattagtatattaatagtggtttaaattcccagcattttattatttttcacaagtctgtgggtcagctgggcatatctgcagtgagctggcatgttgacctggggttggttggtctaggatggcccatttacatatctggctattaggttgttactggctgttggttggggcagtggagataactgggcaatttatcatgcgtccttcagcaggttaatttgggcttgttcacctgcagatagttgtagggt

SEQ ID NO: 132540 - DNA, 1043 bp, Homo sapiens
ttctctggtgactttccgttggattcaaattgtggtctcttaggtgaaaaggtcagtgtgttattcattcagccacacatcgatggagattaactgagagcagtacaagacatttggatcctgccagacctagggcacctgaaggaagtttatttcttttctctctagcctttactatgcctgctgcagaagaggatggccctgtcttctgggagtaggggagggttttgattggctgtgtgttaactgcctcaaatccatggccatagggcgagtaagaaccctggagaatcaaacatgtcatctttgtagcatcacctgatttagtgcttttcctcaggtctgagatgtctcagggggcctttttcccttgcagcactgatctttcaatgaggtgctagtgtctgtcctgagcaataacaaggaaaaaccatgaagtgtgaacagctcttattaggggggtaaatgtcattagcgcctttgtagccttctctgcaatctgaatgctcctgtcaaaagagcgacttactgaagcctcctttaaaatcacataaatggaatttaagatgctgaagttttacattttaattaagcaaggccattaactccctttacatatacacttttttgtagccagttatgcttgtatgccttataaggctattgaaaaattatccacaaaaattattttaaggatttgagaaatagttggttaactttaagtcaaagttttagatatagagaccctatactcatgtgcccaaccattgtaatatgcgtattgacgtatatgataggagaaaacactagcattttgagttaataagtaggtcagtttggattaatggaaagtttgaagcttagagtgtttaaataatgattttattcttttcaatacacaagtggaaatgtttctccagtctaaattccccctagtattctcctgaaacaaaatttttatatgcagatatttgcttcttttgcaagtttgagaatttcacagtaacttctggttaccctgggttgtgtcttgcagttaccaa

SEQ ID NO: 132541 - DNA, 1032 bp, Homo sapiens
tgaaacacagttcagttaacaaatcaatgaggtttttagcaccagccacggtcatttgaaaaccccctcagtgactctttatctgaaagttgaatgtgttttctatttgttgttgcctgcaatttataaacacatccaattaaaaaaataggaaagaaaaggggtaaaacagaaaggaggtgtcagagaactattttctttgcaagatcttgcttaaacacctatggcgaacattcatgtgtagaaatggagccctggtaacttccagcaatatttctaactcctgttctctctctttatcttattcccaacacccccatctctggaactttggcgggaccaccacagccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggtagggagaggacttgaacgccgcccgtgtccggggccgactgtgggtggggaagggtgagagtccttgacaaacctcgcaggaagggctgcacaccctcctctggttaaagtggtcgtttcagcaggcttgtcagggaaggggaaaggagagagacaaagcaggccaccatcgggcctcaggctgtattagaaggaaaacttggcctcttgacttgcgttacctttgtttgcacctttttgaattcaactctttctctacatcatgggctttctggcttcttcaacaagtcttattataaccctattaaaaaggagggctctttgaggcgggtaatgggtgtgtgaaaatctgagattacccttcatttgggtttattagggctttttctcatactcagtttgcaggtacggtgtttttcttggttgtctttgtacctaaaggtaca

SEQ ID NO: 132542 - DNA, 1398 bp, Homo sapiens
gagtgactccacaacagtgtccatatgataatttgtaaatgtgtcaagataaagagaggagactaaaaaacaactaagtttcgtctgacaaagggagataatgttcccagcaagctctggcttggagactatcccaacgaaaacaacattttctttcgtagaaatttttttccagaggggtgtttagggtttggtgaacagtagcacaggcactaatttgagtcctcaggggaagggaagtacatgcttagcagtggcaaagtaagaaccagatccttaggggaaatgtttctagggctttgttcagaaacacaaggatagaaacactatcgtcttcttcccttggtgcactcgtttggaaaaagcggaagctggtgcagtatctgcttaaagaatttgtctttctagtggacttagtttttccagattgtaaatgctgaaacccggctttgcctagctgcaaaattctcttttgctcagggaaaacagcttttagctgcctcctagttttggtgaggcagctggattctggtctctccatgagcaaagtccttggacttttttcttcgttttagagagcaaaagcaaggccattttcctgcctggcacaggaggcttttttgggcttgacctgagggcacagtgccctcttctgcctctctcctttacttgctgatcactgctgataagctctaaagggaagacatcctcataaatgcaaaggtttggtgcttgattaatggcactaagtattttcttattgtgtctctgagcagcttttgatttgtttctcagcctgcacactttttggatggtgctttgcactccttaaattttctttaaacccagcgcaaacagtgcctccccttcaaagtcctgggctgtctgcctattagctccccagattttctttttttcctagctatgttttattcagatggaacataaagtgaggctggcaagacctggcctccagtgtagtcactgctggtctgctggtaaggagtttcgtgggagggtgttgagaatgaaacacacagagctgtatcccgcttcgggtgaatgaatgggaggcaatatacaaaataggtaagaatgttgttcttgaatgagactgtttacattcacgtcgcggctctgtcacctactgtaggtagaatcttgccaagttgtataatctctctgttctgtcatctgtgaaatgtgagtgatgatagctcctagctcatagtgttcttctaagattaaatgagataatccagatgcctcatacatagtatacacttaataagtgttagttgctgttatcactaacttcctataaaagtaagacttcaacactgtggacatgatagacatgttttagcaaagtagagtgattaaaagttgggtgtggcc

SEQ ID NO: 132543 - DNA, 1079 bp, Homo sapiens
actgtccttgaaataccatctcattttattggccctcccttgatttcggtaaagcagagctattttttttaaagcatttatgaaagcttttattattgcacttcaaattatatgaatgttttaatgtcaacatagttcccgtatctgaatttataattagataatttgtaaagttcttgtttttagtggaaatgctgtcctctaagctctttttattttggtcacagtacaatcaagttttgagttcattaactaatgaacatgttatttaaataaactatttctgacttgggatgttctgatatatttctcagttaacaaattattgaaatttaagaacttctggaagaaacgtttctccttatagtctacaaattaatcacttctatatacaacaaagtttacaacctagctacaattggaccatgtttggaagagagatcctgaaatatcagggagattatacaattaaatatttccctagtgctaaattgaagcacaaattaaagatgggggtgaagtatgaatggagtctacagtgaggactccaacatctgaaaccaatagggatccatagatttaatattaattaatggaagagaaatattttacacttgcctgatctaaagcatagggaatggtaaaagcctgctcagtcttattctctgtgaatggaatttgtcccagtcatgttaacaatatccaaaatactgcctgttacaaatgagacagtttctataaaaatcctaatggttccagaaatatgagcatctggagctgtgtgagtgagcatggctttcaggcacagagctgcagtttcaggtatccccatgcccacccctccaccccagaatcagtaatcattgattgcatctaaatctgcagagagatcttttcctggcagttcaagtagttacagtagattgttaatctgcgaatgatcagactaaatcccttctgtcttcagaatttctatgcaaattagaattaactgtatgagataaatttattaactgtagtccgggagcttaggtcagctttagcactattcttaaacataggtttttattcataaaaag

SEQ ID NO: 132544 - DNA, 1034 bp, Homo sapiens
aagagggtaaagatttagaggaactcctttctttagggagcccttcacattgcatctgggaagggaaagatactgacttaggatgaggtgttatatttggcacaacttgggacaacttttgtgttacttctgtacatctttgcttcgtcaccaaagtgtgtgataatcatgcaaatcgattgttctttctaggattggaggtgcttttgaaacataccagaatttaagcttcatcttgtcttgcttcttgcttaatgaggaatagtttctttgtaaagtgcttaaaggtttataagtctttttgcatctcattataaatcctgtccttattaatgtcttctctatcatattatattagtaattgttttcatgaatgccacagagaaatgtaatcacattaccatctttcaaattgcattagtgaaaatgaataaaatatatatcaatggaatacaaaattgctgattcaacattaagatgaaatgagattattattacttagcatcatcagatatgagaagtgctttgcctccttctataaagttaggtgttctggtaaatatagactgagttaaaatgtgtgtttttctttttttaatggcgagctaaccccttattttcaattaggtgataggtctgttcatggaaggactatttactttctatttatgttattacagctgcctaagtagcctgtaaaatttgtaagtatacaggcaataaatggagtatcttaattgttaaatgttaggtaagaaaataaaatgtttttgcctaaattgaaatgccttttcatttcatgtttctttaatattactaattgcctaacaaaatcgcatgtattatcataggcctaatttaattgaaacacacacacacacacgcactccaaagcttgcgtatgctttgatgccatagaagcatgggtattttccttatataattggctatatcccgctgttgatttttactctgaacttctaaattatttaaatggggcctttcttatatcgattgatagtaggttgtgatag

SEQ ID NO: 132545 - DNA, 1050 bp, Homo sapiens
ggtaaaaacacaagcagggggtgaagggacaatggaaacatgtgacttcttaaggattggcctgaacccgttattagctaaattgtacaccgtaaaatgtcctttgtacctcataagacaaatgacttaattttttattcctcagttgaggtcattcagtcataagtggtaaaaattatcaacactgagctctttttctctttttactttctgcaaagtattatgatccgtttaaaccccaaattataatatgaagggaagtcatgcaagtaaaagacattaatttgctgaaaaatgcccatgacgggtgaagaactttaactggagtgaactcttgctactgataaaatatgagtatggtattacagctcataagaaacacttctaataccacagggtgtgaggagaacaataaatgggagtttctttgtctacacatgatcaagcagactcaaattgtatggctggaggattgagagactagtcttttaagtaattttggtgtcattaatgggcttgcatcacagtatctctgtaatgctcaatcctggtattgtgcagaactgctggtgtgagccgcattgaatattggcctgttatcaccaggtttttgagcttgtgaatattttacaactgcacaggccgaaccatattctttggaaaatgaatgccattgctgctgtgttgtgttctccttacataggaatatgctttgacatttgcttgcttctgcttcattctgacactggagttgttttacttttgtccccactcccatagcctgctattgagacaggtggtattttcaaagtctaagtaaaatattggcagattatgcctctaccctcagactctgtttttcaactgttcccttctaaagttctgcaccgttcatgcctcactacatacactccagcagttgctggactctgcagaattagaaccaggtctgtctctgacaattagctcaactggctgcaggataaataaaggaatgcgctcaggggctgtagtctgtgacacagtgtaacagagcgtaaaaaggtgcat

SEQ ID NO: 132546 - DNA, 1101 bp, Homo sapiens
aatgttgaagtgcaataagaacaggaggactctctgctttctttggaaactattaaccagtaaatgaaaatttagttgaaaactagtagttaataattgccattttctaacatgaaaggattttatccctcatgtgttttgttaaacattgtaaaagtgtcaaaattagctgaactctcatgtatttgtatttaatataatctgtttagatgatctggatatgaaatgtgataggaatgatggttgtagcttagagagaaagagagagagattgagaccctctctgaatatttggtttctggatttaatcaccaatgcacttattttattactcttggcttttgtagtctgaggactttgttttcttcttttgcttaattttcttaacctgaaatgtgacttggcaaaattaaggacagaggtgtatcaaattctttgctagtctctatttttttttttgtgaagaagagatttgtattactacgttttatttataatctttagaagagctataatagaaatgggttcatagatctgtaaaaatcaaaatcactcttaaaaaatccctcaagctgtctgtcactaatgggggaaaaaatgtaatccactttggagatttttttttttaatgagacagggtctcactctgttgcccaggctagaatgtagtggtgcgatcatagctcactgaagccttgaactcctgggcttacgcagtcctcctgcttcagccttccaagtagctaggatggtaggcatgcatcaccacacctggctaagtattaaaaaaaatttttgtagagatggaggtcttgctgtgttgccgaggctggtctgaaactcttgggctcaagcggtcttcctgcctcagcctctcaaagcactgggattacaggcatgagccagtgtgcctgacttgagatttttttttttcctgtgttttcacatgtgttgttgtaaggttcatttggttttgttgttattgttgttaataaggacataaaaaaatttgatatgagaattaacgaagaggcactaacataaagataatagaaaagaatatagtggtagcattcaacagtggtgtattgagattgcaat

SEQ ID NO: 132547 - DNA, 1128 bp, Homo sapiens
agataactaattatttgagacccaaattctggtctcccagaatttggtacctcatttttttttttttttttgagacagagtcttgctctttcacccaggctggagtgcattgtcgtgatcttggctcactgcaacctccacttcccaggttcaagcgattctcctgcctcagcctcccgagtagctgggattataggtacgcaccaccatgcccggctaacctcatacgttttaatcccaaattaatgccagctctatatagaaaagacaggtctgtgatcattattcatctgtgtagttttctttctactgtgataatcatagctcagtttagggagcacttactgttggcctggcaccatgacagcagttttacagggttactttcttaattaagtatactcatattctcgtttcacaaatgaggaaacaggcccaaagagaaagtaacttgtctacatttttagagcaagagtaagtggaggtgctggaattggaaccctgatagttagattccagaactgtgactcttgaactacttaactgtaccttctcctagaaggatttgattattgcttttcattccaaaacaaagttttgtgtagactatttaagccatagggactgtagactgtattttgaaagccaaaattaagaaaacaaaaaatgtggccccaaggcactcactgtttttcttccttgattcttgaatcttaagacagcatgggatattagtgatgacagtcttcctactgccaaatggacgcttggccactagttgtagatttgcttcaaagattttgtgtcctcagaagtgaaagaaaaattttagtgaggcacatgctgtgggaagggtggtttggtcagtggttttgtagtatggtttgtgttgttttctcagtgtggagaaaataaggaaagctatatagtaaggaagaatatgttaaaatatgtactctacctttcaaagaagagtccagggtgagtagcaatgctagtgccacctgaaagaactttggagatgtttcttaggtcagaatgaaaagctgttgcagtattgcctaaaatagaatttataaaacagaacgctattgagacttgttaatgtttacagatactgttttcttt

SEQ ID NO: 132548 - DNA, 1182 bp, Homo sapiens
tgtctccctgtgcctcttcctctactctttcaaatcttctttttctcttatccaagccaaggttcaaggaacattattaattgttatcttttttacctgcaagtcatagacaaggactagagaaattcttgtatgtgttaagagtttacctaagagactattatgacagcagtcaggaatgatttctttaaagtatgtaaatgtagcgtcttcattatggcttagatttacaatgctgacgactttgtgaagcagagaaagttgaagagttaggggctgctttacgaagtgtactttggaacagtttctagtttctttcaaactttgaattgaaagagaaaaagcaaagtaagtacctaaatcagcactagccaaaagaaaagaaagagaaagagaaaagaaacctgcacaaggcagcagctactctccattgggaagctcatcccctccttgacagttgctgggctggctgtgcaatgtttgatatgtgctacttatttactgtctttctgtttctctcttgatgctcttagactgacactgtgttaactgtcttatgccactgattacatctttcctttcatctttgttatgactagtttaaaggataaatggtgattttctataaacacaatacataagcttaaagaaaaagatgaacattttagagaatttgggattattcagaatccctatgactataaatgacttagcatatctagaatgcaccgagttgatttatttttttctattaatagtcatcatgattagatagtaccagctttaattttaagttttgttgcctgtgaagtttattttcaatgctcaataccatccaagagagaatcttgtttaaaaattttaatcaaaacatatttaaggtgcttggaacctaagggatcacttgattcaaccttgtcatttctctgttcatcttgcaataacttgagggggccacctaaggttattctagatatctagattcttttcctcttcttgccccttgactccattgataaattgagaatgaaaatatctctctggaatatcttttgatttggtatgtataggaaactttgatatcattgtagaaaggcagaatagaaataaaagatatttcaaagtcttttgatgtaggttaccatttgtaaatctgtgaatctctgctttgacttcctgaaa

SEQ ID NO: 132549 - DNA, 1042 bp, Homo sapiens
cttgaggaatatgagtgtacatgggaaatatcatctacaaccaggttgcatttaaataaaatcaaccatcattctcctctttgtcttccgacacccctttcccccacatgtaatacttttaacttgctctctcatgtctgctcatgggtgggcatggtctactaaactgacaaatgaaacagatctgtctgtgatacttcatatggggaaccttatgtaacttatgcgggggactcagctatggatgacatcccagtagaccctctatggattcccagctgttacaatatctcataccctttgtgaccttttcttctatttttgcatcccttttagaaatttaggatttttttaatttaaccccgaatttcttaaatgtgggtacaatttacacagaatgaaatagacccattttaagtgtacagtttatgagttgtgacaaaatgtgtatactcatattaaactatcgccccaaccaaagtacgtatcattttctttaccccataatgttcccttatgccttttccagttaatctcctttcccctaaggcaaccattattttgatttgtcacaatagattcattttacctgttcaagaactttatataaattggatcatacagtatgtactatgttgtgtctggctttttttgtttgtttttctcatattgttgtgtgtattagtagtttgtgtcttctttattaccaagtagtatttcactgtaaacaacagccatttaaaaaatgaatatttagacatattttatgagttgtttctatatagtggagacatcttaaaattgcagcaactcttgagtttaacaaatagttgactgtcatcagactttcacttttttactacttccctgcccaagggtgctggaattccccagctgtgggctgaatgcccatcccaaattctcaggcttctgggtattcttggttcacatcctgaacttcagaaggaatggtgacctccagttcactgagatggtttagaacatcttaaaacttttgctatcctcacttacgttgtgaaac

SEQ ID NO: 132550 - DNA, 1982 bp, Homo sapiens
tcaacttactcacatacagattgatccattgtcatctcctttgcatctcatggattgttgtgaattatttgctcaccctgggagagacgtgctctgaattataataatttaaaatctgtgaatctattaaaaccgtatttgtagctctaaaaaaattgatattcactgggcagtttgcccaacaagagaaagtcaaagagattacacacttaccctaggtaacagcaaccaccctgccaattcttcctttgaaagaatacagcagacccaaattatacatctgtggataaggggagacaagaaaagaactcaatatatcaaaatcagaaagtaaattccacaataatggctacaataatgtttcaagatggtattttagcataggcctagtcattgaactaatcatagcttagaggggtttaaaattgtttaaagtacatcctgacgttgttaagtatgtttaccactctcacttgaaatcagaatattcactcatgtatggtataccctgagatcatatcggagaatgacaatgactgcattgtttggtggaaaaagtgaggcccagagtgtcacaatggttttctgatttctcatctaaaggtcttttcataggatacttaattaacacatcgagctcccgcggtatgccaggggctggcagtgtaaagatgcataagaagaagctaggtgcagtggtttgtgactatagtctcagctgctcaggaggctgaggcaggaggatctcttccagactagcctgggcaacacagtgaggtctcccagtgaggtctccttcctttagaagaaaaacaaggtgcataaaaataagctggtctttccatgggagcttcgctaaatgtgatcttcccgaaggacaggtttagtcctgttcatctttcaggtctcagcacttaccattgcgtctggcacttagtaggaacgtacctaataattgcttgatgtgataaatgccaatctttgtgccatggaatcacagaggacaggaaaaccaaggaagaatttaaaaaggggatggagttttagttgagttcttgaatagtgttttggggtgcaaatagagtggagaataggtaagcccacctaaaagatgctctccttgagggcaagaataaagttgtgttgatctttgtatatccttgtatccagcatagtgccccatacatagtaggtcctcaaaacatatgctatatttttttctgtatataaacttgaactatacctttcttaactttcatattacaaatgtggtaaatgttttggtttcaaaacatttcttgtttgattatatctaaataatttatgctagaaagaaaatgctgtcaaaaggctatctcatttaatttaattatgtcaagaagaagttgaaagtattatttgctcagataatcctcactttctgataattggaaatcgactttcttggactgttaaggatgaccacctcaaattactacatttggcactaagtggagagtcccactgttaattttcaattaactacaatgttgattatcttgtcagtaacaatgctttagttgtttttaccacctaatctcagttgaggagatcatggaactaacaagagcttgattgtggattttattcttgtataggccggttaaatttgcaaaaggaaaaactccttgaataaacatagacagcactccaaattttggttagctgttaaataaatggatgctattattacaaaagaggacttggctaaagaaggtagatcatcacatctcattaccatttggataaacaaccaaaacatgtattctagtgacagtacttttataacatcggcgtgtgtgcgtgtgtgcgtgtgtgtgtgtgtgtgtgtgtgtgtgtatgtgtatctgagtgatgtgtgcttttctgaaattagtatttagctttttagtggaaataggaagcctacagtgttctttattggttttaaattttttcagagt

SEQ ID NO: 132551 - DNA, 1039 bp, Homo sapiens
aaactaaaaatagtacccagtgggattgaaacattatgcatgctttcagtacttatttgatagaagaatctgtttcagaaaccaacttctaacaaaagcagttgaattacacaattattatatgtttttaaattgtagttacatatttttattggagtcatggtccacaaattataaggttaactattatcatgtatcatgcagaggagatgaaaccacatcaaagtttcctaccgtccactctaagctgcagttcaagtttctaacacgtttttgcttcttataagtggatgagctgatcttcatttctttttccgtggtatctgatttctttctggttgtttctgtttaaagaaatatgtactgcttataggaatgataatttaagcagttagagaagaagtagttctctatttgtgcaggtagatggaaggaacaccttgccaatgcataacatagtatctcacatactttaattccctcaataagttattgtattttaaaggtaaaagaccaggacagagaaacaacagagggcctgattctactaagaatttataactgttataagatcctcaaccaattggaagttgctgtctagtgagatgtgcatctcatttgctattttgctccaattcacaatagccagtactgtttcaataaaggaaaaatttagtttactctgctagaactttctcttgatctgagggagttggatagttggattatttgaggttaacataccttagcacctttagggcaaaatgtaacctgggggtgtgatagaatattccatctagaggataaggagttttagattataaggaaaattactcccttagtgggctcttcaggaacaattttttatcttgtggttggtcactttcaatatatggcagttgctttccattatattctcaggctccaatcaatacgtacaatattatgcaacttatagttacattataaccaaaatatgtcaaatgtggtttctgagtggctgatttacagtaagtcttcctcagtccccaaagtgggt

SEQ ID NO: 132552 - DNA, 1585 bp, Homo sapiens
ctcccggctcaggagaacagcagccattcaactgagtgctttataagaaaagcaggacttaatgaaatatcttctgtcttcatgcgttggaagatatgtcttgtggtgtaataggagtatattagcaaagtacattttttttttttttggtgaaactgttggattgaaattcagttcgttttgtatggtcttgaggcattagaagtgatttggtgtattgcaaattaaaaatgtaaatgtgacattttggctaaaggcatgcctccatttctatgtacataataatatttaaggaatgtgtgtgccaatgcaaagatgcaggctgaagtttcaacatgggtagcactccctagcatgaggaaactcatacttttttttttaggacctccatttggccttattttctaaattttcaggcttataagatgagcatagtgagctcagttttaaaacgtttttactgatttagaaccacaaatgagaagagagaaccatttaaaaaatggacttctatgcagtgagaatgagggtagaagtggtggtaggaggaggtttcagtttttatggtaccgaagggtatgccatctctagcacacctgctcttggcccagggaagaccacctgagctctgctgtgccccaaactggtactgtctgggtggtgtatgtctgtgatacaacagaaaagcaggtgggacacatgagacacgatcatgtatttcctagttctagaaagctaacagcttgtgtgtgacatgcaaatgcagagtgatggaagactttttgtggagagtagtctgatccttgaccttttttgggtaggacgagtgatgttcttcaaacacatcacctggaatggtctgtcatgggtgattgttggaaatctgtttttaaaccttgaattacagtgaaaagaaaattgggttttgcagatgtgagtgtgtaaaataaaactggaaaaaaaaacctattgagtacattgacatactatgggagaaaatgtagaaaatgttatatttacaggttaaagtaacattctggttgtagatgaaccagattgtggggttgatagttcagaaaggaccttgcaaagaagactaagttcctggacaaagtaatgaaagtgacattattggatattcctcattgtggatcatcattttggtggactgcgtggaaggattgaatctgttaaaagatgatcagctatggagagttagtcaagtagctgggacccacttgaagcatttcttcctctcttctttttcttctgccttcctaaatgtgcttcttctgcacattttagaaatacctagtacatatacatattatgtccaccataataaagatgcttaatatacttttcaccagctatctatttcaggagtattttttagcttagactgctttcattcttgccatgtcatgtgtcctagtcctttttaaattttttcctagagaatgagccatttcttattgttcagcatagctttatactctagggagctcactataggacttgccagtcatctccttttcctgcttgtatcataggctttgccccagggctaggcattatcatcact

SEQ ID NO: 132553 - DNA, 1051 bp, Homo sapiens
tgagaggaaaatgagggttaatctacacgtaagattccccacatagtgactcgcgcattggcctgcacgtgtgaaactcttgggtaaagagtggttgtaaacttcaaagacagatgacactctgtccatttcaccttatgagcctagtaaagaagaataaaagacttgaaaagaatgagagaactggacctaaaaatgtttgaagcgttgaccgagtaccttttatttttcttttctttccagtgatattcactagtgaacttgcaaagtggagtatactgaacgttgtttaagtttggacgattgtactgatttttgggtgaaaagaaagagggaagcaccttttaagctagcatgcatggctgaaaactgatgtctgaacaaagcaaattgattagcacagatgatcttaattggagttttaaaaaagtcaaagaaaacaaaacagaggagtgctttgatagggaaagaagacaaaggtgagatgatgcttagttgatgtattgagtttagagacatatagacagatatatgattagtgtgagtagtataagtatggaaataatgaggaacaattagaaatttttaaaaagcagaaaacatgtttaggtggaatctaaaaccttgtttaatcttaaaaaaatctgaaatgaaataagcaagggacagtaggcagtatttagggatgatattgactaattataatagcttagttttaaaaagggatcttagtggctttcagtttagaattttagatatagagaaacattcattaagttttaaccttgtttttttattattaggacagatacataaaacaaggtttttaagcttaaagataacatgtttaaatgagtaactattaataataaatattgataaatagaagtctgcctgtgctagcctacaccaggaacaggaaaaataaatttgaacaaatattttaagaacgtaaaggaacttaggcattgttgaatgtatttttttttaaattcctacataagaaaattaaaggaaagaggaaaagaaaaaatttatgtcaccaatgtga

SEQ ID NO: 132554 - DNA, 1099 bp, Homo sapiens
tatcatttctgtgacttttctcttttttcctttgtcccctttctgccacccatttttcacagccattcatcttcaaatattttcaacggtagctcccatttacaacctggagctttttatgtcttcttttcagaagtctggtccctaacattttttttttttttttttttttttgtgatctcagtaaacaaagagtgtgtgtatgtgtgtgtgtgtgtggttatgtgtgtaggaagcctgccatatttcctccctgccccacagaaaatatgttttctggaagcccttttgacaccgaagtgaatgcccactggccctcccttgttgaattctcctgaggggagagagagaggcctttatacttgtcatatcttttgtttctgctgattatacacaaagtaagttgtaaatagctctctcacacaccatgattccttcaaggtatgtatatacaggagagtagatatgtactcagcctccacttgccctggggatttcagagggtccctttcaaggcctctgacctcctgttacagtactaagataatgaaatttacatcagttgtaggcagttattccataattaaacctgtggcataatgtttagaaatattagctgaacagttcaccatttttttttgtttttaagttaaatgattttattacttttaaagcaacatatacaatcatacaaaaagaataaaagttaagtacctataatcttaatcactgtgaacattttggaaaatctttgtagaactttgtactatatagtatgtcaagtatgtcattaaaacaggcactaggtgttagcacagaggaaaagtggataaaacggaattccccaaatcagtttaaaatttatattaaataatggttaggcacaccccatattttattatcctaatttacaatagactaataataaggggttagacaattgatatctgatttttcttcaatcattttttgattgcttgtggctggctaacttctgaggcttctaaatcaaaaggtggaatgagatgtgctaaattacaactaattaggttatcagcttttatctcttttgtatcttccttagtacattttgatgaat

SEQ ID NO: 132555 - DNA, 1127 bp, Homo sapiens
gtcttactgtgttgcccaggctggagtgcagtggtgagatctcggctcactgcaacctctgcctcccaggttcaagcgattctcctgcctcagcctcccaagtagctgggattacaggtgcccgccaccatgcccagctaatttttgtatttttagtagagacggagtttctccatgtcggccaggctagtgtcgaattcctgacctcaggtaatccacccaccttggccccccaaagtgctggaattacaggcatgagccacgacgcccagcacccagtgaagtctttaacactaagtccctctgagctgacagcgatcttttcggtcattccaaacacagcatcactctaggaagccttctaaaagatgattgagttggcccttggtccctaagtgagaccaagtgactctgtctctttttagtttccccagttgcttataatattcctttgacccttgtggcttgctttcctttcccctatgcggcttccatcgtggtctcaaagttctcagccttcattggattggtatgctgtggtgctgcttttgtgggctgggggcagagtaccatttacagatatactgtgtacctactgaatccttaggtgctttacatgtgtcatctcattcaaccttgccaaccctgcacaataaatataagtatcctcattttacaggtgcaggaaacaaggctcggagatacgtaactgagcaactttacaagatattgcggtagagatttaaacagagatctaattgcaaagctagaactctttcagtattacctgtctttaagatagctggagttgagtgttgaggatagaaagtaagttaacctgggtgtggcatacttgaaattgcatttaatgtcagttgtcagagttgacaatgtatttgcccataagcaacaacctgtggtgttcaatttccaaaataatgtattacaagaatgattgcaaaccaatagaataatagaattctgtacctttttttcttaaatataagaacccgccgggtgcagtggctcacgcctgtaatcccagcactttgggaggccaaggtgggcagatcactttaggtcaggagttcaagaccagcctggccagcatggagaaaccccatctc

SEQ ID NO: 132556 - DNA, 1160 bp, Homo sapiens
atctgctatgtgtaaagcagtatggcaagtgctattgggaaatacaaagagaaataagttagttcttgatcctaaggagagaaaaacatgtttttaaggttcaaggtcatgtggtgcttagagccctaaggaacatagagcacttgggacgatgagatccctttcatccaaaggtatcaggaaatttcatggaagaagtggcatcaggaaatagggacattttcaaagggagaatacaggcgagggtattccaaaaagagcagcatgagaactatttcaggttaggaaagtccaaatcagtatgcaagagacataaaatattctaattagagtgtctatcaagcatttttcatgaagaaggaggagaagataaagctggaaaggcaggttagagctagattgtagagggcctggaaagaactgtaattggtaattggtggggagctataaacatgatctaggagaatgtgttcgacaattggaggggtggtgtatagcactagttggcaagtatggaatgataaagtcaggattattgctaaagggttattgcagaggtctgagcatgtacttgttagaattattctggaaagtgtgtgggggacagctgaggggattgaaagggcagaatggacaggctatcagaactgactgggttcaggaaataaggagaagccttttaataatgatgtatggttctgagtctttgttaatgggcttatggtaataacattgaaaaatatagaaaaatccagggaaagctgtagtaaagaaaggagaccagtgaacctatttgcttgtttagctcgagatgttaactggacacttagaaaaatctagtgagagtttgaaaatgcaggactgaaattcacatgagaggtaaggattagggatttgggagccctgttcacacagaggtacgtgacagatgagacttgagaagagcttcacgtcacttaacgagaatgcgtgtaagagagaaaatgcggccacatgatgtggctcatgcctgtaatcccagtactttgggaggccgcagcaggaggatcacttgaggccaggagttcaagaccagcctgggtaacttagcaagacccccatttttatcaaaaaaaaaaaaaaaaaagaaagaaaaagaaaaaaatttagctaaaaagaat

SEQ ID NO: 132557 - DNA, 1412 bp, Homo sapiens
ttaaagtttgggtgctgtatatcacattatagcatatctattaaagacatatacatatcatacaggcatatatgtgtaaacataaggatggagaagataaagtggatcaacttaactgggaaaataatgtcaaaatcactattttaaataaattgcttgtaaaacaaattaactgccatgataattctgtaatatctttataaaccagaaattacaggttttctcaccagataaatttacattgggaatttatgtagctctttattagaaatatgtctctttcatgaatatagtgagaagagtccagactttttagctagatttacctgcatttgaactgatctctttcctatgtgactttgtaaaagttatataacctctttgaatcttagttgcttcatttataaaatggggcttagaagtaaatgatgcctgtgaattctggcacagagagggttagttagaccaatttcttcttctgtctgttactattgtagattgctagtcttatgcagtttgcacttggtatctgtttatcaacagtgccacagtgttctttatacttgcatcatgtacatacttggccttttcaattactagtttaaaaaatacttgtgtcactcttgcagaagtcttacttttgcagaagaaaatgagggtggagagaaatctcttctttcttactcttcactgagaatcagtcactgagcagcataattctaaaatcttatgtggcttttgggtactttatgaacctttttatggtaacccagaagcaaggcactgattgaattaatacatttccatcaagggactattctgttggcctgtcttcctcctcctaacccatgcatgcttctataagggacttttttgttgcattatttaggttgccacatatagtggggatgacagtttgtagatgtgcaggttactggtaagccttatagcctttctgtttttaaaacaaagggaaaggacaaaacaaaaacaaaaacaaaaacagaacagcaacaacaaaatcactacccaaaccaaaagtaacttaaaaataccatcttagctttctggaaaacccagtgctttataaaatgtagaatctaaagtttgcatactgatattaatttttaatagttttaaaacttttaaatacaacttctgtacaaaaggatatgtgttcatagggcagatctgattaagaaaacctcaaagagagaaaactgcctgaagggctatcaccaaggaactgttaatgtatttttagtcgtctttcttcatttacaagtacctaccaatgtatgaataggtggtagtttcataaagggatgatgttacatgtatatgtgacttttaaaaaatgcattgttatcctaagtatctttccatgtccgtaaatataggtattcatcatg

SEQ ID NO: 132558 - DNA, 1056 bp, Homo sapiens
tttttggcgggggggcggagtcttgctctgttgcccaggctggagtgcagtggcgcgatctcagctcactgcaagctccgcctcccggattcacaccattctcctgcctcagcctcccgattagctgggactacaggcgcccaccatcacgcccggctaattttttgtatttttagtagagacggggtttcaccgtgttagccaggatggtctcgatctcctgacctcgtgatccgcccgtctcggcctcccaaagtgctgggattacaggcgtgagcctccgcgcccagccttcttgctgtattttatatagattaaactgacaatttgatttcagcatttgcaatttgaaatggaagtgtttcacataggttttggtaacctttgcttctgagttggattgattctcccctccccccagtcaagtataattccttttttttaaaaattaattgctgtcctctcatgaattagcatggcttggctaaggtgaagggattagaatgacttttcaaggcatgataatgtctgtttaaaggaaagaaaaagaaaaaagtcttttaactagggcttaagactaattccagctactaaggagacaaaaattactctaaagaagacaatttggttttattttatatgtgcatgttaacctgctttgagatcatcattttgtattttagggtattctcttagatgaagtaagatgttcttcatttgttactgaaaggggacatggcctcactccaggagattaaagctggaacaccttctgccttctgtagggataatcacagctcacctggctgtagctcaaggtcagggcaaaaagaggggactttgtgctttttagaattgcctatgactacagtagagaagaggaataataaaacaattggacaagattgaaagtgaatgtgcatcatatgaagatagttaataagatgaatgatcagaaaaagacaatctggaagacatccttcagtggtaggagaatcagtggtagaagaagaaaggggtattttggggtgcaaaactatgacctctgttaacttg

SEQ ID NO: 132559 - DNA, 1050 bp, Homo sapiens
aatgcttaaactttgaaaatttaagtctgatcatactttaattttggcaacaaaacttactaacgtagtctttccctgtctctcccacaggttagaaactgtgcaatcattatattaaaagttaactaaattttattaaggaataattaggaaacaattccaagaatttgatgtttaataaaataggtttttcttgagaaagaaatagtccctctaatgaggctcctgaatgctgggctggcatctgagttctttaacatctctcctccatgtctcaaaactaaccaaacaaaattcgcttaactctctcttcccttcctattttgataagctctgtggaactgtggtggcattgcaagtgtactgtttaattaaaatccagttgtcagcaggctctcttccactgggtgtgctgagagacttaagtaagtttccataaagtaaattctgacgatggcagcgtgggttgctgattcaagttattccttctcttctgtgtcacttttgacggatggtacctaatgcaatcaaccacaggccgagaaagccttttctttggttgctttagtaactggaccaggagttcccctccccacttcatctccccttcagtggcttgctcactccttgctgccacccccaccaacacttcagcccaaataggaaagcggaaagaacagcagaactacctaggactggctgacaggctttccctaaacctccatttcccagcggtgaagccgaagctgcctccctttgcgtgcgtttttgataaatttaagaagtcaaatcgctgacacagatagataatccaagtgtatagggtgaagcgttataaattaacacattattccctcttaatgtgaaatacttgagaatgcattttctgagtcccctgacatctacccagtgagggctcacattgtgcttttctagtggcattgatttgttaaagcgctgaatcagcatctcaggccagctgcctgatccactgttttgttgtggggctccagctcctcctctctgccagcaatcccttttttccttcgg

SEQ ID NO: 132560 - DNA, 1406 bp, Homo sapiens
gactgtgtggatattttgtgtgtacctgtgtgtgcatatatgtgtaatggtgagcatcagtgattatatggagagaatagaaatatagggaactaatttatgcttaatggatgctattaaaactgtataatattatgctatttatgaaatagagtagtacaacaaaaggagagaaatcacagttttaaatatgttttcttttttttttggttttgatgtagttagcaatcactcctatccccccaacccacctttttctgtcatggtcactgaatgtttacctcttgtgcatttttggaaagcatgtaaaagaggatatgagcttgcattttttttctcttcaagatgacattttagtttgtataaatattacataacttaagttcaaactatgtgagtgaaagtatgtgtgctgttcatatttaatatgtttgtttttcttacctgtagttcatcagcaatgctgattcagcacgtgtgtgtgtgtgtgtgtgtgtgtgtgtgtgtgagagagagagacttattgaaattatatctctgatatctcttgaagccagccatttaaacgagtattactttcaatatatacagttacgctagtttttgttacaggtaaaagtttgtccagtttaatcaaatatgtagaattctgtacatctcattgctgaggcataaagaggtttctctagattatgattattttatttctaagtaaaatttacttagcttatgaaatgaataaaatttattgggttattttttttaaagttttctttaatagtataaaaactaatattttcctgattatttatttagacgtttgaaaactctgactagtagggctgctataaaaggtttcaaaactgagttacagataatttaccatcagtatttaactatagagaaaattgtgggaaatgtccatgaatactgaaatttaataatctagttttatgtgttctattagtaaactaggaagtagggatacaaaaatctttgtcttttgtttcatatgagcaaagttggatctgcttaaatgtacatctttcattctgtctaatagtaacaaataatcacaatctgaagccaatttagatttagtgggatgaagtatgtgcccctaaagttcaagtgaagtctatttgactacattttcctgtgcctgtacattttttcttctatactcaagtatgattttctcaaattatttctatgtatatagctgagtatttgagaacattaaagggtatgacacttgtgtaaagggagttcttctttggatcagtttgatcagtgacaggtggagaaagaaccttattttgcctattttagtttcacaaggtactgttaaaagcaaaaaatgaggcttgcttttcaaagttttttttttaatcacacttgaggag

SEQ ID NO: 132561 - DNA, 1049 bp, Homo sapiens
ccctgtgcaccgtgattgtggtgctgcctggagtgtgcataagtgtgtatctatctgtatatctggagaggggttagtgcagggtgtcatttggtgcctgacagtggaacagtgcagttgactcttagctctgctatccaatgacatgcagtggctgagagtttgaagctgatggttgggtctccagtgccgcctgcacacctgacaggcagctgttaaactgagcaaaggcaagcttggggagtcacaatctatgcataaatgatagggatatctgtgcagaaggtgcgaaagaagctctgaccccctccctcccccaaatctcccccttcccaaatgaaatgcacagttcagccagcttcttaactacactacactcctgctactggctgccaagaggctcaaaaaatccaccttcacttttcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggtaagttactttctttcttgattttttttttcttttttttaagaaaccttgaattgttatgggcacttttgtttctggtgtttttctttctaaatactttttaaaatgtggtcacttcctagttaggctcttgttttgtcataactgtgttactggaatgtgcagggttacttcatggtttccctaagggcgtcttaaaagaaaaaggggaaaggataccgaagtaaaagaaagcagagacattgttgaaaagtttcacagtacaatctgggtcaggggaagacttaatttatttctttgttttctgttgagaatgaaaaaagccacctcccaacaaatgtatctatcaatatgaatcacttcgtccaaagtgtttgctctctcggagtaggttccgcaacctaaaaaacagtcatcaaat

SEQ ID NO: 132562 - DNA, 1151 bp, Homo sapiens
aatggagaaaatcattttccaagccctcaatagcagatggtgccatttactgaggtaggcagcgctggaggaggagcagatttgaggagtaataagacagacacttgggaagatgtcaagtttgaagtttctattagacactgccccggaaatgacaggagtgcattcatagtggagaagggagatctaggctaaatatagacatttactagccgtcaacaggtagtactgaaccctgggaatgtactgggtagcttagggacatggaacggtgggatggggaagaaaggatgggggggtcatctcttttgtcatataattgcatagttagcatagtgatattaccctaatggttaagcgcagcagtggtcgacactttcatcttttgactacttttcctggataatgtagctaaaagtttacatcacctactcttgtaatctagactcctgcccttttctgttaatagggtatgttctgaggtggtgtccccccacagcctcctttccttttgttcactgattatgcattctcttcagtcccctgggtctcctgtggactgttttcctgcacccagtgtgcttctgcctccctccatttgaggccatgtgtcttctcatgctctcttgctctctctttttgaactgttgcttatttggaaatattttcagttatttccacacataacttctagatgtttatacctttttacagagtcaggtatcctttttctggtgtatttatttggtctggaatgtgtcaggttttgaggccacagcacagatgctttgctctcccataagtgtgggcaatatgtggagaatggctttgtgtggattggaagtggaggtgaagggggaagtatcttgttgggaagaaatagctgactgtggccctcaagtgcttcttgggtggatgcatttaataatgatcttagtgaatcagttgctgcatattgaaaacaagatggctggggccgggcgcggtggctcacacctctaatcccagcactttgggaggctgaggcaggcagatcacctgaggtgaggagttcgagagcagcctggccaagatggtgaaaccccatctctactgaaattacaaatattagctgggcatggtggtgggtggctataatcccagctactcag

SEQ ID NO: 132563 - DNA, 1781 bp, Homo sapiens
aggcatcattcatgactgattatagcccatggaaaaaaacctgttacttttaccaaaagagtttggggttggttttaaaatttagctttggaggggaccaggtggtgattctgtgactctgtgcatttcattacctaacatatttcagcttttctaaagtcaaattatttctgcttttctaaagtcaaatatttctatttaaaaggcactagttttgactaaaatgttaataataacagatttaataatattgagtaatattgtttccatctgtttagaaaccaaaatttagcttttatcccttcatttcaggggtggatttttgcttctccaaaatagatcttaaatcttatgtgtatattttaagcaaattattattgcattttaggagtcttagccagaataaaatctgattacattttcaattcataaaattacattgtgaccccagaaaacatcctctaattgctttagtttttacctaataagactgtctctttgtgtatgtttaccatattagagacaaaaatccctcaaatgggtctagaatactaaatatttgtgtacgatagagtgtggatagtacaaacgtccgtccttagctgcttcatcccttgtctgactctaaagagttgttacttcttcctaaaccaagagccaagatggaagatataaccttccaaaaaatcagagtatatgccacagcgggtttcgtatccttacagaagatgttctctctctccttcttttttcttccttcccttcttccccatccctcctccctccttccctccttctttccctccctctcatttatttttgggataattttgagttctttcattgaccataagcttattgtgaagaacaaattcagtttatcaaatttagctaccaaatcttaaaatttgatttttaaagtagaaagataattgcttcttattaaaaaaaaaacagacaaataagtaaagttatgtcaatttgtataattccacattaatgagctagtacatgggttaaaatgttatattagtagtttcaagaaaggaaatgtgagctataattattatatgttttctatttttgttacatttaaggtgagtcttgtaaaagggccaatgaaattgccttaagtaaaatgattattaaccaatacaatttatggcatattgacttgggtaatattaatttgggtacatgacaggatatatactcatggtctcttgtcacagatttttaggttgggttacttaccagatgaatgagtttgtgtttccacttaatttttttaaagttcaggaggccaacaatttgacagatttgaaaataaaaatgaaattgaggtcactttttttctagtggctactttggtatgccgtgcatagactctgtttcttaatgcagaaaatacaatctttatgcctgtttggagtttcaaatgtaatataaatgtcatgtatcatcataagtatgcaaacatgttttaaaacacagaattgtatggaagcaattactggcagtgagtgagctacacaccccaagggtgggttggggccaaaaaaattaaagttcctaaacagaattacttttgtgtgggtgggaaagagagagcaatgttaacttttattaggaaccaatcccagctcttattttaattctcgtcacatacttggtaactcaaataaataggtagtaaagggacattaagggactttgtgttaggattagttttccccccacttgctatagtcttccggtagggagtgattagtgttcagcag

SEQ ID NO: 132564 - DNA, 1086 bp, Homo sapiens
tgtcaaaaccctttgtccagtctcttcttaatggtgactttaaaaattgttaggctctgtatttacacttgttaagtccctctttcctctctttggttcatctttactccataaaactgggtaggggagttgtttttttgtgtggggagggcaacctccagccagctttttgtgagagcccactctaaagcccctacactagactcttcaggaaaagcaaagtaaccttcccaaaccatttaattcatttcacttatttctggccatttgatgattccaaactccaacaggacctgtagcccagaggtaaaagtagaagatgtttaaaagatttgagaaatgaactaatttttgtggtctggagaagtaaagaccaaggtatgagttaatcactgttttcaaacacatgaaattattttgcatggaaggtagtaccagctgttagccatttgagtgaaaataaacaaaaggacttagattgcagctggagggattttagttagatagaaatttttcattaagtggttctgggtgggaactgggttcccatcccagtagattgttgatttaggtccagattggagggcagtggggcagatttgaggaatttaagcatcctgaaaatcagtcctcatgattaaaaaatcagcagctgcgaatgctcttcgtgttcagagctgcagaatgaggattcccctcatccctcccaccttcccccaagttgaaagaaattaacctcaattaaaggaaacagtgatggatggttgcagagataagtatgatatatcacacaggaaaaactacattaaaagcacattaaagttgagacagaaagcactaaaagtgaagaaattcacagttaaggttgaaaagtgatatcgtttacatctctgctaatatggagacctaacagggtacacttaagaaattatgagtgccgggcgcggtggctcacgcctgtaatcccagcactttgggaggccaaggcgggcggatcacgaggtcaggagatcgagaacatcctggctaacacggtgaaatcccgtctctactaaaaatacaaaaaaattagccaggcgtggtggc

SEQ ID NO: 132565 - DNA, 1030 bp, Homo sapiens
agctattgctcttgaagagtaagggctgtcactgaatgaaactgataccctggttacctcacacatttgaccagggactgtagtgtttctgaaaaatcatttttagttttaattctagcacacatacaacatgaagaaatcatgggagtttttttttttttaataacgaaatcagtgtttaaggaaacagtggtatggactccttcactgtggagccagcagctacttctgtatattgctcttcttatcccaaattagagtttataggggacattcttcatttacttataaataaaatataaatctcaaaagatgccatgaatctcaaaaagcgattaaacttgagcatgcatcagtatcacttgcttgtcttgtgtaatcacagattgctgggcccctacccccaggtcttttgattctgtagtggtcagggtctgataatttgcattcctggcaagttcctggatgatgctgttgctgctacttgtgagacactactttgaaaacaactgttctaaaggaacctagaaataatgtttgcattatctgtattccttgtaattacatgtattttttctctttactgttgtacatgacagatataactgagcatattttagtaaaagcaaaaacaaataaaaaacgcttcattggcaaaatacaagagggtcactggataacagatatacagtcttttgtgggataggccagcagataaggcatccagaggcttaaagcactcagggtcctgggttgttcagcccaaaacaggtttccttaaatattttgtagccttagtttttttgtagaaaaatggcgactgctaccagatctctctggaccctttaactcctaaatctgtagtcagatattcagtatgtttaaacaggcttacaatactgcaaatatcttgattaagaaatgcttgtatgtttttagtaaatgttcagagtaatttaataaaagccttatttgtaagttttatcacaatggagatttaaaagttggatgaggaaataaacattgaaat

SEQ ID NO: 132566 - DNA, 1029 bp, Homo sapiens
ctttgattttacagtcatgcgtgattctgacatgctttttacatcctaacagttctttttttttttttttttgagatggagtcttgccctgtcgccaaggctggaatgcagtggtgcaatctccgctcactgcaagctccgcctcccgggttcacgtcattctcttgcctcagcctcccgagtagctgggactacaggcacccgccaccatgcctggttaatttttttgtatttttagtggagacggggtttcactgtgtaagccaggatggtctcgatctcctgacctcgtgatctgcctgcctcggcctcctaaagtgctgggattacaggcgtgagccaccgtgtccagcccctaacagttcttatgaaataatttccctgaggtttgatgataaattcaattcaaatttgctcctcatgtttttcacaggtcttttgaatattacaactcatgtggcagaatgtccctgttctcctttttgctcttcatctggtactagttttctaatgtgttcatacccccacatccatttaccttggctaagactcttcttgcctttgtctgccccaaaccactgtcctatcgtttatttatttatttatttacttttattttttaatttattaattaattattttttttgagacaggagtctcactctgtcgcccaggctggagtgtagtggcgccatctcggctcactgcaacctccgcctcctaggttcaagtgattctcttgcctcaacctactgagtagctgggattacaggcgtgtgccaccatgcccagctaatttttgtttttttagtagagatggggttttgccatgttgaccaggctggtctcgaactcctgacctcaggtgatccgcccaccttggactcccaaagtgctgggattacagatgtgagccaccacgcctggctgccactgtcctatcttttaaagaatgattccttcatattcgtttctttcaattgacccttattattaacttcattaatttgtttccttcgtgttgcccat

SEQ ID NO: 132567 - DNA, 2001 bp, Homo sapiens
taaaaacttgaatgatcgtcatcttatttcttcttccactcttgtcatttaccaagtcctggaagtagattgttttagtttgcattgccttctggaacagtcctctccttaaaagaaaaagtctcattattattgctccgcagttggagggcaggggagtggtttatactgtgagttcacatcactcttttaactccttttcattcccactgacctactataggcttgttgcagtacctgcccactttaactttagactttctctaggatactctagtgattgagattggaggcttttaaaaacacctctgactttgccagtgctcagccccaaaacttcatttattgcagactctctgtattcagagtaagcccttacctctgtgctcagtatccctccttgagtgtaggcttgcttacctttctacctccatctctttctgacactcttttgatattgtgtcctatccatattgtttcccaggaatacctcttattttgcagtctttttcttaaggcacttattactttgtcccttgtgggacaattatttgtacatttgtatagcgctccaaactagatttagaaattcttgaaaatactttatttacttttagtagtggtagtatagtagtagtagtggtaaatagttaaaaaagtagcaccagactactgcaaagaccttagggcaacatcccctgaatactctgaaccctaattatctgtttgcacagctgtcttccctgctacattgtgagcaactccagggctgggactgtgctcccagaatctccagtgctacagcagtgtggcaggaaagtctttttgactaagaagatagtcatgtttgtttcttattcatgtgatgctttcctccattccttgaataggaattttttttcttgttttaagcagaaattttgcctttttcccaaattcactggaaaaatcggatgctattccactgttaattgaggtgtcactaattactttgcttgaaatttcaattattctaaaatcttccaacattttcatatatgtatcgatattttaaaaatataaaagaattttaaaacttacatttggaaaatttaccaatacagttttggctaattgggttgtcagttagccaaaggttagggatgattgatctagtttaaatatagctttgcgatttcattgaaattacttaagaaaaaatatttctagacagcatggaagaaaggtgaatataatagtggtttaaatgaagtagaggtttaatttgtgaattaatttttgagattgttatagagatactgtgatcaagtgctaagtcaataatgtaaagcagtgcatatcatttgaagctgttcccaaatatatcttaaagctaaatcaatattaaaactgtcctaaatagtaaaattgtttaatcattagacaacctgagctttatgtaaatttgtagactcttgaaacttgtcgtatgcagaagcgtaagcgtagctataacataagcataaaccattgtgatttgcataatttatctcttcagcataaatattgtacttgtagagtaacatttttgtcctggaaatcagattttggttgtctgagtatttgtgggactggaggaggttttaggtttatgtttgtgtttagattaaatttgaatggtgagttaagatttatggtgagcagtgtgcagaatgttttatttactttttcaaagcttatgaataaaagcaacatctgaatctgatctttgggaaccaagttcaggaaatgtggtataatctattttaattgtctcccttaatttcaacttacttctgtttatttgcaaattgtgtatttaagacattaacatatttaataccctgttattggatatatttaactttctactagcttcatgctttcagagttttgaactctgaaaacacaagcagcattaagacctgtcttttgcttaaagtactgagtgattacactccgatgttttcattatatgaaaca

SEQ ID NO: 132568 - DNA, 1372 bp, Homo sapiens
tcttgcaaagtaaactttatttcttagttggttccccccgctggtatttatgcttctactcactagaattgaaggaattgaatgtatttgaactattcttttggccccttctgcagactgggaatggtctttctagcttctcagatctctgcatattgtgcatccttgttcttttgccagaaacctgaaaatttcccagcagaactaactggcaatgatctttgaattatatgaatcaggtttgcctggcttctaggagtcaatattatacccttctcaatgactgtatccttctttctgaggaaagcagataagttagtgatgaagttttgaagaacttcacttacggagttacacttcctgagttcaaatcctgacttcactgcttacaggttgcatgcttttggacaagttatttgacttctttatgctttggtattctgaatgggggttataatgcaactgatcacgtaggttgtcatgaggattgtaagtgaaaatttgtaaaatgttcttaaaatagttcctggtgcatactgagtgtatagttggtatgatggtatctagttgattttttttttttttttggagggtcaaggtcttgttctatcacccaggctggagtacagtggcatgatcttggctccttgcaacttccgtctcctgggctaaagggatccctccaccttcacctcccaagtagttgggaccacaggcacgagcaaccacacctggctaatttttgtattttgatagagatggagttttgccatgctgcccaggctggtctctaacttctgggcttaagtgatccacctgccttggcttcccaaagtgatggggttacaggtgtgagccgccgtgcctggcctctagttgaatttttaaaagtactttttaatctattttctcttttggtcctcacgccaccctgtgaagaggtagtagtattacttattttatagggcaagtcatagaaacacagtgtcagtatgtgactttgttactagtaacagtgttcgaattataatctagatttctcctctcatctgttatagttgactgtgaatggggtctttaggaagttgctgtgattctgtgatgttatcagtcagaaggtgtaatgggaagggcatcaatctctgtttcttaaatttggcccagtggtgagccagttcattctaaaataatttgtatttgctaaatgcagatatttctcactttgcatgattttaatatacacaattttcagttgccatggttaactaaataatactagtccctcaacacagtccaagtttcagttatcatgttacattaactataattgtggccgggcgcggtggctcatgcctgtaatcctagcactttg

SEQ ID NO: 132569 - DNA, 1351 bp, Homo sapiens
gtggacttgaactcaagttttctgagttcaacttgcttgttactttttggggataatagtagtagctaccttatgggatttagagaaggttaagtaaaaaaaaatctatattaagctttaggaatagtgacagacactgagaaagatatagtaaatgaaagctgccattattgtcatcatcatcatttttacttttatcattcctgttgcactttattactaccaacaccatattttgtgaggtagtcaggtagctaccttaacaaaagctacctcttgttttgtgccatatcgtagaagccccacttttgctaacagactgaagcaagtgttcaacttgcgacaatttaaggaaaatttgacagtatttgaccttgtacagagacccacaaaaggcattagttgaagataaataaatggtagttagcaatcctaatttgaatttttgtacacttgtgtgtgtgtttatagataatgtttcccatttataaagatttgtcaaatacgattctactcaagtacattctcttgaaacagcaggaattctatggaataaggatttctttctttctttcttttctcttcttttctttctttttttttctctttcctttcctttccctttcccttccctttccctttcccttcccttcccttcctttccttttctttcttttttttttgagacggagtctcactctgtcacccaggctggagtgcattgacgtgatctcggcttactgcaagctccgcctcctgggttcacaccattctcctgcctttcatgatttcttattaagcagtctcctatacttccttgcttcctgagacttcttcattaaatatgtactatttcaaatgttttaaatttcctagtcctgtcagcacagggctttaagttagaagacatcagttatgaaatctatcagggtgtagttatttaaaggactagacttttgtgaaatttttaattatatgggattatacttatgctatattaattgaaaagaaatggatgtaaaactatataaagtacttacgaaagaagccaagttaattgtgccttggttagatagtgaatggttaatgccattttgtgtcatactggctttgtctctgttttatgtacctgctgtctcactaacagtgttgcttagtagaaggagtgtgggctttgaagtgagatgggtttggggcttcactccattgtcttcatttaagagctttgagactgcgtaaattgtctctctgagccttagttctggttagacttggatgctctctcctttgcaaggtttctttatcctgaaagtggcttgctcttggaggtgcttagtaaatgttagctctt

SEQ ID NO: 132570 - DNA, 1014 bp, Homo sapiens
caagtgtcccaagcagtgcctggcacacactgaaaactcagtaaatgcttattgagtgactaaaagtctccagtatgagcaaaagctgtaaatcctggatctacttctgttgctggcctagttctttctgatttgtttaaggcacgttaaaccatactctggcaagggagaggaatgaaggagtatttgagaaacaccttcagtgtgccagatgctttcatcaatactgctcagtttatctccacatcagccttgtgggtttatgcctcttcaccttttttattttttgaatgaagaaatgggaactcagtttaaacagattgtccaagatgtttgaatttgaattgggatctttctgactctagacccttatattttccagacatccatagcagtataagaaatgattaattgctgttactatttttaattgccatcatgatcatcatcattatcacctttagattttacaaagttgtcctcaaatggcagcctgttgcctctaaaaagggtgggacattactttgcgaggagaggagaacattaatggttcaggcagcagtgtttctagatcctcttattccttacagcacaaatctacaccagtctcttgtgtgtgtatgcaaatggctacctgagtaagggtgtttgttacctgagatcccttccagctactcaagtcaaagagatttttaagttggaatcagagtgttctgcctatgtaattttgatattttagatggaaaagtgagctggaatgcaggaaggttttcctaaatggaaaggcggctgcctcttcaccctctccactttctttttctttgtcagttgctggagagagatggccagtgacacaaaagtccttctaaactttggggagtcctagatggctggcagatgagatcacttgattccagtgaaacctaccagctgccttaaattcactcttccagagcaccatactttttattactagattgaattataggataagaaaagtgctttgagcatctt

SEQ ID NO: 132571 - DNA, 1074 bp, Homo sapiens
tctggctctgtcgcccagggtggagtgcagtggcgcgatctcggctcactgcaggctccgctttccgggttcatgccattctcctgcttcagcctcccgagtagctgggactccaggcgcccgccaccgcacctggctaactttttgtatttttagtagagacagggtttcaccgtgttagccaggatggtctcgatctcctgacctcgtgatccgtccgccttggccttccagaatgctgggattacaggcattacccaccgtgcccagccccacctggctaatttttgtatttttagtagagatgaggtttcaccatgttggcccagctggtcttgaactcctgacctcaaatgatccatctgcctcagcctccccaaagtgctgggattacaggcatgagccaccacgccctgctgggttcttcttaattataatactctttcccaagctccttgcaacttctacagtttagcctgatatgttgtaacctcttgctgtttacactgtccactcttgtggaggtagctaagacactgactgccagggcatgttttatagtcatataaaatctgtacaaaagaaagttaattttcattcaagaagccaatagcttctggatcattgccttgcattggaaataatttttttttctctgtagataaaaggtaagcattattaagttattaaagcaaacaaataactgtagtcatcctgccactccaagaacaacaggatctagagtataaaagtaatatcaaaatttcagaggcctgcagaccctgttgctgtttatcactttatcattctatttcctccttgaatcctttttttttctttttttttttttgagacggagttttgttcttgttgcccaggccgtattgcaatggcgtgatcttggctcactgcaacctccgcctcctgggttgaagtgattctcctgcctcagcctcccgagtagctgggattacaggtgcgtgccaccacacctggctaatttttgtatttttagtagagatggggtttcaccatgttggccaggctggtctcgaattcctggcctcaagtgat

SEQ ID NO: 132572 - DNA, 1924 bp, Homo sapiens
agagtttacttcacaagtagaaaatgtttgctcctgagagttaagcttcagaacgtattcttggcttcatactacctaactatagcaggtcctgtaacttaaagagacagtattaattttatattcatttcatgggaagggtttatgcttactcaagactaagcattttcagttagggttttgtaagtattatgaattgatacctggaagttcaggtaaatataatgtgttgtttgctgtggtttttctataaaatataatcagtatttctcactggattagttacaaatttatttgaacctgtgatttttttttgggcacagttatagaatattttggtattaaaagatttgattaagctactccatttttatcacattttaagtagcatgcagatgtctggttatgtctgtcaatttttttcctgaggtactttttacattttgtgtaggattttggatgactttatagtgtgaacatatcattgcagacatggaaatttagacctgagatcatttagtgttagtagtagaaatactgctttcagtttataatggatatataaggtaattctataaagcactgccatctttgatcactttatgaagaatacagacatgcctcaataaatgttttttggatgaatgggcatatcatatggattcaaacaaaatacatgttgccattaatcatgagtctgagatttataaattataggggcccattttcttttttgtttttgtattcctgtactgtaattcagtcttgaaaaatgtagccagctatacatgtttcacacttcttcccatatgtaccatgatactcttttacacacgtgtgcacatagaatctcttaatctccttttcttgttctttcaccagtactcacaaattccactcctttgcacgcaccccatttttaggttgagacccaatgcacttaagtcaccatgaacaacaaagtttatagttttcctttttgatcgaattactcatgtgttgactgagttctccggattctaggaatatgacaatgagtgacaagtaggagaatcagagctggactcacccaagcaattgtcttcatctttctccatcagtacaatacctctttcctccactctcagtcaaattcctgttcagtgggtcccactgaggctggtcgcagctgctctggagtacctgctctcaggaagactagaagaacactgaaaggtcacataattacatgtgaatttaattcacagagacctgcttgtcgcttttccatgtgtttctcctagttacacattattaactgtggtgccttgtagggcttcaattacttgggcaaatatgtatcgtgcagagactgagcacaagttagaatgctgagagtggttataaaattatgttttcctctccagatgtaactttacagtaattaaacctaatgcaatgtaagcattatagtcagtgctgtggtagctatctccaagtctaattggtaacatcgcttaaatcatagcacttattgctggttatctgggaactggaataaaccaaaaaagttacatacattaacctttggtttttctgcatcaggtgaagtggatagcttgtcccttcatcaaaatctgtcatctgtattatatggaattttgatagcatttagaaaatttttttcttatttagatagctctgtgtattcatccatccatcgatcatccatccatccatctatccatccatcatttcatctgtctttaggctattttccatagtttgttgccctggatttggagacttgatccagcacagagctattgtccacttgggttattggggtttccctttctaagtagatgatcaaaatccatggtgaaaacatgcttgccttccataaagggctacttgtttactatatttcagtcatttttctgcc

SEQ ID NO: 132573 - DNA, 1683 bp, Homo sapiens
tattcctctgccaggttaaatgtgtgaattacagagtaaagagtaagttgaagatttcttccatttcctgctctcaaataataatttttcatgtttttcttttttctgtttccctttggtgatctactttcagaatctgagtcactaaatgagttttatcaaaggagaaaaatgtacttagatacttagaaatggaaacaagatttgtaagttggcaatcaccttgaatgaaaatacagttggccttctgtatccatggtttctgcgcccgcagattcaaccaaccgtggatcaaaaataatgcgaaaaaatccagaaaatgttacatcgttgctgatgtttcagtatagaatattttcttgtcattactgcctacacagtatagtatatcaaatatttacgtagcatttacattgtattagtaatctagggatgatttcaagtataagaggatgtgtgtaggttatatgcaaatgctacaccaatttttaagggatttgagcgttcgaagattttgctatcctcagagggacctgcaaccattccgtaccaccctgatactgagggacagctatactaggtgaatactgccttgccttagccaagctgataactgtgtatgttatagagataattgccctccaatgcagttttgttttttgtttataccatgttggaaaaccgttagatattttattgaaatataattgtgtggagtttttgaaagaaaatatggaatatgttgtttcaaaagcttttcacatagattgtaaatttctttacagaccttctaggcttttcacagatataagcatttatagcagaaatgtagtgaatatttttatacatagtctctaaaacttaagtaaggcccattctacaaatgattggagtagaaataggcattaaaatgtggtggattcatgcacaagtaggtggtttgtgtcctatagtgtgaatatagtgttttctattttctttaggggggcatttctgttcccctggggaaataaacttcctatttatttttcttaagtatttttaagcttggttacttatttttttaagtaatccctgccactgtttatatgtagaacccaagtagcatttgtagttgaattttgtacattaaaaatattttgatcagcaaatatttaacaagtgcctactgtgcgttaagatgtttgtagaattgccgttttgtttgtgaatgttagcactgggcatagatctaaatcctcctctttgcaaacacccctgagaataggaactaaggtgagaatgtgttttggcctatatcgtgttttctagtcatttctatgtattttattagaaaaatatttttaaaaaatgttttgggttagggaaccaacccacttgtccaacttgtgaaagtctgcggaacaccaccaccatcaaaaaagacaacatattcggatcaggaatgtaatcacccagtcacctaataaaaagagtgcttgagtatgcatatggaacaaaaaagcaaaaccattcatttggtaaagggtgagtaggggccaggagacagccctaccctgaagatagaatgctttaaaaacatgttgccattaatatttaagacagaaagcgttttgagcccgctcctctcttctacccttcctcagcattcatgttgtagtttgctccctaatgctcacaagt

SEQ ID NO: 132574 - DNA, 1048 bp, Homo sapiens
aaatacaaagcagtgaccaccaactggagtttgtggggtcagagaagatttctctgaagggttgtttgagctgagatctgaaggatgcagagaaattaactaggttgtctgagggcaaggtagagggtgctgagtattgcaaaaggactgaaggcctgagattagagagagcttgcttgggacattggaggtgtggacaggccattgtaattggttccgagagaacctagtagagtaatgctggtgagctggtatcagactgaagggaaggaaggggctaggaggccatgttaaggaccaagagttactactctaaatgaaatgaggaggttttaagcagggtttgagttcacatgattttcttgaagggcttgcttagccacccgtcattccctttggagtggtcttccttctggagtcagggacaccatttgtcttaagtgcagtagtaataattccttatggcaagtggccaaataaccagcaattcccagcatgtgaggcccccataatgggcctgcaaggacagtaacacttgaaaaacatcagagagaaaaaaaaattgctctttgcccttagtgaagtaaggctaaaggaaccataaaggaatatagtcaaccattactgctctgaggctaatgacctcgaagctcttggcttcccaagctagttttttttctcttccttcttggcatttcattgcttgagaaaactgttccaggaaatggaaaaagaatggagttcagactcaaagtgggtctttactttttgacgatcctggtaaaatgcttacagggacagaaggttgaaattgtcaagaagagtgtttttggatttgttaatcttggtcctctttgaaggcagagtgcttctaagagaagatcttattcatcgtctgatgaataggtcagttgtcacttgggaggagggagcgaaattggtggtggcaagagaagggtggatttgtaggaagcatatcactttcctgagggttttgttctaattcttctccagatacaaataaacgcaacattgggtgaattgattt

SEQ ID NO: 132575 - DNA, 1016 bp, Homo sapiens
atgtttcatagtgtttcaggtttatattactgagatctttgttgtgggtccattttttgggttcaaaaacatgaaaagatagcattttgaaagtgttttgttacttctctatgcttataaaaatttgactcttagaacttacctatgtagtcccccacctgagataccaggacagtggggagagaatttatgatgtggtaaattttttttttggcagagccaaaatattgtaacatatgttgaaccaggtgtgtaagttgaataccttttagacatgtagttgtcactgttaatataagtggcctgctatcactcaatgctgtggacagcccaagggccttttctgaatcttttataagcaggaagtttaatttgcctatatatttttctttcttttttatttttttgaggttggttcttctaccaaaaactgaaaaaaaaagtattattagataatttttactttatgggatttgttagtcccagtctttgtagcaatttcactttaaaattcgtgattagcagaatgtcctcttcatttctgatgactttctgtggtgaggagggttcacttagaacctgggacaaatgagagttggttgagtaggatcaaacttaataagaatcaaggagacattaaatatattcttgaactggttttctaggattcttttttttttttttctcctgaaaggaagagctgggccaaagttttaaaaatcaagacaaactagaggtttcttcacattcatggccatattattgtttgggattctatttaattttcatatacccctttatgtttctaagaatatgtttctgatggtctactttatatatgcattcgtttgactccagctatagtaataattgattataccctaaaaaaacgacctctgattcttcatttaaatcagaacaaattgtttttgaaagcagcgccatgagaattaccttgaatgaccatagacttggcccacaaaggaaaggaaattatgaagaggaggaagccatgc

SEQ ID NO: 132576 - DNA, 1097 bp, Homo sapiens
ggggagacgccatgttaactatgggcattcattaactgcgtggatatgaaatggcagtaagttctctccccttttatgccaggggcattggattctgtaaaagcaaaagggagaggagcgtatgtggctgccaaaatgagatggtaagaagttaaatgatcaggacacagagaaattaaggaatagtaaggtttagtgggtatgtgataaacattgcagataggctctgtggtatggaccagaaggcacaaggtctggatttttttctaacccagactctgtcactgactgcctgtttgatctttgtaacttctttggtacttctttagacctccttatctgaagttaaagatgtaaaacagtaaagatgtaaagagtaagttaaagatggaaaacaggtttcaactcttatcaatattgatagattggtaaaggctattgagaagagaatcctgcagctgtgtcttgcttgggtcattggaaggagttctgggattagtttagcagtttctggtgactgtcatggggtggtggtgggtgtgtgcttgcaggcatgcatgtttgtacgtaggtacatgcaccacaccgcattggttgactaatcatttgtaaaaatccttttcaattcagtctatatattggaaattacgtttttcttggctgtaaggttgagaggatcttctaatcagcctttaatttttctgactgaaagccagtgtacttctagttttgggagagaattacgtgctatagagctggatgcctaataggcatatagtgatggcgcctaagaaggaatgaaatcgttggtccgagagctagagagtgcgcagcgtgctttagacttgcatggggttctcttctaacctgcatatctgtgtgagtcaaacatagtaggtcctttcagataggtaatcatctaatgagccacagttaattaaatgtttatcattgcttaatatttggtatagggcattttatttctattctaggatagctttcaaaactagtaatttgggcagtattttagtactacatagaaggaagactggtacaaaatgggtgatggcgtgtaacttttaccgtattgatacata

SEQ ID NO: 132577 - DNA, 1070 bp, Homo sapiens
gcgtatattatgacttgtagcatttgaaaagctccatggtctaggccatgtgacttctgaggactgtaactgtaaaaaagctggtgttgaataattaaaaactccctccattttaaaaaaatgcccatttctcttagaatttttatggtgtcagtcaaattaatgcaggtatgtttggttttaagaataacatgatagaaatccgaatttacactgataggctgcctaagagaaagttatttcaaaacatggggcatcctggcagtgcctgggaaggttggcccccagcccgactgataggaacttcctactcatcagttcgctgtgaagtactgacaggtggagggggtttaggcttctttgggttctgaacctggtgatgctactacctacacagtgtttggaaatcttgggcgatgttttgtttgtcacaaatgactcaactggggggctgcctcctgctatttagtgggtcagggacactgcagcatcaggattgcagaacaatttacatacagtgatgagttgttctgccccaaataccaataatacctttcccagaaatgactggatagttattgatataaaaaaatgaaaaatggctgggtgcggtggcgcatgcctgtaatcccagcactttggccaaggcaggtggatcacctgaggtaaggagtccgagaccagcctggccaacatggtgaaaacccgtctctactaaaaatacaaaaattagccgggcgtggtggcgggtgcctgtagtcccagctactcgggaggctgaggcaggaagaatcgcttgaacctggtaggcggaggttgcagtgagccgagatctcgccactgcactccagcctgggtgacagagcgagactccgtctcaaaaaaaaaaaaaaaaaaaaaagaaaagaaaaatattcgtaaaaatactactcttgctccccatccctagaattaccacctgacatcttttttttttaaaggaatgttgattttttttaaggtgtgtacttgattgaacactgaattctacttcttaacgtttttaagtaaacatgatttgtaaaggcata

SEQ ID NO: 132578 - DNA, 1505 bp, Homo sapiens
atatcttgatatatctcggacaagcttttaattgtcaaaattaagttatactaccttgtatattttagtcttagaatttaatgttctattcctgattgaaaaacctgtgactagcacttcaaaatttcctaaacgtgtttggtcaattcttttttcctttttaaccaaatgaattttataaagtcaacttccttaatttgtaatgtaggctcagtgaaagcttcagggttgttgcccgccgcccccccccccccgccccgagaaatcttcagagagatgtttaaacaaatcaaaatatacttaaagtgtaaaaaaggtaatttgatgtggcaagttttaaataaataaaaaaaataaacgcacacactccataacctttctttgagtcttggtttaagttctctgtcatatagtgccaaaaactttgttttgagctgcgtgtgtgttgaaacatgtatgcctgtcctagtgtcataactaattatatctcttatatgcttacttctagtaattggaaagtagacctaccgcagcatacatcttcacatttagttttatcttgaggacctgctacagagatcattttctaccatgcagcaacttgacattgtgaacagatattactattttaaatatattatctactttgtgttttgcagaaatagtgtactttcagggaagttaagtttcgggtgtttccaaagcacatctgtctttaccagtaattatacactaatactgcctttgcagttttgactgagatatttcatctgtgaattggaaattgatggcctagtgctgtgatagcaaaattttataggatttctttttactcaaagttttcaaaagattgtggctgatggaaaacctgctggtgctttggtcacttactcttcatggattggtctaaaataatttggggcttcttttgtaaaagtgtattgtagaattttcacaaacttagaaatcctgtcttagatatgcttatgactggggccgcaaactgtttctcatatgcaccagcttgtatgaaaatatgtggtccttgtccatgcctgctgaaagagaaaccctaccagtcttcagtttctgagctgcagccttgtcgaaattaaagtcttaggactgggagcagttaatgctggtgatagattgtggtatttagcgctgtgctgtgttgcgtggtggacttacacgattctagtcagaacttgggaaagaatataccacagaattggtgacaaatatttttcaaagagaaatacgatgacttttcttattaatgagcagaccttttgggctttgcttaaggaaatagtgaaaagattgtacagttctgttattgataatggtttagaatttaacactgaaaatgctggattttctttcctcttattaagttaatgtattactttgaagcatcttttctttttttacagttagaaattcaccaaaactatatttcaaacgtagctctttttaattttatactaaattaatttttt

SEQ ID NO: 132579 - DNA, 1370 bp, Homo sapiens
ataataaggcggtgtgactgcgggtgagagtgtaaaatctgttcccactcttcaaaagatcacacatctcatgttgagttgaaagtgaaatattatatatgagattcagcatgaatgtgtatatctatatgttttatttaatattcatcctctggtggaatttacaagtctcttcagttcagggtatacctgttttggggtcctttgtacctgtgctaacatatgtgtgagaagtatgtgagctctttcagtgactgaaaaaattattacttgattggtctgttttggcgtgatctgggcttttgattaatctttgaataactttttccttcatttttaatagttcaggcttgttaatgatgcttcactggcttctttgggtatctgtgacttaagtttttaaaaacagttttattgagaaataatttgcataccatagaattcattgctatgaaaagttttacagtaccattttataattacatgtgattttcaagacacaggaaaataaagaaatggtatgcttagaatttggaagaaagtctagttatgttttcattttatttttatttttttgagacagggtctcaccctgtcacccaggctggagtgtagtggcatgatcatggctcactgcagccttgacctgctgggctccagcaatcctactgcctcagcctcctgagtagctgggactacacgcatgagccatcatgcctgggtaagtttttttttttgtagagacaaggtctcactatgctgcccaggctggtctcaaactcctgggatcaagcaatcctcctgccttggcctcccaaagtgctgggattataggcatgagccactgcacccagccgctgtactgattttaaatactttttaagtgaaatgagattttataacatttgaagaacttaaaatgtttgacaggattaataaatttgaatgaagcattgaaataattactatactaatgaatacactaaggaaatttgaaaaccacaaataagcagttacaaataagtattattatttataaaatagtcaccctagaagatgatgcagtgatggtgtcatagcttaaaatgctcttggaggtcttcattttacattgatttcagacagcctgtgtctagttcttctaagcgtctttggtgctagcaaatcttccatgacataagctttgattttctgaatcttcaaaagtcttttggtgttaacttacttggtgggtgttaaaacaagataattctatttttgatttttttttttatttactttttagaagcagagtctccctctgtcaccctgaccggagtgcagtgatgcaataataactcactgcagccttgaactcttggacttaagcg

SEQ ID NO: 132580 - DNA, 1170 bp, Homo sapiens
atttaaaatgatatgatgtattttaaggataattttttttttccctaggggaaacaattctgtgaaaattctgtagaggatttaaaatcacttctttttttttttttttttttttttttatttgagacagagtctcactctgttgcccaggctggtgtgcagtggcacaatgtcggctcactgcaacctccgccggccgatttcaagtgattctcctgccttagcctcccgagtagctgggattacaggtgcctgccaacccgcccggctaattttgttttgtatgtttagacggggtttcaccacgctggacaggctgatctcgaactcctgacctctggtgatctgcccacctcaacctcccaaagtgctgggattacatgcgtgagccactgtgcctggcctgaaatcacttctaaaaattgttacagtaaaaattttatgtttaccagacgtaaattttggttacatatacatttatcccaattgacacattttattcatactgaataaaacattaatgttacttttctattttttatgatgtattttgacatgtgtttagatgtatgttttatatgtatggactgacaaaatcatatatgctattatttggcatcttatgtggttggaggtcataaagaatgtaagtaactgaaacaatacatttgctcaaagaaaggccactcaattctctgccctgtggtatctaatctccctgtaatacacatttcaccatctaggattggagaagttcattctatcaacacgaatgctaacaggtaggcttctggaagtacaatgtgatagttcagatctttctctgattcaaaatggtgatttaaaagaaaacatacttggctgaattggcttttgatagactaaaacattaatttgccttaatgtgcattaacgctaaaggatactaaaaaacaaaaatttttttaaacccagaaattctaccaggtctggagccatatttttcacccagtaaatgtcccttgtaagaaatatatttacacgaagggctgggtgcagtggtgcatgcctgtagtcccaactatttgggaggctgaggcaggagaatcattttgagtctagaagtacaagtccagcctgggcaagatagtgagatcctgtctctaaaaaaataaataagaaatattttcg

SEQ ID NO: 132581 - DNA, 1103 bp, Homo sapiens
tacagtatttaatagttgtcaaaatgtacagtattgtcttggaacttgtggttcatgagttcatagtccctgcttttttgtgtttattacaaagatgtaacaacctacacaaaacatttttctcttataatgaccttacatttgccaaagtgccccatgctgaaattccttttcagtgtctttttttttttttttttcagtccaaagccagacgtgtacccagacacaaaagcctctgtgtatagcaagctgttttaaatattgtgactcgacgatgtgctgtcctttctctgcttgagccaaggatctctgctcagtgtctgtggattaccaagctccttctttattgtacctcttgtcaactattcctattcatttaacctttcattagtgtctgtgcagcttcactgtctggaaaggcaaggaaaaaccgaaaggccccactgtcacagttattagatttctcggttacatcccagcaaccgtaaagaagtaagcgtcgagactattgtcgtgcatgctgctgtcctggggtgcagctcttctgtgcatgtcaaggacatgtgccacatgttgatatgcatcccagggataaatgcacaacatgggggataggccgacgctggcagtaatgagctttgtaggagttattgcaaagaccaacagtttgtgaaggaattttgcttaacaggccaaggagatagacagagttgagggttgccaagatttgcctgtgcggggcttgtcagtcacattgttttcatccaaacttcatttgaggggaaaattgaatacatttgacagcaatggaaagtcttattttcttttttcaaatctttcagaggacaaaagcagtatttctggtgactaacataactatttttagtactgactaaatcatatatatgaatggatctattagcagtttatctttttccatatctagagaataattaaaagatatttcatagatgtcatatatatgttttaaaatctatgtaaaaataatgtagcctattaattttcctttgctcttttcctcctttgattttcctctagcatagcctggttctttagaaatacatttgcttaattggctagat

SEQ ID NO: 132582 - DNA, 1105 bp, Homo sapiens
tccccgctgcgctcccagtggcctcccctaaacttggccccaagtttctgaggcgagctctaggtgggagggtgcacgtgagagggggcttctcaaggtcggccccgctcgcggcttccgcgcgaaggtgagcggctggctaggggaggctccagggcgttggggacgggctggggggacgaggtggaggggagtgggggatgaatggagcgctggcaggagctcggggaagagaggaaggcggctgggacctacgggaacttttacaacttgccgccgagtgagggaccggcggctgggcgtgggtgccgggtgcgctggggcgcagccgcccgggcccggcacgttgactcttcctctccccttgtcttcacattcggaatcttcccgtggtaaatggagatgggaggaaatgctcccgcaggctttacggagaaggtgcagaacgcagggcaggaaaatcaaccttgcagagacggctcttttcgaagtgcaattctataggagccgatttgttttacttgcacgttgactggagggtgggatttggggcctggggagggagcagaataaaaaattatatatgctgaaaaaccctaggtgaaatctcctgtgaagtgagtttaaggttgaaaaaaagttccaagtgcaagtggtggaggagatgggctggctttgccaagcgagactccagcacagcccctctacgagaagcgacttctttgcagcgaggaagcgtgcaattagttcgcctggtgatgagccgctctgtccgctttcggggaagtgatttgttagaaatggggcttgaccactcccttctttttagtttgcttcctcccagcgtcgctattgttacccccacttggggatctgacatggtgtattccgtatatagagggaacatatgagaatacaggtgagatagcgggttggcattttttcctcttccctgctccctaatgtgacatctcttgtttcagtgatcaaagtcacaactggagtgtaggagatgggactgtcaaatgcaggggcgcgtacacacacacacacacacaaaagcaagagcccaggactgtggttacagtaacgctgacagaaatta

SEQ ID NO: 132583 - DNA, 1188 bp, Homo sapiens
cagaaaatataagaaggtgcttattttttctacattcctggccatcatattgtttttaaactttttaatttttttatctgaaatgtaaaaaatgatatcctgaagtagttttcacttgcatttctcttattatttgtaagtgaactctaagggccattttatatcgttttctatgggatttttcttttatatatctttgtatatccattgtcgtgccatgtctaattcatgtcctatggtgcccttcaaactcactatattatgtaaagaacttattggcttcttcttttagttattttactacctaactttctcactatcacaggcatgacattttcttccctttctttaaatttcacatcttgagggtaatctttgataccttttggactctttgaacagaaaatcaatgcccaagttcagtcacttcctcttttgcagtgtcactcaaatttagtaattcctctgtgtccttaactttcaaatcctctatcttggttctcagtagctcagctctgaacatcttattgatttcttttccaaatatcagttctgttttacatctttactttgagacaaaggaagatataagccaccaaagaaaataatttgtaaaattcaagttaaaggtagccaatgaaaattctaggactttcttaatgaatatctggaggaaaaatgtaacctttaagcttggatgcctagaggatacctcatgttgcaaagtaacctgactgtgagatttagacatgcatggccatcattaaaacagatatttccaccacatttacccattcatcaggtatcaattgaatgtcatttgattgtcagaccctctgaaaaagttagagaaagagatagctctgcatttagctattaaagaatactctctaataggaaagacatttgtagaaagagacaatttataataagaatttgataaatactataatgatattcatattaatgtaattatttgatctctggaaaaagttaaaaaagttctcactctcactaattctaagtaattagaagtttatgttgttgaaagtcaaattttgatttccttagtagaataatatcatactagaaaatatttttatagtatgattttattcttataaatttgtagaaaatattattttctatgatatgtagatatttaagtttacctgtcactttatgagt

SEQ ID NO: 132584 - DNA, 1060 bp, Homo sapiens
ctgtaggtcagaatcactttcattttagaagtaaagagctatacccgatcccattcatttcccttggagcactgcttgtaaactagttggatacccaacagcattttctttacatgtgctacaactagcaacatgttcgttgaataggcagatattgaatattttattctttagagacatcaagatcagagagtatctaaaaatatattgttttgggagtaattagggaaatgattttctcagctttttttctacgccctttatttctcattattgggcctgaagaatattttccaagggccttgttttattttttctggtagttcattcctaaacattaaaatgtttaccaggtctccctgatggagaagggatgcctgatgtcctcagactgcccccagtttactgaccagtgacttggcaactaccttctcttgactaaaagttggaaagcagagtggtcatagatctaagctaggacattcaatgctgtacttagcttctagatcacattttacagaacaaatcaggggaatacggggagggaaacaagctctagccagcatttaccagacaggaattgaaggtagcagcagttccctcagcttcctgttttgtttcttcatagcacttactatagtttattgttacatatttctggattatagaccagtagctacctaaaggcaaggattatttataacctttttcttactgaaaacagagaactagtatagtgccaactacatagtgtgtgtaaaaagaataaatgatagatattgaatcgggttctgaatctaggtactgcatatctaaatctcccagcaaatgtcaagttggggccacgaaaaaaagcagtttgtgaatgaaatcccatataagaaaacaagggaaaataggccaggggtgactaatttaccctattcatgggatcctacagttgcagctgagagcagcaaacaaaagcttctggtcagaggctttttgcttgtcagttaaactacaaaatgcagatctggtagaggcaatttatatttctagcatagaaaatggaacatac

SEQ ID NO: 132585 - DNA, 1057 bp, Homo sapiens
aagcgaatacttacgctgtgacctatttcttacataatgtgtgtgattactacttttttatccttctgaaataggttcaaatttatgggatctttaaggattttgatgacttaccgcgaaatgtttttcatgatttggtgttaaatagtttttcataggttagccttaattaacgagctttctcataatttctcggaagtagtgaggtttttcctaggctaccacagtggcagccttgttatgaaccacatccagaaaaggtgagggttgtgttttacagaaccttggttaacttagggtgacagatgcagcatgtaattcccgtcgtgtgtgtgtttgcacgcatctgcatcatcttcatcacacattcttgcctttatagaatcaattatacctgtcaacttaggaaatcaagaaaagtaagactatttctgtaaaaatgtttcttaatgtaattatttttgcttttctattataattggagttatctgtgacctctctgccagacatgtttatgaaagtaagtgatttgtttgttgatgtagtttggaaggcttctaataactttatactgcaagttctttcaggtttacagaaccaagcatatgtgctgcccaggaattctgtggcaggacttcttcgatattactaacctttttgattgctctactggtcacttctctatagcatatctcagcactgcgtttaccaacacatcttttttccacttggattctaaagatttcttttgcaaagcttagtgccctcaaaggcaattaagagtcttggctttggagtgggaaaggctaaggtttgaatcctgcctctgctgcttctgaccttgagagagtatttaacttctgaacctgtccatgctgaagtgatgataatttccgttgtctcttcagggttgaggtgaagagaaacgagtgtgtagaacacacgtataaagtgttcaataaattatagttattgacataaaggatatttttattagtataaaatactatcccttatgctgtgaagaagttacccaagctagaccttttagtttttc

SEQ ID NO: 132586 - DNA, 1340 bp, Homo sapiens
cccaagcttccagataagagcccagtctagccaacgccttcattttggccttgtgaggccctcaacagggagctcacttaagcaggcccagacttctaatttatagaattgtaagataataaatgggtattgttttaagctgctaaatttgtggtaatttgttatacaacagctgaaaatgaagagaaggaatagttccttctgtttatgtttggttggctggaacttgtaacatggcccctctgtggtacacctaagagaaatggaagaaggcaagtgtagcctagctatgtgcccaggatgtaaaagtgggtttttggttaaaaagctagcagttttgctattactggtgcctataattaattaattgtgtgtctgtatattaatctatttgtgagcttgtaagtgtatgtatatgtgcatatgtccatatgtacatacacaacatacatatgcacatatgaattttaagtctagtttgctgaataagtcttttcttaatacataaggctcagtatgttccatgtgccttttgaaactgtcgtccaggctggggtataatggggcgatcacagctcactacagcctcaatcctctgagcccaagcaatcctcccacctcagcctccagagtagtgggactataggcgtgtgccgctatgcctggcccatgtgcctttttaatatattttttattttatagatttttttctacagtgctttggctttttgatatttagatgtttttctctgatgaggcacaagtttatttctgtggctcctgatcagttttttttttaacagtggcaccgttaagtacttgctgagcagtaccttagcctggtgggctggtggaacagtgacaacttctctaaccttggaatagagagactacagatctgcaaagaagtttctgaattcttagtctctgacagtgtggcagggatttcagttagagtagaggagttgactgttaatcctgcatctgtttttgtgcttgggggaaggctgaggccaacacagacagtgaaatgccttacttagtgcaggcacatcggatggctacatggtactttgaagttgttcattaagttgttgaggattgcagatttgtgtagcacatttgaagtgtgttgtggtgtaagcagcagggttgagggtggttgtgggccccgtaacatgtgggccattgtctgtgatccgttagccccatgctctttgacgtgattcatggatccttagccctgaatggttttctaggtacatctggtagacggtgccagacataatttggaaggcatgcggtctggcaccctgagatatattttagggacttggtgt

SEQ ID NO: 132587 - DNA, 1083 bp, Homo sapiens
gctacgagatgaccagtggctggggactcctatagcttcaggttggggactgttcaccagaaagaccaatgtatgcttagagggttgggactttcagctccagcctccttagaggggaaagggggtgaaggttaagtggatcaccaaaggccggtgatttaatcagtcatgcctatgtaatgaagcctccataaaaacccaacatcacagggtttgggaggattttcagacagctgaacatgtggtggttcctgaaagaggatgtgcctggagagggtatggaagctccaggctgcttctcccatacctcgacctatgtgtctcttccatctggctgttcatctgtatccttttaatacctttctaataaatggctaaacataagtaagtgtttccctgagttccgtgtgctgctctggcaaattagttgaatcacaggagggagttgtgggaaccctgatttatagctgataggttagaagcacaggactgtgcttgtgactggcatctgaagccagttgtgggaccgagccctcaacctgtgggatctgacgctatctccaggtagtgtcagaattgaattgaattagaggacacccagctggtgtccagtggagaatcatctgcagaatgggttgctggtagggagaaatccccacacattttggtaaccagaggtcacagaaatagtctgtgctgggtattttgaggtatatatataataggagaaactgtgtttgtttttttcctacatccttacaaggacacaagaatgtaccaactgtcttgttcaaaacatggcccttcccatacataatttgactatggaaatggttgacctttttctgagtaccaaggagttttctgcctgtaatggggtatttaattatattttagaaaaaggaaggtcatttgtttagagcagcactgagtcatctgttctgtgcccgatgttcagaaaggaggtagacatgttctttaagagaagcttttgaagtaatttagaaaatggtgcaataccatccgtcatcaggctgtgtggcacaagatcagtaggagcccagagacttcacatctcctagt

SEQ ID NO: 132588 - DNA, 1344 bp, Homo sapiens
aaggaccctgccattctatacttcattctgttgccagttcctagcctgtagtgggcatttaattgataattgttgaatgaatacatagcttctgtttctgttgatccttatgtatatttaaaagggggtcctatgcatatatttttgatgtattcatttctgcttaaaatacatcaccgatttctaaaagttaatgtagaatttaaagcacaccctcataaaattgtaagattgtaagtttaaaataaacttccttcattgtacaaatggctagcctaggtactattttaactcatttattactcacagcaaccctatgaacattattatccccattttacagatgaggaagctgaaacacagaggtggttacacagcttcagtggcagagtcaggattgaaaccacaccacctggtttcagagccagtaactgccagtagtttttaaccatgagtcctattgtcaccttatatatcaaaccaagacatacctaaaagctcttagtggtcaccaagaagacgcgaacactttagtagaaaaataagacaacaatatgaaaggcagtatttgaaagagcaagtggccaagatacgaatgcaaaaatcaaggaaatcagacagcaatatctgacatttttcattgtttagattggcagagatgaaaaggatagtaacattctgggttagcaagagtataagaacatggatccccgtttatggtgggagtgtaaactgttaaaacacttctggagatcagtagttctcttccctgtaattctgtttttaggaaactattcacagaatataaatgtataagtatgtacaacttaggtacaagattgttcactgtagtagttattgtggtgaaaaattgtaaacaacctcaataagggatgaggaagtaaatctgtatgtcaatattatgaaatctctacagctattttatctatagggcaatatttattgcagtagggaaacattcatgattattgccaaaatgaaaaaagccagccataaagcagatatgtaatatgtagtaagcctgatattgtaaaaatatagctatgatggtagctaaaatgcactgagaatttatagaccaggcgttatgctatattgttacagtaagattatttttttaatgaacatttgaacagtgattattcctggtcagtgggtttatgggtgagtagtgtttctatattttctttcttatctttggtaatttgatctattacaaaattttctttccacttcatcgtctttacttgtaaccccactttctcaggataagttgaaaacaaggaatcgaataattttaggagccatcacggggactaggaa

SEQ ID NO: 132589 - DNA, 1097 bp, Homo sapiens
agctaataatattgggactagttgtgcatatggggaaattctcagagagaggaggtgcctgggggaaggttgcctagcagcagagctggcatagaaggcaagcccgtgacctgtctgtatgggggaaagtccggctcttcaagggtggcattgcctgtctgtcctctctctctagttctgtgcacagaaggaacaggaacaggaacagaaggcacagaggaacagggaggaaaagcccttccgggagtgtgcctgagtgtggcttgtggtgaatttgtggtagtagctctggtcagattttacaacttagaatatgttttgaatccatatatgtggtacactctttttgtgtgggactgacacaaccctcttaaccttaccacatctggaaacttgcttgaactgctgaatctcagaccctatctcagacctaagagtcataattgctcttaatcaaggttgtcaggtgattcttatgtacattaagtttgcaaaatgcagctctattgaaatacagaggaccagaaattgtataattgagaataaggtgaggagaggaaggggtgcatgtgtgtatgtgtgagagactgggaggatgcatttcacttgtgtatgtaattgtgggagtgtgttctcattttacttgaaaaagcagctcactgagctataattcacataccatgcagttcacctattgaaagtgtactgtttaaaccacttattggttttaagtgtgttcacagccttgtgcacccataaccgcaatcaattttggaacgtttttacacctggaaagaaaccccatacctataagcagtcactcaccatttttccacagtgcctaccttgcttccgagaagcccctgattatcactaatgtacttctgcctctgtcttttggatttgtctattctggtcatttcttgtatgactgaaataatacaatatatggtctttagtgtctgaatttttttcacagtttatccatcttgtagcgtgtatcaatgcttcattccttttttactgctgtcattttgttgtcaagtttattttgagcaagaatacagagattcacctttatcctaagctttgatgac

SEQ ID NO: 132590 - DNA, 1047 bp, Homo sapiens
tcttcacagatttctttgggatggaaagttctttctttaacctgattactgtttctaggtgctgtaaattgctgatcattctcagtaaatcaccagcattctgttctttctcagtcttgacaaagttgccattgtgcatatgtgtatttgtgtgtgtgtgacagggaacatgcatggtttctgaaaaaaaaaaaaaaaaaaaaaaaaaaaatccttgccccttttagatttggaaattagcatagctaggctagccagatccctcttttggaggaaatgggaaagattggattgagcccttgtgtcaaggaaattgacttggctggatttcagggatccctgtggactggcccactaaagatctgtgtcagtatctttagtggcactggaattgggacagcgtagctattttctgtcatagggcaaactcagggggaaaagggcaggcacccaacattctatgagaacttccatgtgtcagagagtgttatgtaaatgctatgtatattcttgtgtagtatgacaaccttgtgagctgtatattactactgttgttattattaccatcactgcttcacgaatggagaaactgaggcccagggagatcgtatttcctaaagttctacagctgagaggtgggttgcggaggctgctgtccttttctaccaagtgaagtttgtctttgctctttctctgccatattctttaaaggggcagatgttacaaggttgatgcggctgatggaaacactagcataggacaaaaatacaaaatcccttcacagactcaagtttccccacacccaaaaggctccgcgacagcatttccaggtataggggcaagcttctgtagcctccagcaaccacagaggtgcccagatgccaatgacaccctgactagagtgagcatgtcctctctgctctcagagtcctctgtcattggacccctcccaactgctgtggacacttgggctgtgtgctgcctactcccaggtgttaagttactggtaggacccacggctgtgtgtttattgcacaatttggtgaa

SEQ ID NO: 132591 - DNA, 1892 bp, Homo sapiens
aacaaaggggttgtatgaaattcccattgtgttttaattttgataagttattataatttcatgatagaaatgaaatatagtgtgcaagtatttttcctaaaattgtgagatcacgtctgtgagatccatgcagcttgggtggatccaccagtcttttttataatgaagtctctgaaatacttattgaatgaatgaatggtgctattaaggtgatggaaataattttccattcacaaattgctaacatactgcctttcatttcataacattcttccaaaaaacaatattcttgtgactattattgagtataaactggatacttctggatacagctctggttgtacataagtgttttcctaactaaaggattgtttggggaaaatgagatttaaagaaccaagatactgatttttggttatttagcactatatccttgccatttttcatggattcccttgtcttatattcagagaacattttcagattgccttaagcctgtttgtttcctgtttatccaggtttcacttttcattgatgggctactacaaggcctaacttttgcatatacctgtgtccaggtgtctcagtccaggaagttctgtagtcctgtttatgccatgtatttggactttcatatattcagcaactatttttttctgtatatattttggggtctcttacaccactgtttaaaatgtggttcccaggccacctgtaatggaatcacatggagatgcttgaaaaagtggcacgtttctggttaatgtgccgttcttactggagcagaatatcttggggacagacataaaaagcctcatgttttgcaagtgactctcaaatttaagctggcctcagaatcactgcttttggaaatcagggttatagctttgttcatgttcttagaatctaacatataattagaattcaatgaatatttttgagcaataagtgagcacatgagttgctgggtttgtggtagttagaaagctatacaatacctttaccagtctttttgtaatgaaagctctgaaatatttattgaatgaatgaatggtgctaataataaggtgatgaaaataatttttcattcacaaattgctaacatactgcctttcgtttcataacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcacgcgtatcaatgctaggagtgacgtcaagtagactggctgggaagggcagaatgtggtaggcggttaaaaagcaaaaggcacatgctatatgactttttgccttttcttgttgtctttaagacttttgtgatggttacataacaccagtgggaccagagactagggcaggccaaagatgcactgattaaggaaattactgctacctaacagttattctggagctcaaatatttcctgttcattatgcaataatgtagcctttcgagtctccaaatgccatttggaagaagagggtgggggagttggaggtagtaggttggatctgaggcttagtctcttgcctgctgttttatgggcaaggtggggcaggacctataaaaattccttcacccatggcccttttctcctacaatgactgtagaaaattagaaccctttaactgtttaggaatgtgagtgttcagcataaggatccaattaggatgatggggaggagagataagtagcaatagatttaatatgtgatgtttgatagcattaaaaatgtcccaagcctatgcatgcagtgattgcttgatactgtagttttaatttgagttatagcatagagatggtgat

SEQ ID NO: 132592 - DNA, 1017 bp, Homo sapiens
tgcatttatttagggaattttaaatgtcctttaaagttttgacattttctccttgagaatcttgtgtgatctttgttagattaattccaagatgtattgtttttgttgctcttataattaatgctgtgtttgccttttttctggttattgcagaggaatactcttcactttgtgtatattggttttatatttgacagctttgcagaattgtgtagttagttctccattaccttattagctgtatatctttgttttagcagtttgtgggtgataaattctttctgcttttgtctgtttaaggaagtctttattttgctttttattttgaaagagatttgtgttggctaaagaattctaggatgacatttttttccttttagcactttaaagatgttgttttcatatttccaatatttcctcatctttagtattgatattgcttaacttgttttaaattcttattttgtctgttttctcactcattacttcagtagttatttttcctctatttttattctgtctttaaactgcccagggtttacttttacttatggtgtgagtcggggatctttgccaaatcattgcctcctctctcttgtcagtcctgcctgagactcttccaaattattagccttttcaaaataccacttagtggttcattaatcagtctgagtgatgaattgattgactggattttttttagttcattgatttctgcttacatctttattttctgctttcacatttctggctttattctcttggatttgtcccctttggtggatttagttatcagctaattgtaaatcattattattttctattgaaggcatttaaagctcataatttactgttgttactgttttaggtgcatgccgtaaattttggcatgagttcttcccttctcattatactttaaggattttatagtttccctcatttcttctttaaatcattattattcattattatttttacatatatgtgtttttattttatatttcagatatgtgcagt

SEQ ID NO: 132593 - DNA, 1059 bp, Homo sapiens
gcccaaagcaatgaacatgttatttgttcatgattttgttggaaaatcatgggctcatgattgagttgggctcagctggatgtttcttctttttgtctttttaggggtcactcatgggtcctcattcatctggtcgcccagctgaaggtagaaggtctagaatgaccttactcacatctctggcaatttgttgctggctgtcagctctgcctccctctctcatccttaaggggactggccagggtttctttccatggcagtctcagagcagcaagagactaagggtgaaagttgcaaggtctttagaggcccaggcccgggaagtgtacagtggcagttcattaacattgtcttggccagtgcaagtgaccagaccagcccagattcaagggatggggagtagacttcatctagataggaggagccaccaggttacattgccaaggggtgtgcatacagggatgggaggaatgtgattgtttgttgctgtcagcacagtataccttactagaactgaattgacgtctctactttttgagcattttttgtacattgttgtggtatttctttgtggtagtcatctcacatgctttaaacttcgtatgtcttatttccttccttagtaggtcacattgggagctcatcttccccttcacttaggagacagtgcaataaacatttgtatctctcatagcacataccagatttttaaaatttggcgggttttaattcaggacttaaggggtgaattatcttattaaataaataactcaagtatacagggaagtgaaagacagtcatttacctaatgctctgaacatctttcttgagataaagtagtgctgtgaactgataaagttcacataaagctaaagaaattcctttatgtattaatattacaggcatttatgtaatatcagtatctgtctgaaaagaatgcattgattacaaaactctttaagttgtacagaagttatttttccctagaacttcaaaagtctttgctctgcaagggaggggagagtaaaaaaggtgccttaaggatgtagacatgctgta

SEQ ID NO: 132594 - DNA, 1021 bp, Homo sapiens
tggttttcctgtttgtttgtttggattaggaaataaaaactaagatttagcagaagtactgagtttacagcatcctcagctagttgccacactagataagtagctgtaggacagaccaggcagtgactcacatggacactgcttttaggtcagaggaaaataactcaggcagggctagcagagcttccattttattctcagcagagcttagatctccctttggctgttcccagaattagaaagctcgtcagggatgctacagattatgctttagagttgggagttaagactgagcctcaactgcccccatttgtcttccttaaaagacagcataaattttaaggtcaaaaaagaaactactcattttagcagaggacaaaacagtggagcccttttgggaataggtcagccttttatggtcatcctaattttgcttcctgctgttttaattcacccaatacatttccttctgggaatcacctagaagtagattcatgggtttgaaggagaggagttaggtatgtttagaagagaagggacacagatctctaagggcacatacaacttggtaaagcaatccaggttgagagtatataataggaatttgagtgctttaaatttgtattttccaggctcactctcagtttcttaaagtactgcttcaaacaatcatttaaagataattatgttaacatttaaagatggttaatttggaggtctgatgatatttttaataacacagaagtttcattaacccaagattcttaatatgtaataaatttgtgaatgaacttaaaagctagtctcttcagatatgtgaattagtaggctttttttaatcatttgaagtagataagctagtagaaaatggctttcttcctccttcttatgaaaatatagaacatatccaagatactcttagtaaaagaataaagctcttcataattgaacaacattcaaaatgatgtgtttgaaaatcagccacagtgtattaaactgtttagaattacttacctggaga

SEQ ID NO: 132595 - DNA, 1125 bp, Homo sapiens
ccaggtatggtgcaaggaggggattgaagctcagcatggagcattagatataatcccttggtaggtcccttccaagtgagattttgttcttgagttcaattatatgtcaagtgggaggcttaaactaaatcactggatttagtttctctggtgacagctgcatcagtcagctggggcaagtgttaagatgtagattcctaggcccccaccctagatatcgattcaagagctcaggaatccatattgtgatgagcaacttacgtgattctaacagactggatgatttgaaaagcaagactgccatttctatctcacttaatttcaaggaaagagtttttcctctggcttctcatgagataccatttctcttgaagacagggcctgtggggcctgtgagtgtgtcctttcattgtgtgtagggcatgtgcattccttctctgtttctgtcatgggctgcaaaggcttagtccagcttggctttggcctgacaaggccagaaaataaagggcactgatatttcctataatttatcttttattcttaattatttttaaagatattcccccatatttagcctttgaaagcactggccccattgatgcatgtttctttatttctctggtggcgttgtattttaaaacttagcctatcttaatttggaagttaatggacgtgatggagaagtgagctcaaataagccttttccataagccctttcaaagcctattcctgcccttgacttttgcagcatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatgtaagtgactcctgtggttttcaatttaatcttatcatcgaggcacaacattaatatgttaaaggccataacccttaaaagcattaatatctgattacactatgtgataagaacttcagtagatagttatttattttaaataattgtcagtcataaagtagactgagaaatagaaaagtttcttctgcattcctgtagtttaactagattctcgactg

SEQ ID NO: 132596 - DNA, 1047 bp, Homo sapiens
aatagcaccaaactccagttttagaacatctccatcacacccaagagttgtgcccatttgcagtcgaccctgcttctacccccatcttcaggcagccactaatttgtgagtaatgttttaaattacaaaaattgagatattttagttaagtggaaatcattatagtttcattgataaatagcactggcatcattagccatccgtcttgaaaaatatcccaactaacgtgctcacctccatgaaacctctctccacgtccttaccactctgataaggtagctccagcatctgtactttgttcacttcaggctctcaccatatccaagttttaaggggctatcccagcaacacattaggactagctccaggtgttgaatattgagtcacaggagagttctcccatgccaataaattatccaattcagccttaaatttctctcatccatccccatttcaacactcttgagattcactcccacgagtctgcccctagtctctgccagtacttatgagcctgctcttcctacagtgcatagactgtttcccccagagcaggcactgtgtttttctgctctggatgtactaagctatgtcgctttatcagcccagaggcagcaggggctgaccttgggaagcaggacccttaggtgaagactttgcaaggtcttcaagcaaggggaggctgctggtcctctagcaaagtggaggaaggatttgcctgtgtcagatgggatgattcaggagaatccaagagttgaagattctgagccttgtccacctagacaggtccatgacagtttgtgggtcccactgttccttgctctgacataagagaactgttgagattgtacattctattttcttttcctccttcttcttcttctttttttttttttttttttttttttgagacagatgtcttactgtgtcatccaggctggattgcagtgccatgatcttggctcactgcaacctctgcctcccaggttcaagtgatccttccacctcagcctccagagtcgctgagactacaggcatgcactacca

SEQ ID NO: 132597 - DNA, 1071 bp, Homo sapiens
tgatggtatgctatgacccttcgtaggagaaccccagtattgagtgggatcgaattttccacccaagagttggaattaagtggctttggaaagaactgtgatctgaatttgtttgcaaggcttgtgcctacaactccctcctgaaacctcagggatcttatgtcatcaattatcacctgtctcccctctctctgacccacttcctctgctggttttcctcttcaatatgtaaatacattcaaatgtcccacatcttgaaatgataccttcaccatgcgttccctaactgtccctcaatctttctcctcccttgcatagccatcttcttgaacgaagcatctactgctcatatccatttcatctctccaacttaactggcttctgcttctgtactcagcagtccacagaactgtcctggttaaaggcaccaaagtgtggtttcctgaccctgtttcactgaagtgggaagtttccatctggaaactttgttactttgccattggagacgcttcattctttgctttctccctctgctgttttatagtctcttgtctctgtgtagctttcctttctgtctgtctgtgggtattggtcattgtgagggcctctctccacacccttttcttgtctccttctctgtatatatgttccccaaagagtgaccaggtcgacttccataacttcaattaccatgtacacattaatatgttgaaaatctttctcttaagtccagattctctgattttcatatatgaaattcagcttctttaaattcagtgtgtaaacagaattcatcatttccattgtgtcctaaatctaattctcctcctcaattgtgaatatcaagaagtgacccatctacctacctcattatttaagccccaaactttggattcattcttgactcctcccttcatctcatcttctagttctcacacgaatgaccaaactctgtccattcaactttctaattattttttagatctctcccttttgttttattcttaggtcagaccctaatctctgcctttctcccccatcctcgcttataccattatagatatcctactt

SEQ ID NO: 132598 - DNA, 1029 bp, Homo sapiens
gagatgcagctaaagcagtacttaatgagaaatgtatacttctaaaagcttagaaaagaaaaatgatctacaattgattatctaaacctccaccttaggaagctaggaaaagaggaaaggagataatacagataagagcacaataaatgaaccagagaacaaaagaatagaaaaaaagtcaatgaaaccagcagctcattctttgacaacatcaacaaaattggtaaaacatcaagctagattgatcaagaaaaggagaagatgtaaattacaaaatcagtcagttctcatatactctgttttgaaatgtaaacctttctaatgcaatcgatatactttgagcatagtatactttcacatatatttatacacagctttgtacacaacaaacgctaggtaagtgcagaaaactatacccagctgaaccaagccacgtaggaatacacaaagtgcacacatgtacacacctcagacatctaccagctaccccatttcactgcctgtgtggcgagccatgcccaaccacatctagcgctggaaattccagccgacttcagatgaccctcccttccaccacttcacagtaactcataagctgcaacaatcctgatgtctaactccacaaacaaatttcaggtttttttttttccttttttttttaaatcttttaaaaaaaattttattattatactttaagttttagggtacatgtgcccattgtgcaggttagttacatatgtatacatgtgccacgctggtgcgctgcacccactaactcgtcatctagcattaggtgtatctcccaatgctatccctcccccatccccccaccccacaacagtccccagagtgtgatgttccccttcctgtgtccatgtgatctcattgttcaattcccacctatgagtgagaatatgcggtgtttggttttttgttcttgcaatagtttactgaaaatgatgatttccaatttcatccatgtccctacaaaggacatgaactcatcattttttatggctgcatagtatt

SEQ ID NO: 132599 - DNA, 1066 bp, Homo sapiens
ttaaaactacttttgtgtccagaaagttattctactctcacacttgttgcttattttgcatgacatagactcctaggttgaaaatagttttctccctgcttctactcccctccctcaaattttggtggcatcaccgcgttctcttttgacatctcatgttgctattgaggaatccagttccattttaaatctagatcctgtgtcttcagcctgcattttttggtctctggaaacttctagaatgttcattttatatctggcactctaaagcaaaggtcggcaaactttttctgtaaagggaaatagtgtaaatgttttaggctttgtgggctatacggtctttgtcctaacttctcaactctgcctttatagcatgaaagaagcctagacagttgtaaacaaatgattgtgactgtgttccaataaactatttacaaaaccaggcaagagggcggatttggcccatgggccatcgtttgcagacccctgtgctaaagtttcataatgctgtgccttgctgtgggttatttaaattcaccatgctaggttctttgtgggctttcagtagatctgtctctttcaatttagggaatatttattttcatatatcctcaataatttcctttccaacattttatgtgtttgctttttgtaaaactcctattagttatttggcctcttgggttgttcatcatctcttaaaatcttttgtatttatttgtttgttatactttctaaaggattttctcaattttattttcaacagagttaaatttacgtagattttgaaccagtattcctagctggggacaaacttcactcatctccctcttctttcaacagcaccaggtacctccaagtctgaagccctacaggccacatggtttggtgactccttgttttatctctctgcccgcacaattctgctaagtcagttacaattcctccaccagttttccatattccaaaaatttattttcatctttcgcctgttgttgtgtcctttccaattcttttgtcatctttatttatttactgttattttagcagacatttgggagagaaa

SEQ ID NO: 132600 - DNA, 1024 bp, Homo sapiens
atatgcagtgaataaaactgtcttgggattggttttacagtgaatgtatacattattaattacagcagcacctatgttcgtatgttatttaaagaaatattagctactatagtagaaaaatcctgaaatctcagagttttaacaaaatttctcggtcacataaagtccaattggcagggctgaagtgggggtaggtgctcttcaagcacctggtttgatggagtcatccacctggtttgactggtttgatggagtctctgccgtctttaacacatagcttccaaggtcaccctggtgcctgtatctggatgacatatgggggaagggaatgttgagaattgcacgggtaagttttcttgggggtagtcctgggagtggaatgcatcacttctgcccacgtctactttttgtattcttaactaggctcaaatctggtagggttccattccctcttgtccctccacaagaaatcagtttcatggtcatacctcccagcaagggaggctgggaggatagctgtgagcttaggaggtcacacaaactggtctctggcacattgtgcttggagagtcataaatatatgtgcaagtgtgtggctgatgtctggatacatatggattcacaaatgactttcaagaatatagaaaccctaaagaattccaagacccagagggtggaaaccgctaaaaataggagtgtgagttttgtttgtggagaagtttttgcctgcttcatcattttcaacattgtaaggtaagatatggtggagtggggttgaggggaaccagttagaaatgcactatgtgcatcttgactgaacaaagctatttgttgccctacagtagtgaatcttcccaggctcttgtgtagctgtattcataatatgcgctgattagtatcttgtcagctgaatggaagcccaggtggggttctggttggactgctggcggcattgtccttaataaaatggggcctttcaaccaatgtgctattttcgttcccacatcacctgataagtcctagt

SEQ ID NO: 132601 - DNA, 1028 bp, Homo sapiens
atttttgtgtaatttttgtacttttaatagaggcggggtttcaccacgttggccaggctggtctcgaactcctggactcaagccatccatctgacttggcctcccaaagtgccgggcttacaggcatgagccaccatgcccagccactaccatgttttagcaactataatttaaatctgtacgctatgagataataagtcttatctggaaagcagtttctctctcttcctcctttccctcctcctcctcctcctcctcctcctcctcctcctccttcttcagaatgtcctagctttatttggaccttgactctttcatatgaagtttataatcattttgtcaatttccatagttttttttttttggaatcacactgactgtttacattcatataggtaaaaatgacatgatactgcaaaccaaagctgcccatggagaaagctttgtcacatgacacattgtattgctaaaagttcaggttcttactgctgctgttgatgctcagctgtcacaaggacatttgttcatttacttgttgatgctacaacccttaattaaacaaaagcatgctttatgcctggtggataggctatcctataactaccccaccagaaatgctacccttagagatttcacactctattggcagaacgttgggagatttcactgagaagggaacaactgagcttgtccctatttattaaaaagatttaagtttccaaggggagaatagaaaactagctttacaaaagcaaagtgcttttgacccagaaatttcatttgtggtaatttgtcctacagatatatgtgttcacaaagacttacacatgaggatgttcattcatcgtcgttcctaaaagcaaaataataaaaacaatcaaaatgccaatcactatgggactggtttaatactctgaaaactgccacaagtgttaagtctttatgtactgatttagaaacatataacattaaatttgaaaagaataaccttaaagctcagaatcatacatggggaaagaaaaaggata

SEQ ID NO: 132602 - DNA, 1007 bp, Homo sapiens
ataaaagacttaaagaaaacagcagaaaattccagagtaaaccagcttatgcttgggaagcccgggtgactgtaactatttcagtaggtttgggtgctgacccacctgaaggtctgtagcatgactcagttttcctgctctctctctttctttggacttctggaaagccttctctgtatgtagcattatttctgccacattttattgatcatgcaagtcactaaggccagcttaggttcaagcaattagaagccatttcaatggtagaatggcaaagaatttgcagccattgttaatctgactcagatgtataagaagtttgttaatagcaattgtctctggagatgagctcagggggtctgggatattagatagacttatatttcattggggctattgccctgcccctggtttgaatatgaaagttaagtatttcattcactgctgttctttcctcattagcttgcaagaattaaaatcatcctactttggtgcctgttaattgttactgctaacatgtataatgaaatggcatagctatctcatgattcaggatatatacatattttcctagattttcatgatttagaaaacatggaattagaaacgctccggtattgtcaattttaaataagaaaactgatattagaaagattaattgaattaaaaaacggatggatatagatataaacttattttaaagatcaataaaatgttctaaaagaactcacaaacccacgtaccctcagtctgagaaacgcagctggagaatcagagcctagaagagcccattggagttgactccccagaattctgtccagaaaccctttctgacttccagagactgctgctgttgcttcttcccttagaccctattagcagcttcctattactgctaatcagcatggcttggaagccaatggactcgacagatgccaccaccaaggcatggacatcatcattgccttatagctttttgggcttctgatacctccaccttcaagctt

SEQ ID NO: 132603 - DNA, 1048 bp, Homo sapiens
tctatgttaattactaactgatgtgctatatttaggctgatcttttaaaaaatttaaagcaatcacatcgcttattattttaactttattcattagagacaaaccaaaccaaccaagtcctggtaaagatttctgtggtatccttaaagaaagttccatcatacatgataaattgggatattcagagttttgacaattcctatgactaaaaggagattattttcagactttcaattcaattgggcttgaataattgattctgtgagctggaggccccaagggcatgtaagtacccatccaagtaagtgtggttgactgtttctccaggttatgaggatgctagattgctttggtctgctcagaactctcagatatcccagtcctctgggcgatgggattctacatcccagaagtaaagccaggcagcttttttgctgatgatggcacatctactagccaggaactatggcctgttccaatcacttgggtcttctctactttgttcttctcctgccaaattttgaactagtgaaataaagcaaacaagcaaacgaatctcctgtttctgagtaccagtgcagtggaataaaagttgtttgtcacattgttgcaaatatggtccacatattttagaaatgttgaggcccaccaggagcttcttggatagatccagattaagagaggtctgggaaaccttctgaatactcatcaatgaatacctgaaggcacagttcttgctttaaggaaacaagcccataggaaacacagagaagaaataagtaagtatagtaagtgctatgtcagagtgttagtatagaaaaggtttacttgctcatttactttttttaactttttactgtaaaataaaacaagtacaaaaaccacagaaatcaaatatatgacttaatgaagttgaaggtgaacaccacccaagcgaagaaacaggactttgctacgcactcagaagcctcttcatgtgccgcattccgatcacagaccctcccttctgcaataagtaccaccattctgccctttatagtaacttttt

SEQ ID NO: 132604 - DNA, 1049 bp, Homo sapiens
taactctatgtggttagttttctaaagttttgttaatgtgttaagagaatttgatattatgtaattgactagccttgtgatttcaatttaaaatgtgtaaatagttttagaatttatgatttttaaatggaaatacataaggtgatttggctacatgtatagacagaattggactgttaaaataacttgagagacacaatatttatgtctaattgattagttttattgggattaataacctgggaacattttgtttgttagtgaggcttttgaagttaaaaaaaaaatccagcacataaacttgtaaaatgtagtgtaaaatgtgtataaaaggggatgtttaattatcttattttttaaatgagaccaaatgttaatcaaatcctcccttgaaggcagtttaaaaaatacattacttggtttgtaaatagataatgagattaataagttaaatttaagtgatttaataagagatttataaaataagttagatttaaggaatgtaagactttacaatttatttaattgaaaattattttccaagtagccacagatgggatttttgtgtgtgtgtttaaggcccattctcaagaataccaaaaacttactttagcaattagcagattcttgtgatttttctttctttttcaaaattaaaatagaatttttcctaattaaaaaagggacacataattcagagtacaaaaagatgtaaggaatgaagtaaatttcatactctcagcacccagattatgattgttagcagttttgtgtatccttcccaatgactagctggctgactaatttatctctctgtggtctatttactgatgtttgattaactactaaatgggacaatattatacatgcttttttctagccttcttttttctttactagtttcttttgggcacttttgtcttataaattttaactgtaaggattgtattgtatcccattatagggatttatatgaagtatgtaccaattgacaagttatttccaaatttttctgttataaatattatggtgaggaacatacttaattt

SEQ ID NO: 132605 - DNA, 1074 bp, Homo sapiens
tgctactaagaaaaatgctgcattattttttgctggcaaaagaagggcaactagtgaaatgcaaggcaagtagcttgaagtaaagttataatgaactgaaagacttagtaaggaggaaattgcattttttggcaaaaggaaattaggtgctcccttttattttgggttaattgggaatagtttggtctgaactagagagaaaagtggagtaacattttaatttacttcagctttattattttaaaagtcacagtaatttgttttaattctgacttctttattctgtgaattccttgccaaattgttttttaacagaaggcattcaagaggaagccctgacaagattgcttaaattaatagagaagatacatttataattagtatttatattataggagttagagtgctaaaaacagacgtactgtattatttatggcatactggataaaaatgctggtgctggaaatagaggatccaggttcaaatcctggctctgctacctcctggactttgagcactgacacttattctttctctgcctcaatttcctcatctctaaaatgacacagtccgtatagctaggccatacagctgttgtgatgaggactaacgtaatctaagctccttagaatcgtgtctagctcaaagcaagtgctttataaatgtgggttgttattactcagtaaacttcaggcttttaatactactaatatttttatcattccctgtcttgtggataaacttgtctcatctatattaaattatcacatcctaacttaccagtgttcaaagagtgtttttaattttttttttttcaaaatattttgagagctcccatcatctgtagttttcttccactctccacccacctcctgccaccaagccttcattaaaagaacaaccgctgtattaattatcataaggaacacagaccttgactggcttttcacttgtgtgcttttacttccttggcacacaaacctggatgttagagagaagatgggtttggggatagcagagaccttttcagtataaggtgagggtaagactgagctacaatgttatattcagtta

SEQ ID NO: 132606 - DNA, 1042 bp, Homo sapiens
taggcaaatttagcaagaaagaaaaaaatctgtagagatggttttgactaaaacttggcattatgttttaagtctgtctacaaagatacccattcatgatcaatgaatgcttattaaattagatgaatgggtaggtcccagagggaatttcattgcccaaatacaaaagcactgcccttccatagaaattctcacatatagtgataggccatagctttcggcagtgaatttaactctattttaccctcacattgtctagtcatcatttccatggatcaggctatctggcttgaaaaaaaagccttgagttgttttctttaagaaaaagttgtgtggcctttttctactctaagtcctgatactcacttggtgcctttattttctgtgtgacagtgacacaacaaagttccaatatattaacattttcatctcaattgacaattttggagcaaaaaaaatttccctgttctaaagagacagagatagacagagggagacagaaagggtaaacactgagatattgaagaagccgtttgtaattaaaatataaagtactggtttctctgggaggaaggaatctgttcctagccattgtggaaagaattgtcttgttcctggatgatatattttgttcttttttagttttctaatctgtgaaagcaaaaccacagtgggattttaagggaatggcaagttgaggctaaattgtgagaggcatatataataaaggaaattatgagtaaaaagtactagttaagatataggcttgagtgctgtaatgcagagactcaaaacaagagcgacttaaataaggcagcaagttgtttcagtcttgctactaggcatgatttctttaccacaggccttttctagcttgttggtctgccacctttaatgcatggctttcatctagctgttcaaggtggctgttccagcattgctcatcccacatacatttcagtcagcaggaagaaaagtaaagaggcatataagccctttcctgttaaggacatgaccaaaaagttgcattatcaaccacttc

SEQ ID NO: 132607 - DNA, 1081 bp, Homo sapiens
gtagctcatgtctgtaatcctggtgaattgggaggctgaaatgggaggattgcttgaggccaggagttcaagaccagcctgaggccaggagttcaagacatagtaagagactgtctctcttaaaaaaacgtttttaaaaaagttagttgggcatggtggtgtctgcctatagtttcagcgacttggaaggctgagttagggagatcacttgagcccaggagttcaaggttgcagtgagctatgctcatgccactgaactccagcttgggcaggagagcaagagcccactattaaacaaattgtaaaaggttcatgtgtatagccttctattttgtaacagttaactaagggcagactttagaaaccaagaggaaaatactgtattctgaaatgaataacttaaatctctttcctcttttatctaaatatgtttgtcaagcattcattttcagttttggaagaggacacagagacattcattgttcaaaacaggcataattcagtgttcttttctgttagcgaagcgaatgcagggaagggccatgttgactaggacccgtcagaatggcgggcagcccatcacccaggatgggacagtgatgcttactgtataccacgaggaagagctcctggatagttcccacaggcagcctacttcagttttgttcatttaaaccaataattggggaaactacactagaatcatcttgtgagtatctgtccatgcataaaagtctttgggctgagtgatttggctgtcccaaaacaccctcctttcttgtggcctctgcctcttgctgttgcagagacgtttggctctgcacctcctttatgagtgggtgttctgcaccagagccagcttccaatttccgtgccggtttagaatcaacaaccacaggactcacattttatcccccactgcctcccttctctcccctcattcatggcaccatgcatatttttatgaatcccctctcttttttcaaagttaaaaaaataaaagaaacagggaaacacagatgctcctactgttgctccatatggaaacccactttctaagcaagcaaattgtagatctggg

SEQ ID NO: 132608 - DNA, 1028 bp, Homo sapiens
ttaatattttatgcatttgtgagtcaacttttaaaatatcaatgatttatctggtgatacaatgccaacatttaaaccaaaaacatttctagttgtaccttacttataaagatgacttgatatcttgaactgatcattcttctggaaaaaaagaaaacaacattgctcagcttgttaatatttttggcagtttgcagctttgagtgggggtggactttgataagtctagtctatcagaattagtaagtggcagttactgtctcaaggtggaaaactgctcttttagttctgaagattgtagagaagataccatcaagtctagtgtgtatgctatgtatccccaaatataatattcagagtaattgttttacatgtagtaatactttattgtgaatgagtatctttttttcaagcttgtaacacgaataattctttttcattgtttttttctgccttatattactctcactttataaacattcccaatctttaagaacagttaactatcctacagctgaccttacatacaagagtactcagtagtcctattaaacatttaacaagtcttcatgaaaattgtatgcaggtggatcagggcaatactttaaaatcactcgagctgaatgacacatgtttgcagatttccatgggcccagtgcatgttgtttggccaagctcatctttttaaagaaactgaaatcaggaacatagtttttaaaattagaaaatgacttgctttctcattttgtttgtacctctcccaaaccaaggaacaaaaattgaatcctttatttttgtctatttatattttgattattattataattaatagtttagactttaaagattattaaacaagaatatgtaagcgtatctgcattgttttaaacaattgttttagcacagtgaagaaaagctatgtaactgtgaaaatactagcgtatgcttgtcctggataaactcaggtaaacattttatatgcacttatgatgtgaggacaaggttaagattgatgaagagtctttgtt

SEQ ID NO: 132609 - DNA, 1005 bp, Homo sapiens
acctggccacagagataacctgtaatcactggattttgagattgtacacccgtcagttaagaggcaccaatttagcaggggatgttcctggtatccattggaggagccacatgccagaatgttctagtggttctcgcattaatatgtatttgcgtgcattgtttttgattgctctaatcagccttgaaatgaatccaagagctttctgcaactaattgcacagtgcccaatccctccaggctctgtctgaaggcttaattcagctaccttatctctctaggtatgcggagaccaaagccaaggggctgttttcctgcgggaatttacactgattcgaagagagagcctccatgaagatttcctgtctgacctcttgaatagtcacaaaactgaagactcggtacagtgtcgcttcttctacttattcacagaaaacactgaggttcaatggctgattctgacttgtggtggtggtttttagcaaatctgaagaggtttggatggtattttctcacatctgtgagaggagggggaggcaaagtgtagggcagtggacagactgtatagggcaactttctgacttttcctgggtctggcaagatttaaacattttactcaagcgttaaagtttgtttggggcagcatgtggaggattcacattaagacactgatgttttgccagcgagtctgaacatgaaatggtaataatttaaataagtgaaggaataaggagatttatatgtaaagcccagattgttttatgggtcagtggaaattccactgtcttccaatcctggcttctttgtagatattcttacttcaaagtgctagtgatatttgttttatgaaagtttgtttctctggtggtggttttaggggaaaacactctagaaaatgagctctcaaatgaaaacaatagtacagttgactggagatgtcaagattacaggcctttctctgcttgcgaatcaaactgtgatttgtaatttggacttctttgtgaga

SEQ ID NO: 132610 - DNA, 1052 bp, Homo sapiens
acaggtactaagcatttggtaatgtaaagcctcaaaatatggtccacaaagcaatgagcagcagtatcaccattacctggcagcctgttacaaatgcagaatctggggcctattctagacctactgaatcagaatctgcattaaccagaccccaggtgattcatatgtacagtaaagtttcaggagcactgttgtcaattttcataaaaaggtattcaaaagtagaggaatgtaacatttttcctccatacctgagcttggcctcgtcacaggccctcaagttctaactggctggaagaaaaactacttttcatttgtagcctcaaggtaggacagtgtctttcagtttaaaatagtcttgctgtggcaaagatctgattaattcaggatctaaccttagtccaaggggacagtcaaccaggatgcttccatcatctgagaagcctcacatctgttattcattgctcagtaacaaacaaccctgaaacacagtggcttaaagtaattatcactttaaaaaattttctgatgattctgggggtcagctgggcagttctggtctgagttggcttggctgatctctgtgggtagctgatgaccccatgatcagagaactatttctctgtcctaggcctaccttttgcaaatgaaaggccttaaacacgtactcaaatgccttaaacatatactcaaaggaaaaaagtctttaacccggggtgacagtgtcctctccttaccactttctccacagccaaaagcagtgtctacagaaaactccctgaagagtcagggaaagacaatagctacaagaaagtatagaagactttgcgacatttgtaatttaagttaccttatttaataactcccttccctcacaaaaccccacagtcctataatatagaattaatagattaggaaagttaatcttagtgcatttcagaaactctcaaagggatggtatgtacatggttgggccagaaatggatcctagtctagctgtccccttctacctcatttaaagaaatgtctaaggagagaacacagggtttact

SEQ ID NO: 132611 - DNA, 1035 bp, Homo sapiens
ggctgagaagtttaaatcctatttgcttttccttagccctgctctcccttggagggcagcaccgaccaaatgacttgcaggccactaggtggcgctcccttttaccacccagtctatgcatgacagcaaagccagctgtcaggagctccgtcttcttaaaacgtttaaagataaaagaaaaatctgtaaggttcttctccttatcatagcagctaaaggtatgttactcaactaattgtgaaatcctgtagtcaatatcatctgagactataaaagcaaatatctagcacatttgagagactcaataaatattaaagaaatatacaactaaattgaggacccatgattttttttccttctttttgaagacagaaaactatacatccaactgaactgcttgtttgcagagtcatttgaaaagccagtgcctcccagctttgaattttaataactccctttgaaagtctgcatagaagatacgacttaacctttacaagtccacatcaatcctcttaataaacacctggcaaaatgttagagaatgaaagttgttttcttttttctctctttctctgaaattttcctcaaactttggaaatctcactacaggaaaatagaagattggagtctgctatgtagataaaaatatacacttatcacacatcctaagttactttgatgtataacattccctttaaagtttaaaccaaactctttgatacaatggctcttttagaataaagctctcgtttgtcttcagaagatattttgaatttcatctatggagagtgttaaaggacaggaaacttttaatacacaaggtaataacaaaaagccacctgctcttctatagccaaaactttattcacaattgttaggtgtgttagaataataaccattatcatccagccatcccaaagtagccatttagtggatttgggttttcatttggcattaaaaattattattattacaacatatattttgccttttaaatgtctgcacacttgtgcagcaccaaaacttagttaaaaa

SEQ ID NO: 132612 - DNA, 1050 bp, Homo sapiens
tgtatctatgtacttatgtaagaaaatatagataatttctcatacatatatgagataaagtttaatttataaatcacattgagaaattagcaaaaataataaaatagaattttaacatttaatattattgatagaatttttctaacaatatgctgtaaaaacctctattgtactattataactctattgtaactatgcagttataactctatgctattataactctactataacaacatgctgtaataaaacttaagtgaatgtgatctctctttcattctctcaaaatatcttattgtactgtgctcacctgttctcaaactgtgggtgactgtgtgtaactaaaaccccagaaagcaaaaccacagacaagggggactactgtatataagtctgaatttcaagcgaggaggtctgagttgcaaatagaaattgaaacactgattttttttttccgagaacaaaatatagtacattggattttatcgatggatatttgctattcagtgctttcatcttaactttgaataaaagatacagaaagccaagtaacaaagaccaaaatatgtaaaagaggcagcccaccatctacttaggtgtgctaaaagattcgaaagctttagaggatatattttccagaacatttatccatttattatagagcagccttttatggtaatcttttctggttttactgtcagtaaattgaggattcctaatattttgagggtaaaacaactggtaacattttctaacatcatccagtagctggtaaatttccacgtatgtttttatcataacgtggttatccgcagttgttggaggataaagtagatgccttgctaggcagttctaattgcgttttcttgcatagtaactgttatggagagtgagtgattaggacagtgtggaggggcagtatggggtttaagtacatttctaagagaggaaaattaagtcagaagcatggatttttttttttttttcggttactacagtacatgtagtcatctgaatatgatttccaaggttcttgatactatcagatac

SEQ ID NO: 132613 - DNA, 1026 bp, Homo sapiens
ggagacagggtcaagtttgcaaaagctcagatctatttcagcccctttggatttgacaacagcatataggaagtaagatcacaactcaaattccattgaaggaatatactctccttgagaggtcagagcagatggagttccattggataattttttttttttaacttccctctaccctgctaaagtagccaatggaataccagcaagcatggttggctctttgggaaatgacctctggtagggttctgttagaaatgaaaaatacttttctgaaattgctgtggagtagcaaatcatctcctctgcattctactcaaattaaagagaaatgtttagaattctgaaaacatccttccttagctctccaactccaggactactgatttttcagagttaattcaggaaccactttcaaatatatacaatcgagtaactatcattaaatttatctgtcagcacaaaatagagatttctcatagtcattcttctaaaacctaaggtgctgggaaagacatattttcagggactgggacaagttttctccttttttctcctttggagttcctgcccatatgaatgtatcaatatgccagttgaatgtaatgaaagaaagtgggcattcagcaacccatcttagtataagggatattcaaaatttatttattttaatggagaagaatccctgaatctaaatgaataagccaaaagcaaatcagttacgatctttttaaaaggaaaagtagtcttctggaagttgggaatttaaattcttattaatcagaattaacaatgaaccaatcaaacaggagtcacaaaatcctaagagaaaagtgagctggctgatttttaatgatccccaaatttccagagccagatgaaaggtgagctgctggatatagtgatgggactgagttggaagtagctggaggtagcaatttggctactctttctaactctagccttgtgggttcaggataatcagttacattttgctgaatcactgcactattatgacaatggaaaaat

SEQ ID NO: 132614 - DNA, 1053 bp, Homo sapiens
gtagtcttttcctttaagaaaggagaaagagtactttgatcttgctctatttccattgtctgtatttgtattaggcaattgtaatgtcttttaataaaaagatgattttttaaaaatcaccagcaaatggcagccatttgataaacttctcctacttctctttatccttctggcacattctaccatggtttttctccactttcctgtttttgctttgttcctctgaggcttgataacataagggaaaaaaaaaaaaaacttggatataagttcagaaagaaagtgagttcaatgtggggaatctgagtgccagaagtttgaagagagcatgtggcgagctgacagtgccttttggcagaagacaggggagagatctggcaggactcctccaggtgtggagaactgctcacctggcttctccactgggccctgcagagcagcctcatgttccctgccagtgggtcgcctcacagtctgtaaatataagatggaagattcttccagagtagagaaacataagtgaggcagtttgttcagcatctgctatagattgtggtgaggtgcatgcatatggtgggctttattgatatcaatcattttgtcatgagacatcatcagtgctaaggtaaacgaatcaattccattttgtcagtatgtataatcatcaggttgtgtattatataatttacctactgtcggtcttgaatagggcacttttcattgaggtatttatttgcagacttggagatgatatagggctctcaatttgcttcagtttcttccttaggagcttctccatctttgttttgtgattcaggccctagaggtcacccatccctccctaacagtagggtaagaggaatgtctatctgagcacagtagtctagatcctctatgagaacaagaaggtatgggcatgagaataaagaagcacctttaccattaaaaacatgctcccaggacactatacagccatcactgcacacatgcatgacatttccttttgtacctaacagtaattcctagattcctagataatgaacactgattcag

SEQ ID NO: 132615 - DNA, 1054 bp, Homo sapiens
tttgtagagatgtggttttgccatgttgcccacgcttgtcttgaactcctgaactgaagagatccacctgcctcggcctcccaaagtgctgggattgcatgggtaagccactgcacctggcctgttcagacatatttttttttaacagtgtacataattatcctatcattggaaggatttaggttaaataagataatcccaattgttactcaatttctctgaaccttaatattatcatcctatctttaggagaatttagtttaaattagtgaatctcagaagttacctgacttctctgatcttcagtttcctcatttgtaaaacagggaaaacaaaacttgccttatactattgtcgtgactagatataaatatagacatgaatctagatatagggatgtatagcctggaacacagtaagtattctgtaaacattattttcctctctctaccccaaatctcttaaaggacagggattgaaaaactattttttttttaaatagtgtttcaactctccaaggcccctagcacattatctgttgaatgagaaaaaagaatcatatgctcccaattccttccctggagaggttacattatcgagttctctacaaagttgaatattccactcatgacaaaatcttatagctgtttttaatgtcatacattgttgaatttcagagagctaagaatttgtggtatataagaacaacaacagaaaaaagtgtaaggggaatatagaaaaggaaccaaaaaaaaaaaaaaaaaagttaagattaggcctacagagcttctttggtttgtttgttttttgagatggagtctcactttgttacccaggctagagtgcagtagcatgattgtgatcttgactcactgcaacctccgccccctgggttcaagtgattctcctgcctcagcctcaagtagctgggattacagacttctgccactgcagcccggctaatttttgtatttttagtagagacggggtttcaccatcttggccaggcaggtcttgaactcctgaccttgtgatccacccacctcggcctccc

SEQ ID NO: 132616 - DNA, 1035 bp, Homo sapiens
tctgatagaaggaaacaacttagttttcttgccagcacaaaagaaaacagagcttgccattggaagaatgatcagttgaccaagatgatggataattagtttgtttttctcttttactgaggatagcctatataagtcaatgactgtatccaaactattttaaaaacaatctatagccaccaacttatgatacattggcctcttaggtggggttattttattaattacataataaagattgtattaattatataataaagattttctatgaccttgaaatatcatatgtcctcataaggtccaggatgcagctagctcaacaccctcagattaaacatttcctgggtaacaaacgggctttccaaacatatgtcagaaccaaaaatcgctctctgctcaggaaattataagtaacatcatttgggatgtggcttgaaaaggaggtatctaaatagggctcaccttgacaatgaaatctgctgtgagtggtccagccattctcagtatctctttgtctggaaatttctggaagtccacactagaattgtccacaaggaaagttcctgtggagctgagactgttttcacctttagtcccctggagggttttggtttccagatctatatgatcaaacacgtgaagatgagagaaagatgttcctagggcaaccacaggcaagcacatttcatgcaacaatgtttagagctaggtaagggagacacatcattctttatatagctgacaaaattgaaattgtgatatcaacaaactatacaggcactgctgagtcacataggaatttatgctggagttgaaattatttcaaaagtcattagccaggcattcaagggttcctgtcaaaaaaatctttgactctccagatgatgttatttgggcatcccgctttactgcaaccctattcctttgactaaaccaattctcatatgtctctttttgacttcaatcttgatggccctcagcctaggataccctccagttttctttttgctctacaagatccagggtgtatctctg

SEQ ID NO: 132617 - DNA, 1005 bp, Homo sapiens
tgtaaggtgctgggggacctgcccggcattcaggtctgaaacagaaggggaaaagtcaaaggtgagattggaaaggtgggcacaatccagctaaaccagagtagcagatactgtggctatggatttgtcttctaacctagaggcaatgagtgaaggtgaggggttatgaaggattaggaaagggattttaggaaacgcactctgaaggtaacataggcaatgaaatcagaggctggtaaactagctcagggtccatggtactagttcagatgagaaaaagtaaaggcctgcgctaacgcagtggcagcaaggatggaggagaaaaaccaatgttgagagatagtttggatgaagtctgaccggtggcatatagaagggaaaatcagggtgaatcaaaggtttctgatttgcctgggcagacagtgtcttcatttataagattaaaaaaataaagatgataaagcaggtttctggggctcaagttaaacttacgcatgtcgggcttgttgtgcctatgggttattcaagcagtgatgtgcagaaggcaactggatagatgtaacacatttgacaatgctgtgagctgttccaatgtaagcaatattgcttgaatccagttatataatttcagtatgtgtattaactctcacaaggccactagggaaattactatagtatacttggtctatttaatggtactccaagggcttcaaagaataaagacatctttcacttctttactggattttcttgcttaacagaaatcatttaactacctacagcatcatttctattgtgagctacctcggatggcttgtagcttcttgctcacgttcatgtggctggcgtctggactggattaaaaagaactaccatgcagatggagacggaggacagtattctggaacctttctccctctaaccttactgcctattgcattttcctatatgcattcttacttccagctgccatggggtcatcaagctttagcttaaatcaaatgt

SEQ ID NO: 132618 - DNA, 1023 bp, Homo sapiens
tcctggctaacacggggaaaccccgtccgtactaaaaatacaaaaaattagccgggcgtggtggcgggcgcctgcagtcccagctactcaggaggctgaggcaggagaatggcgtgaactcgggaggcggagcttgcagcgagccgagatggcgccactgcactccagcctgggcgacagtgcgagactctgtctcaaaaaaaaaaaaaaaaaaagactgtttcctctaatgggactttacagacagaaaatgtctttggcatcttggcggaggtatctgccttacaggagggcctcgagattccactctgttcagaagaaaggatctggtccaagacagcacaaaatttcttccatgctgaagtaactctactcttataatacccaagtatttcctcacagaagccaacagtttttagactaagtgaacaccattacctcctccacaggttgctgagcaaggaaagaaatccgtctccctccatcggtggatgatgggttgatagaagatgaactggactgtactgtcagcggagcccgagttacgaatctgcaggagtcaacaggaaagtagaagtaatgtgacagtgcggtgctttctggtcccttgcagcttcgaacaagagtatatggtagtgctgatggttttaggctgtgtgagggactgcactgcgggagaagtggcaatggcagtatcatgtatcctaccattttaccagtgaatggtccttgcataagctttcactatcattatcttctgagttctgttgccacagagcaagggagaacaatatctcaatttgtgatttcactatcatcttattccaagcctgtattccctttccgtcctttatttccaacctctttggtataatagataaaattatgtggattttaaaatgtagattcagaaatagacaatttgttctaagaaaattatatactgcagaaaataaaagatactggttttggttaagaaaaaagacgagttgaagaattaaataacacttcccattcagagac

SEQ ID NO: 132619 - DNA, 1048 bp, Homo sapiens
atgtcattttgaagaataaaaaaattaaggggcagctttgagacagatgctgacttcaataatttttacaggactctggtcaaacactgccttatcatgccatcagctactcagcagtgaagcgctggagcattttggaactgttcctaggttagagaaacccaaaggagagcttttgtcttttttgtctactttttaaaactcaacatccataaaattttgggaaaaaaggaagaaagactactcactccacgtagcagatacaaataaagccaaattattcctttcagaaatgaaaagtgaggatatgacacttgtttcagaccatctttctttctctttgcttttctgatctaaatgaacagaaaatgatttgaaaatttgcttttccttgcaaatagtctacttaaaaggccacatcccagggactcagatgccatcacagcttacaatgctatcactgcatttgtagttctcagcttaatattggaatgtagtttaaatgcataacattttccctgactttgataaagatttaaaatattggaaactcaatacttttcatgtaccatttcttctttacatggaatgaaattagtttatcttgtaattttgtgaggtttctttcccttaattcaacatgtttggcaaagctttccaatgaaaagttcagttcattaaaaatgaccttaatggacttaacatatattggtggtgacagggtgcatactttattttggcacacaaggatcccattaatttgtctttgtcactctctagggctctgctaagcgacagttcagatttagctttctgaaagtagccacagaacgagcaactgcggtgacagagggagggactgataaatttagaacttcttggtttgcaatcaaggaatgactacaaaaaaacggctctatctgctctcttgagtttattattgattctgctgtttctgcgcatggagatcaagtatatttaactcagagtagagagaggttgctttttcacccaggcagcttctgaacttttcttactcatttttgta

SEQ ID NO: 132620 - DNA, 1045 bp, Homo sapiens
taacatgactgttatggctctgccttgtaactgtttgtatactggtttcctaataagctgttagtgcgcggcccagggtctatgtcctagactttattgtttctccagaacctatgacacagtaagaattttataaatgtttgctgagctgtgctggattttctcttaaccagtagaaaatgcccaccctcccaaggattagagcaaataggaggagataatgaaggctgggcattcttggtctagactgggcagtccctttcctctataatggagcctgtcttttcttcaggaaaaaaggtgagaacacagttttctaaagtacacacagatcacctacatcctccaatcaaggactgcttcttacaaagatacgtaaaataccctacaaaacccaaaactaatctctattaccattcatagagtacttagtatgagcgaggcactgtgctaagcgcttaacacacttctcctcacaaccactctctggggttaaagaggaagaaactgaagccctgagaagttcaacaacctgcccaaggccaaagaggcagcatactatatgaattggattttaaccctgatttacgggacttataagcccatgctctcacagctggaataaagggataggaatcagtcatttacaccttagtgtgaattagtttaggtagttttgttttcctaattcttagctgagttgagttgaatgaatgggggtgggggtggtggagagtgagaaaaaaagagttgaaggaagtgagaagactgtaccccgtacaagtgacagagaagggtcagctgggaatttgggtagtcaaaaggcaaggtgactgagaataagtcttcaggggagagagggaacaggcactaggaaagtcagaaagagagtagcacagaaaaggaggcaaggacccaggtttgcactggggaaagagaagagaagtggggtggggggcagagagagagagtgagcgagtgagtgtgtgtgtggggggagtggtggtgtcggtaatttacaacatgaacaagcatcaccaaagca

SEQ ID NO: 132621 - DNA, 1012 bp, Homo sapiens
gatgaagccatttcccatgcagagatctccctgtctctgtctcaggagtttgatatgtgagaagacaggagacgaagcagctagctattgatgcaggggtgattaattccctcagggctggggagacacacacacacacacacacacacacacacacagatagtagacatgtacacacatatacacacaggcattgatacacatgcatatgcgtgatacatacacatacacacccctgtgggcagtgcctgctgtttgcacaggcttcctattcacacagatgttctattcacaggatatggggaacagcagcccctgcactttctagccctaaagggtgttgacgtggggagtgagaatgaggctttccacaaatgtttttatatatgaccacacaaaagtgacctaaactgatttttcaagttaggttcaaagatctcttcatgtagaatgcatgttttactctttgatgttttgttacctcagggcgagttaagggattattatcagaatgaagcctgaataaattgaaaccctcatattaggatttatattggcttattaaatccctcatttgtttttgattatccatgattctcatttattgctaggacttttatccctgggacactatttttaaacacacttggatctgatagaactgatgaattggcctaaatccctaagttgtatttactaagtaggagacatgtgagcataatgtcaagaaccagactgccccagaactttgaatttcaacataccatccacttccatctgtgttttatgaccttgggaaagttaccctttttgaatgccaactcatttatctataaaataaggatgataacaataattacaataatagcttccagtagttattgggtgcttgctatgtgctgggtactgctgtaagaacttcacatgtactaattcctttaatcctcatggcaaccctaagatataggtactattattataccattttatatatagggcaattgaagtaact

SEQ ID NO: 132622 - DNA, 1127 bp, Homo sapiens
tagaattcctgctggctgttataattcagatatgagcctcttgagaaacaaattagtagggtagatgatctgcaaagttatttttactccaaggagtttgatatgttaggtggtttgtctagatttctaggtataaatttcttgttaaaaatagttccagggttgttctccttgtggtggtcaagatcatagaagaaattactcgcatcatgaatggtgtcctctattgttgtgtttcttctctaataccatattttgggttttattgcagtttgtctctattttatattaactgattagcatcttcacattaaaaaccttccactaaatgaaccctttttcttttctagaattacctcctttatacagagtgagtttctgccaggcacagccacttgttggcttcccaatacaccatgtttctctttcacatctgtgaatttgcttccagcttttcctgacttcatgttcctacctcaagatcaaggactgattcaagcccttcctcttccagcaaggtttccctcaccatcccagctcacatcaactgtaccgtccttgagattccattggatttacttccatttacattctgcaatacttactacacagctattctaagtaaactgctatagcatttaatctgacacaattctctttgcttaaatgtttttttccccctagttatcatcccaagtagaccacaaggcatttaagatttaggatcaagtgccttgggattaaggaaataatttgacattcatccaatcaggctataaatgtctctatttactgatttgtaggtggcattactcactaaaaccctacaaacctaagtatttctccttattatgggttggattgtgttcctgcaaaagatatattagtcttaattcctagtacctcagaatgtgaccttatttagaaatagggcctttatggagataattaagttaaaatgaggtcactagggtggatcctaatccaataggaatggtatccttatgaaaggggaaatttgacaccatgacagacatgcacagaggggaagatggctatgcgtcagataagatgctgtagcactctacttagaacagccacatagtaagtattgtagaatgtaaatg

SEQ ID NO: 132623 - DNA, 1120 bp, Homo sapiens
gagttgacagatcaagctgaagccctcctggcttgaccctgcccagtacctgaacaactgacttctgaccaggggcaggcaggagacatagggtctccctccaccttaatggctggaattagtcttcctgccctttgcccagcctcaagtgtgcctggattggcctgtcactttaactggattttaagctttcagcttggcttcctaattgccactttgtttcccggacagtgctggagttctgcctaaagtccagcctactagactgtggtcctgtctctctgcctggatctggctagcccttgaacttgggctgggcagagcacccttagccatgcatgagctaaaaactgtgacgtgaccacaatccagctgacatcacacatggtcaccaataacaatagtaatactaacatttatatcgtacttaaatgagccagattctgtgctagttgctttaaatgcattattcctgtccacagcttcctgagataggtactattatcctctctattttaacaagcaggagctgaggcctggagaattcaaatcatggcccagaatgcctgctgctgggtattcctcaatgccatgccaccagagtcacacccaagtccaccatgacatggacataaaggcaccgagaatggggctgcttcttatcatgggaccagctctgtggatttatgaacctcagttctgcatgatccgagcctcattcactgaggtctcagcagagcccagaacttagcttacctaagatgtgggaacatatattgacttatttactagtgataaaggtactgtaagtttccccattttacaggatcagctaacagagactctgagaggttaggtaacctgtccaaagtcacacagctcgtaaacaagagaatcagcattcaaacttaggcggcctggctcctgcatgcctaattattatattatactctctcttaaggtcaatagaacaaagtattaatagacctgagtggcaaatgctgggcttcctgtgcttatagtttcagaaaatcacaagtgacaaaatgacagatctatttctaaataatagaaacaaacacactgataccacccagggccatgaatccacttgcagttg

SEQ ID NO: 132624 - DNA, 1032 bp, Homo sapiens
atgaaatatttatgaagcattggtagtatgtgcagcatttcataaaaaaggtagtcccatagaggactcaaaaattgctgaaaaggatgtggatttggccctttcacagagcttgtggaggaaggtgatctcaggggcagccatgtatctgcaacttaaatcagttatgttaaccagggaggaacttgttattttaattttggaaaatattttcttcatatcgatggaaatttccttaaccttagattttattttcttagagtctctgttacacattaagaggaaggaaaaaaaattgaggacttggtttcatattacatgttttaagaagaattcttatttttaatttaaataaaattgacttcataaattctgattaaggaaaaaaaacacaaagaacagcctttaacagatacttgctgatgacttatctttagcagaatccagatagagatgccaagaaaaaaaagaaaaactttcacgttaagattgaatttttattgtagatttcatgtacttttcatgttaagctatgttatgctccttaaaaatggccttttttggatatcagaattaatgtttaattgttcataaatacctttcatcttataaaatgagtacaagtgggtatatgtcaaatttcagatattattagagtacaacttcatattccaattacagcagtaaacatgatctattcgaccttatagtctgcagatggatccgttcagagtaacatgttctgattctgttctgtagtgggcagttttaaacgtcattccctccattgatattaaaatatttattactgaccttcaggtgatttatagtttatttggaaagatgacatgtctcgggatgggtggtggaggggtggaaacagctacccttagatgaatgagaccaataaaacaagtgatgtaggatgtgaggggtgggagaggcgctttgggatggggtagccggggaaggctttaggatggagaagtgatgaggaaagtgaagctggagtgagactgcctggtttcaaat

SEQ ID NO: 132625 - DNA, 1034 bp, Homo sapiens
tgagtaaatagcgtccaatgtttaaagactggggaagcggggagaaagatgaaaggagtaagcagcacacacttcaaagcccacttttaagcacacgacattatgaatattaaaaataaaggatgcaaacaaaaaaggcaattcagcattttcagaaagagcatttggcaatattcaacgcataaggagactgtgcttggggccatccactctctccagcttctcaaagtgtttccgggcattgcgaatgttgatcagagtggccgcagaagggatcgacggatctgacatgaccaccatcacgtacgtatttgaggtgaagatgtcgatgaaagcagcgaagttggaattcctaacttccatgctctggaaggaagcggccaatttactgcagctcagcttgaactgtttgatgatgttgctgatcttctcaaaccggtggacgtcgcgctgctctttgcactggtagtgggaaataaccaagaatgtagctctttcgaacagcagaacttcatcggcctcaatgatttgggcaaaattcctgaggttcatctccagctgctgaacgttgggaatcagctggtagacgatgctggaccaggctttgtagagcgtctcatcccagatggacgttcgaaaacaagcacactccagcgggcgagacagacgcctcaggtcttcctctcgctctttaaaaatcaggtcacgctgatcctcctgaaccagatccattttgtgcaccaggcagaagattttggcgtcaggagagttctggaggatggcctccagacacgactggtaataatgcatgtccttttccagttcgcggctctccacgtcaaacacgtaaatcaaaacttccacgttacggaagatattgtctcgctggctggtgaagtaattttccatgaaggtgtcctgaccgccacagtcccacaggttcagcaccaggttccctaggaatcggacgtgggagtgttccacgtcaatggtggcccccaggcgccgggtgtcgcgagcaatgtaattggcga

SEQ ID NO: 132626 - DNA, 1103 bp, Homo sapiens
agaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaatttaaaacatgtccttatttgaaataacttgaaagtgcttaatatgcaaatctaaaaattctgactgcccacaagtattgcttgactggcaaatttgattctgtgaatttagcccccagcactttagtgatgtttggtaacagctgtagaagcgcttatgctatggactgaagctagaccacctgagttagtattctggtcccttcacttactagctctgtgaacatgggcaaatacttaatttcattacacttgtttcctcattggtaaaatgtgggtcagaatactactttatagccagtcgtggtggctcacacctgtaattccagcactttggaaggctgaagtgggaggatcacctgagatcaggagttcgagaccagcctgggcaatatagagagaccctctctctacaaaaaaaaatttttt

SEQ ID NO: 132627 - DNA, 2305 bp, Homo sapiens
aaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaaatggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgatggcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttata

SEQ ID NO: 132628 - DNA, 1800 bp, Homo sapiens
ttatagaaaatgtttgccaaactgtggcttagatggacaagaaaaggtctttttaatacatgtaattcatatgtgctgtgtaaaattggatgcatatttcaggaacagctgtctttatatgtgtttatttgtgcgagcagttggagatggggttcttcgatgttgggatttgttatattgtggaggcttatcatccaaccagtatatttatggaacatgtactgagtcaggagctttatcttcagtgttagaaataaaatgattcattgcatgctctatgtttgggaatgttagtaaactgtgtttttctcccctttaattagtaactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaagggtaaggtttaaatagacctatgcatattcacctgttgaagttttctctcaacttttgataaaaccagtacacaaagaatgctgcatgacctttattgttaatgtgctcccccttccttcatttaggatgaggggaatgatccctcactggacaggtcctttcagaatctctgtttatgtatatatagttacaattgatttgagacaggggtgggaaaaaaaagcccccccaatctgaagcttacaggttttataatacaaatgactgaaaagtaaatgtcatcaaaatcttgcccagtggaaggtggtttttaaacacttgagaaacccaattttaaatatcatcactataatggtgtaatatctgggggtggggtgtagaaataaaagaagccaggtcagtgtattagtttcctagggctgccataacaaagcac

SEQ ID NO: 132629 - DNA, 2250 bp, Homo sapiens
agtttaaaattggcctctgaactactggaactattaaaacttagatgaccaacttcttccgggagagtttcgtgtaatatgccaaaatcattatctttaaaactcttagaactaattccacttgatatctgaaaagaattccacaacatagttttatttgtggaaggtttgttacaagaaacttctaagtggtccaatattttcataaactcctcttcactgccacccatcacatctatcctattgccgacagcaggggagaatgtctccattcggctagtttctgaaagcttggtgaaggctaaacattccaaatcttgcttgcaaattactttcttatttaacaaatctgactgattttgtgttggtggttcatctatgtgactggtcagcacatgtttctgaggcacacactcgcaatctgaaataactttctcttcagtcaaatgagactggccaaaatctgatacagtggtttctaagagaaaatcagccatgctaaattctctttgattgtgcaacacaggtaatgattctggcaatacttctctatgttcagcatccatttgaattggttctttagttctgttttcttccatttcaatagcttttctccatgagctcctaatttcagttactaattaaaggggagaaaaacacagtttactaacattcccaaacatagagcatgcaatgaatcattttatttctaacactgaagataaagctcctgactcagtacatgttccataaatatactggttggatgataagcctccacaatataacaaatcccaacatcgaagaaccccatctccaactgctcgcacaaataaacacatataaagacagctgttcctgaaatatgcatccaattttacacagcacatatgaattacatgtattaaaaagaccttttcttgtccatctaagccacagtttggcaaacattttctataagggccagatagcaatattttaggctttgcaggccatccattctgtcaactacttaactctgccatgatagcatgaaagtagccataaacaatgtcaacaaatgaatatgcttatgttcaatacaattttatatacaaaaacacacaaggtggggccaaatttggttcataggctatagtttgctgacctaggctgtggctcagttcaaactgaattaaatcagcagcaaaacagaaattatttaattactcaaccaagatgatgtgcctacctaaggacaccaatatcagaactttgcctacacaaattacaggttataggaaaaaaggtattgggcagtttgactcatttgggaggggtaaagacctccgcacacatggtttatggctgatgcttctggttgatgactggcagaacacagcctatgtactctataaatatgtagatcacaggtcagaccaggaggcaagagatttttttttttaaatgctcaaataagatctttctagataaaagcaaagtataacaacaaagacaaaattgtacattatcaaaattttatatctctgtatattgagtacactgaaggcacaaaatactgctaaaagactgttatgtgagaatgcccacacttagtacgtcgattacaacagcataaataaacagcctttggcaactcagctaaaaagatctgtcaggccatggttctaacagtggttatgtcgatgaaagaaaaaagtaacagaaagcattattaacttactcaagttttctggagtacggggaatctgattccttgttaagaaggggttagaacccagagagtcaattagttcctctaattttatttcttttccttcagagagctgtggtgaatcagataaaactgctctggcaacctaaaacagaaaagaaaaagtaaagcaaagattaccaagcccattggtagaatgcaacaaaacccctgataaggataataagcacttcacagtcagcagcccctcccattgcagacaacacaaaaataagcaacaaagaagttccccaacaactctgtatagaccatccaggtacaatcctgtaaagtgaaatgaaacactgaagtatttcctcatcttaaatggatatcccattataaaggagagaatagataagaatctttatgctgggaagatttagaggcagttccagttgtgcagtgacctaagctgctgtctgccacaactgtgagcttgacagctctgtattcactaaaatgactagttttaaaggaagcagactcttctcaat

SEQ ID NO: 132630 - DNA, 1567 bp, Homo sapiens
agcctgactcacatggagaaagcccatctctactaaaaagacaaaattactcaggtgttgtggcgcatgcctgtaattccagctactcaggaggctgaggcaggagaatcgcttgaacctgggaggcggaggtcgtggtgagccaagatcgcgccattgcactctagcctgggcaacaagagcgaaactccgtctcaaaaaaaaaaaaaataaaataaaggatctgctacaaagaaactgtgatttggaacctgtgacattgtaataatgcagttctagttaattgaatctgtttttaacctgtgttcaagttgtggagtattcattaagtcacttaactctttcaaatcaaaatattgttgactcagtatgtggtaagtaaagtcttcataattgggaggctgatacacaaattgggctgaaatactgctctacttgtcaccatgcctccctagaataaactgccttttgatgaccgggacgaattgagtgaaatcgtaacggacagatacggggcagacagattttagaatagactcgtaaagggaatggaattcttttctccttataacttggatttgttgtcttttttccttttagccctgcctctttcttgtcgcagtcagtttcatcatcagatagaaacagtgttacagtacttgaaaaggtatattttaaaataagtctcaattaattctggaccatactaaattataaaatattatttatttttgttgataccacagttaaatttaatttctaatttcacattttctactatttgtacattttgtaccatatctacttatattccttattgctaagtgggaatattggaattagttaattctgccagtgacatacaatttcacaatagtattaacaaccttttataggttcatgataaccagtgaactgctaatgaagacagcttcaggatcagccatgattattaagggtttaacattacatatctgtcttcttcaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggtgagaaaagactgtaatgagtatacttaaatatcagttattggatgggcacagtggcccatgtctgtaatcccaacacttggggaggtttcggcaagaggaacatttgagcccagaagttcgagaccagcatgggcaacatggcgaaacccatctctacaaaaaaattaaaaaaacagttgagcatgggggcgtgtctctgaagtcccagctacttactggtgaggctgaggtggaggatcacttaaagcccaggagactgaggctgcagtgagctgtgtttgcatcactgcactccagcctgagtgacagactgagaccctgtttcaaaaaacaaaatcaaaaacaaatattttctcaatggtgttgggatcctaagcgaaatacagttaat

SEQ ID NO: 132631 - DNA, 1194 bp, Homo sapiens
tatctcttaaaatattactttatctcttattcttttgatcctttccttctgaaactcctattgttgggacttctaattctgtctttcatatcttttaacttctcattcatatttacaacttttttgtatctcatggcttcattctaggtattttctttagatacctcctataactcactgatttatcttttagttatgtttaatctgctttttgacctgtctgtctagtatttagtagtcataggtatatactttttacctctgtaatccttacttcttttctgtaactgcctgtttttcatggtgtcatctttcattatggcttctgttccacttggacatgtacaaatggggaaagcctttcagaaggtaacatgatgaaagaggtcgagcccttggaatatcagatcttctgtaatccagtcatggctttctctaccaatcttatttcccaccatgcttccactggatgtaccctgtgctccatcatagcaacttgtacctcgttctctcagtaccttcatgccttcttcccactctgcagtctgggctggatgtctgtcctctgcctccttaaattctgtatatacttctgtcataatactgtagaagtataacataacacttgactcatcactatcctttcctagactgactcttcggaggcaacatttccatctttcatttctttcttccattgttggtatggtagtagcatgtagttattcagtcataggttgaagaataaatatataggttgactgataccataaatgtgcactgaaatatgctaagactgtaactttttggccttgctggcttttgtgataatctcatgatctgtgtatgtaaacatgaagcatataacactggggaattatggattcttagtctttgagtaacttgttttagtattagccatcatttcttttataaaagctagatgttctctattacttttctgctcatcactttatacttatcaattgaataattatgttttcctattagtgttcatattttggtttttctgttttcttctgtttacaagttgttctcgaatttcaaggaatccttgaatgttagaatgtacaaacataattaaagagtaaccaatttttaaatttctttagatgcacataagcaacataaccaagaaaatggttgcagaggagacagtgataccttgggagc

SEQ ID NO: 132632 - DNA, 1034 bp, Homo sapiens
cctctgcctcccaaagtgctgggattatgggcgtgagccactgtgcccagccagaaaacaagactcctcttgatgtgaggtactatgatgtttgagaaattcaaggactaagtaatcccccttgctcctaatgttgtactctgctttaaaaatagttatagggctgggcgtggtggctcacacatgtcatcccactgttttgggaggcagaggcaggaggatcatttgaggccaggaattggagaccagcctggacaacatggtgagaccttatctctaccaaaaacaacccccaaaactgggtgttgtggtgtgtctctgcaggcctagctactcgagaggctgaagtgggaggactgcttaagtccaggagtttgaggctgcagtgagctatgataatgtcactgctctttagcctaggcgagggactgagaccctgtctttaagaaaaataaataaataaaaatagttatctgatacattcttggtaattctgactttcttattgagaagataatctattcatagattaactcagtattgttattgtggtagttagcaaatatgtttacttcaaaattgtgaattttctgttttaagtctgtagatcttttaccaccaatgtctcccctttcgtttgatcctgcctcagaagaagtgtatgcaaagagtattctttgtcagtatcctgcttcacttccaggttggttatttatttatttttttctctttgaaacctccttcctgtcattctttttcattataataatagttctttaaattccttatctttttcctccatttttttttattgtggtgaaatgcatgtaacataaaattcacaatttcagttattgcaaagtatataactcagtggcatttagtacatttacaatgttgtgcagtcatcatcactatctagttcttgaactttttcttttatttttttttgagacagggtctcactttgttgcccaagctggagtgcagtcgaacaatctcagctcactgtagccttgaccaccccaggctca

SEQ ID NO: 132633 - DNA, 1073 bp, Homo sapiens
atcccaacactttgggaagctgaggagggtagatcacttgcggtcaggtattgagaccagcctggccaacatgatgaaaccctgtctctactaaaaatacaaaaattagctgggcatggtggtgcacatctgtagtcccagctacttgggaggctgaggtgggaggatcgcttgaatgcttgggtcggaggctgcaatgagccaagattgagccactgcacccagcctgggagacagagtgggattctgcctcaaaaaaaaaaattaaaattaaaattaaaaaattggcaactaattcaaatgattttaagacatagaaatgtgcaagccaaagaaacatatttaagtacagatacagcctttaggggtcattgatttgtaacttctgttaaaaaatgaatttatggtcttttcactaaacctgctgtttctgctcaatctttatttttctttccatctattaacatttcttttattctagttttcaaccttttgtgtaatataaaaatgtagcaaaaaatgtagcaaggcatgttactctttcctagtagttttcactgggccaaaattatttacgtcattttatgtttgggggtatttgatttttttccccccgcttttttttttgtttgtttgtttgagatggagtttcactcttattgcccaggctggagtacaatggcacaatctcggctcactgcaacctctgcctcttgggttcaagcgattctcctgcctcagcctctggagtagctgtgattacaggcatgtgccaccacgcccagctaattttgtatttttagtagagacagggtttctccatgttggtcaggctggtctcgaactcccgacctcaggtgatccgcccccaccacccccaactcccagagtgctgggattacaggtgtgagccgttgcgtctggcctttccctcttctttaaggtaaactttaatagtaaaaaacataaatatttttatgtaatagtttgttgtaacaacctatagttcaccaatttttttctcctcctgattccttagttgcacataggaaatgtttatgaggctggaaaac

SEQ ID NO: 132634 - DNA, 1127 bp, Homo sapiens
tcccaaagggctgggattacagacgtgagccactgcgcccggcttctcttgaaaaatttttaaaattatttctccctgaatgatcttcattcgattaattacatgtcagcatatagaaaatgctaattgtatcttgtataagatttcttagatttggagctgggtgcagtggtgcgtgcctgtagtcccagctacttgggaggctgatgtgggaagattgcttgagcccaggagtttgagtctggcctgggcaacatagtaagaccccatctctgaaaacaaaaaaattcttagatttgtttgaaaattatagtgagctagattctcctgatacatttttttaaaaattccctttggaaataatatccaaagggacttttaaactattaaagtataattatttaattttcttactagaaatcattctaggaaatttgttactaagagtgaacatacatttacatttttaaaatatgtacagattatgtgtggactttaatattttgtttctgtttccaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcaggtaagcatttgatattaaggaagcttttgagaaaactcctatcatgtaattgtatattttcttgcaatgttcttctgctttcagaatttgttttttgttttttgttttttgttttttttttgagacagaattttgctcttattgcccaggctggagtgcaatggcgtggcgtggtttcagctcactgcaacctccgcctcccaggttcaagagattctcctgcctcagcctcccgagtagctgggattacaggcatgtgccaccacacccagctaattttgtatttttagtagacggggtttctccatgttggtcaggctggtctcgagctcctgacctcaggtgatccacccaccttggcctcccaaagtgctgggattacaggcgtgagccaccgcacccggccagaatttatttctatgagtgtgtttagta

SEQ ID NO: 132635 - DNA, 1105 bp, Homo sapiens
gtagtgtttattttatttcgtatccttttttgtcttgctatttcattctgtaaatttttgcatattgccatagtgtattactatttttttttttttttgagacggagtctcactctgttgccctggctggagcgcagtgtcacaatctcggctcactgcaacctccacctcccaggttcaagcaattctcctgcctcagcctcccgagtaattgggattacaggtgcatgctaccatgcctagctaatttttgtattttttagtagagaaggggtttcgccatgttggccaagctggtctcgaactcctgacctcaggtgatccacccgcctcagcctcccaaagtgctgggattataggcgtgagccactgtaccctaccagtgtattacttttaatgtctattagtcctgttagtggatatttcattaagcagatattctttcaggtaggtagtccatcatttttttaaaccacttaatgctattttatgtttaggttcatctatgcagcatatctttttttcttggagtttcttctatgtgtcagatactgtttaggcattgatattacagaattaaacaggacagacaaggctgttactctcaaagaataggttgtatataattgtgtgtgcatgtggtttttttttttttttttttttttttgagacaaggtcttgctctgttgcttagctagactagagtgcagtggcatgattatgactcacggcagccttgacctcctgggctcaagtgatcttcccactgtagctgggagtacaggcgtgttctaccacacccagctaatttttaaatttttttgtagagacagggtcttgctttgtagccaggctggtctcaaactcctggcctgaagccacattcctgcctcagcctcccaaaatataggcattacaggtgtgagccattgcacctggcctaatttcttttttgcaattgtaaacagttacagtaggataactttgtagaatgctttgttatatattactaaagctatagaatcctttgaaattaactgaaatgttgcctgactgtattagataacatttaaatttattcctgggtatgtgagatgaggataag

SEQ ID NO: 132636 - DNA, 1058 bp, Homo sapiens
tgtgtttggatttaataaggcataagacttctaagcatggattgtcctatttctggatttaaaccaattccagtcaacgtgttcagagtctagataacttctaaattcggtacactcatttcctgttaaatatttagaaattttggtggtttctttttttttttttcgcagacgaagtctcactctgttgcccaagctggagtgcggtggcgcgatctcggcttactgcaacatccacttcccgggttcaagcgattctactgcttcagccttccgagtagctgggactacaggcatgcgccaccatgcctgctaatttttttgtatttttagtatagatggggtatcattatgttggccaggctggtctcgaactcctgaccttgtgatccacccgcctcggcctcccaaagtgctgggattacaggcctgagccactgcgcccggccaattctggtggtttctctgaggcaatgctagaacctggataagcaatgttaatacattgtggaagtccctgattttcagaatattcatgtttttgttgtattgaaccatgttaaagtaggatttattacaggtaaaaacctgaactctgaaatatttacatgagttattctcaggtctactctggtttttagtaacacagtgacgaattgtttgagaaatgaacagtggttttatttggttatcctgtcctattggtcttactaggaggaaaagtaaactgatggcagcaatggagatgatgtgatctcctcttatctttttatattgactttcttcctttgttaaaagattctatggctgggcgaggtggctcacgcctataatcccagcactttgggaggtcagggcgggcggatcatgaggccaggagatcaagatcatcctggctaacagggtgaaacccgtctctactaaaattacaaaaaattagccgggcgtggtggcgggcacctgtagtcccagctacttgggaggctgaggcaggagaatggcgtgaaccctggaggcggaggttgcagtgagccgagatcacgccactgcatttcagc

SEQ ID NO: 132637 - DNA, 1047 bp, Homo sapiens
gtgcagaagctgtttagtttaattagatcccatttgtcaattttggcttttgttgccattgcttttggtgttttagacatgcagtccttgcccatgcctatgtcctgaatggtattgcctaggttttcttctagggtttttatggttttaggtctaacatgtactcttaataaatattagctatttattgttattcagtaaatgtaggttgttaccattataaggcatgtttctcttgaaataggttttccttccttttctgtagagtgttttcattaaagccagttctgccagtcttatattgaatctgtgttttcagaattagaaaatgaaagcttgtatgtttttcttactggttataaaatacacatgaatgagaaaaattaatttgccttgacttcctgaagagaatgaaaacattaatttgtgtcaaagtcttactcagcttttgatgatgtttagcttattaacctttttctttttctatttctatttcatttttaaccactaggaacatgtttgacaagctgaaccgtgatgcctttcatataatttcttattttttgtttcaagttctggaccagtctctcaccaaagaagttttcaagtaaggaaaaataatttcattttcttaaatttctttccaaatttgaaaatggacagcgttttgatacaagccagaattctctcctttttttttttttttttttttttttgagacggagtctcactccgtcatcgaggctggagtgcagtggcgtgatctaggctcactgcaacctctgcctcctgggttcaagaaattctcctgtctcagcatcctgagtagctgggattataggtgactgccacgacgcctagctaagttttgcatttttattggagctggggtttcaccctgttggtcaggctggtctcaaactcctgacctcaggtgatccacctgcctcggcctcccaaagcgctgtgattacaggcgtgagccaccacgcccggcataagccagaatttcaacttggcctttgactgttgttttgaatgaatatt

SEQ ID NO: 132638 - DNA, 1137 bp, Homo sapiens
ctttactcatgtacacattaaattttagttgctggctgggcgtggtggctcatgcctataatcccagcactttaggagggcaaggtggttggatcacctgaggtcaggagttcgagaccagtctggccaacaaggtgaaatcctgtctctactaaaaatacaaaaattagctgggcatggtggcgtatgcctgtaatcccagctactcggtaggctaaggcacgagaaggaggttcagtgagctgtgatcgcgccactgtacttcagcctgggtgacagagtgacactcaaaaaaaattttttgtagttttttagttgctttacctgtgctaaactggaagtaaatgtggagtcagtgatttaatagttaaatagaggcagtaaagagctactactgcttggttaatttacacatattgataataaataataatgatagcaggaatagatcttattcaactccaggaaattcttagtttttatgttgcctgatttacatcatacatctgcaaacaggctaacgtgaatatctgacttgtgtgttcctttgtcttgtttcaatgtgtctagattgaatttgccaggaagaatgtgtatagtgccaatcagaaaattcaggatgctcaggataagctctacctctcatgggtagagtggaaaaggagcattggatatgatgatactgatgagtcccactgtgctgaggtaagatgactgggacggtcatttgttggttgctgaagaagttcttatcagacttttcatttcaatttttccatactatgtcttagaatactcttctctatcaaaaggttgaacaataccatgtacataggtggctagttatgtggcagaaaagcaaaactaggcagcgaataattttatctaacaacctatgagtatacatatgccccaagtgagatacaactaaatgagaaacacaggccttgccctcataatgggtacagactaacaggggatacagccagccatgctgtcctattttgtgcctttttaatgctccttgcagaagagggctatctcataggcagtacactcagagtagccaagtccggttgttgtttaacggcataaatacaggtactattggctgggcgcgatggctcacgcctgtaa

SEQ ID NO: 132639 - DNA, 1019 bp, Homo sapiens
tgtgtgactttggaataagctatataacttaccttcttttcttttctttttttttcttttctcttctctttttttttttttttttttgagacagggtcttgctctgtcacccaggctgagtgcagtggcacaatcacagctcactgcagccttggcaaacagacaaatttcatatctgtttacttcatttgctcctcctgcaattcccaaggattggcaggtagggcagatatacttgatagggaaattcaggctcatcaactcttagtgacttgcccaagacctaaagctagagtgagaggactagattccttctttaactcttcagctgtgctgccttagttaagaccttaggtatgtccttgtgctcatttttctcaccagccaggggatctgcttttctacttacagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactaggtaactggaattttatcttgaaatactgttttatattaaatctttcttaaacagcttcattgacatatactctcatcttgagtctaaatttacacagttgtgcaagcatcactgcaatccagtttcagaacacttctgctaccccaaaagatcctcatgcctgtttgcagtcagtcctttttaatttaatttaattttatagagatgggatctcactatgttgcccaggctgatctcgaactcctgggctcaaacgatccacctgccttgacctcccaaagttctgggattacagatgtgagcaaccactaatctttttgcc

SEQ ID NO: 132640 - DNA, 1031 bp, Homo sapiens
taatattagcttaatgttgtataggcggagatgacaaatgcacccagaacaattagtgaagacagggttgcctctggaggtgatgacctcatagtcctccagtgacccaagtcttccccaatttgggctccagtgcacactccgttttgtgctgtgtcttacaagaaggggcaatctctgagtgattgtgaaattctaaatcttttgaaatggccttcatatcagtttgatttttgtagcattgttttcttactctcttattttagtgttctgaacttcatgctttgctgtattttatactgcatagttcattatataaacgttttaaatagactcttctgagtaaataaatgaatctttagttggtatccaacaaaatcaatttcttttcactcttttgtcttttttataaacctaattcatgttttacagtggggttccagcgtgtttctgtgttataagaagtctgtacctgcttcaaatgcaatagcatataaggctggtaagtgagttaaaaaaaattgtctcaattgctatagttattggtgcatattaacatttggctaaaagagataaagtatgctcccttacatagtttgtagaattgatctattcataaaattatctataattttagcatataaagatatgtgttttcttaaatacatatacaagatatattaatacccccaccaaacatgctgttaatttaatttaaacatttatctaaagcaaacatatgtggaataaacattcaagcttttggtctacgttaatagacttaacagtataatggaaagttgctgactctctgaccttttatattttggcaatcagaaaggtgtcaaactgcgtctttacttcttatatttccttctcttatctctttgtgtctgatttgaaaccacatgttacttgccatgaaaggtggacttgcttcctttctcctttgttgcaaagaatcagctatatggaggagaggagggcctgagaaacttttctgccatgaagtgtttgagaaatctatcgcc

SEQ ID NO: 132641 - DNA, 1010 bp, Homo sapiens
acttttgaaaatattggtttgagatgcctgtatgacatccaggtggagattagtgagtagtcattttgaaaataggagtctgaggttcaggggagaggtcaggtagacctagagataaagatttgtgttttgttagtataatgattatagttaaaaccatgagagaatgaaatgttccaaatagaagtgtgaagttagaaccttagggaatgctagtatttaaatgatgggtgacataattggatctagtataggaaagagagaagtagccagaaagcagagaaatttgtactgtcaaagacagcaaaggaataaagagtttgaagacagaggagtgtcagctttatcttgtgtcatacaaggaaagggtgtggaggaattgaacctgtcaacattgctgatgagaaagtcaaatgctgctgctgtggaaaacagtttggcagctcctccaaaagttaaacttagaattaccatatgatcgagcagtttcatgcctaggcatatacctaaaataattgaaagcagagactcaaacagatacttgtacgccaatgtttgtagcagggttattcacgataggcggaaggtggaaacaacccaaacgtgcatcaacgtatgaatggatacacaaaatatggtatatatatatgatggaattatgatttcttccttaacaaggaatgaaattcagatatttgctacaatataggtgaatcttaaaaacattattctaagtgaaataagccagacacaaaagcataaattttgtatgattcctcttataggaggtacctagaatagctacccttatagagatagaaagtacaatagagattaccagggacttggattgagggcaagagaatgggaagttaccatttaagggttacagagcttttgtttggggtaatgaaaaaagttctggaaatgaatagtgctactgggtgcactgcattgtgaaggtacttaataccagtgaattgtacacttgaaaatggttaaagtggtac

SEQ ID NO: 132642 - DNA, 1011 bp, Homo sapiens
gccattctcctgcctcagcctcccgagtagctgggactataggggcccaccaccacgtctggctaattttttgtactttttttttttttttttagtagagacggggtttcaccttgttagccaggatggtctcgatctcctgaccttgtgatccacccgccttggcctcccaaagtgctgggattacaggcgtgagccaccgcgcccggccatgaatttttttttgttgagctctttaattatctgttagcattccctggaaaataattagtttttttttttttttaaatcctggatgcttttagttggattttgatctgaggtaattttgagaattaataggtgaatgaaatgtgtaagagttaaagataataagtttattttatgatatttggggccattttattttattttgattctttccataaaattggaatgtgtgctttgtatagatactagaagaattaacatgcaaaaagctgttagtatttttattgtgcttatgatcatcgtcatggcttgaaaattttaattacatttgttcttagcattgcttagtagtattttatagtcatttagttttggaatgaagtttaaggtaaacaaaacagacttaactgcttttcagtggtcccttttcagtaatactagttacttatatattttttattgcaaatttaaaatttggttaattttttaaaactttttccccagatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtgtaagttgattcattttatattatctcccatttatatttttcactatgtagagttacagttctttgaaagcatctagaaatatgctatttttggtagttgttaaatcttcgtcttaaatac

SEQ ID NO: 132643 - DNA, 1021 bp, Homo sapiens
atataaaattttaaattattttagtagccacaataaaaaagtaaaaaatagggggaaaatagtagcatttcagcatgtagtcagatttttaaaatcattgatgaaatcttttacttttttcacaaacatctttttttttttttaaagacagagtctttgctgtgttgcccaggtggaatgtagtggtgcagtcttggctcactgcaacctctgcctcccaggctcaagtgattctcccgcctcagcctccctaatagctgggattacaggcgcgcaccaccatgcctggctaatttttgtattttaagtggagatgaggtttagccatgttggccagactggtctcgaactcctgacctcaggtgatctgcctgcctcggccttccaaaatgctgggattacaggcgtgagccactgcgctcggcccacatctttgaattctggcatgtattttttagttagtgtgtcttaatttgggtcagttacatttcaagtgctaaattgccatatgaaggtagtggttactgaattaaacagtgcagatctaggggcttggttaaattcaggtttaattctcttggcaagaagtgccaaaatacgtggtgctcacttcttcctattgcatcatcttatgaggcacatacatgtctggctgtcctacttttagtgttcctaataggtttaaagtgttgttaccctcactcattcattgtagttcacccatcagcctttgacttacttggtctagcagcctttgctgatcattgcctggatccactagaaggaaagaaagcctttcattataacttgtggagaataatttatttctattttatttaagcttttctctactaattagtatctaaaagggatggcagtcaggaccacagcatcaaagaaagaaaggctgcagagaaaaccatgtttgaaatggtggcattaaccaggttatgcaggatcttttaggattagtgctggtttcagtttttatcctaagagtaattggaagcctgtaaaggat

SEQ ID NO: 132644 - DNA, 1018 bp, Homo sapiens
tgaaattttttatttgagaagccagataaccttgtgattggtcatcttttgtcttaaggtttacaaaacaactaatcaaaatagttttctatcctaatagccacaagtaaaaaattatgctttagcctaagagtatgtattcagcctaaaaatatactgtgcatgttttgtatcagctggtactgaaaaggggtagtttttttctaaatcagaatgtaagataaaaatgtctattaaattcatagtggacattttcattaagaatctgttttctttttttctagttgtttcctgataaaggcacagagaaaacagataaggtatgtttttcttagattttaagggttgaaatttcagaattagatcttgtttgtatgcaaattaattggggaaaaataatgattttcaggttgattttgattcagcagaagataccagattgatagaactagatgattcacagaaaagtgagcatactgtatttataatgccgccagagccacctcctgatgatggaaaggacctgtcaccaaagtacaggtagtaggaagttttaaaagagcttaatggcacagcctatcagtttcttttaatttttattagtagatatgtatattagtcttttgtgaaactcattttcagtattagttcagtgaactaatgtagataaatattttatggaaatgccactaggtgttataatttaagaattggatggtattgtcagatgttgatcattgtttaccttagtgtttgtattttaatctttaaaagtttcaattctgaagaagaaaaatgatacttttatgaggctccctgctccctttgggagtttcattttgaaacaaagactgtgaaattcttatgaattagtaatttaccaagaaaacttaaggtagagggccaggaatttattctttattaagataaaggataggatttggatgtgactcttttaagaaattagaatggattttgtagtttttttattgctataaatttaataaacttagaaaat

SEQ ID NO: 132645 - DNA, 1396 bp, Homo sapiens
atagttctaatgatgctaacaatggggagcacacagtcttcgtcagagatttaatcaggcttgagtccattgataatcactctagcacaggtactaaaatccagattttactaacccttcacttactctcatgttaaatctttcctttttcaaaaagcttcttccattcttgagtttgtgtgatatgactactttaaaagtactgtatgcttacaagagaaacaatacgagtctgcagatgacttctgtttatttcctatagtacaaaattagtatgggagtgctgtgcacagtgctctagcatgatgcttctttgtatttgtttatcattagtttgtgaaagtgtatgctataattaggaatcatgagctaaggaacttgaaaattagtgacacaacttgcaaatctttttaaaaaattaaatagaaaatgtatcttaaaacttcaagagtatgaatattaaagagggaaggaaggaagtcacacaatgagaaaaagtattctctttaagttacattttttaagatctgagaagttattgaagctgcttttatgtacatagccatgggaataatccctctcctctgaagttagaaataagtgtaactaaagtagcacgttgtgcagatatatgtgtgttacatatccttcttcttgtgttgtttttttgttgtggttgtttttaatatctcaagccttcctttaaaaagaattctgggtctaattcctgtgcttcatctgatgaacttgtctcaatgactgaagtttccttttctctgctctttgttgctttgctttttgctctgtgctgtttcttggtgctgcatttgtccttggctgtcatggtgtggggtgcagacagacttatatgacgtgaagctatggatacacgtgtgcattaattctacccttgaatgttaaccacatcaggtaatttcccatttattaggttaaattttgctgacctgcaagggtgggggaaagacctttcattgtattttaagtttgttttgagtggtaaacagttttcattttcttgccttttctccttcagataaatgtaatcatatatagactcttgaaaatatccagctaactttttatggtcagtttgcaaagcatgtttgttatcttatttgaaaatatattatgccttgctaaaattcttattttgaggttggtttgtagcatcagtgtgacaaatagtgttataggcattgaagaattaattgtttcagctgttaaggtggtgtggccattgctttccaaaacttatctgctgaattcttgtgctaaaaacaaccttcacataattacaggagcatgtgtaaatttgaaagtcaacataaagctacaggttacaatcctgtttgtaattaacttcctcagtttgcca

SEQ ID NO: 132646 - DNA, 1604 bp, Homo sapiens
agacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggtaagaaagctttatgtgtgtagtctgtctgctattggagtgtttatagtatctttctagaaatatatgtattcttgttcagagatttctgtgcccaggctggagtacagtggcatgattttggctgtctgcaacctctgcctcccggctttgagcgattctcttgcctgagtagttgggtctataggggtgtgccaccatgcccagctaatttttgtatttttagtagagatgaggtttcaccatgttggccaggctggtcttgaactcctcacctcaggtgatccaactgcatcagcctcccaaagtgctgggattacaggcatgagccaccatgcctggctgatttctggtaactttggtttttatattttgcatagtctatctaatatagaatagtctatctgtagtctattttgtgtagtctatctgatatggaatgtttgtatatctttttaaaaatatgtgaaggattattaagacagttctggtaactttggttttcatatttaaaaactatgcatatttggtttctttct

SEQ ID NO: 132647 - DNA, 1143 bp, Homo sapiens
attccattggcaaatgaatccttggagcacaaacctgtatccagtttagcagaacctgacttgatcaactttatggacttcccaaaacataaccagatcataactgaagaaacaggctctgcagttgaaccaaggtatcaaagggtacagagacctctttatgtagtaataaatggggtacccttgtaaaaattctgtctctaaagacaacctgactcatataggcataagttctggcatttaagagtacatcttaacttattaccacatagtgtttaacgagctaatgaatgaatctgatgataaaccatttttgaactaagtttaatattttacagttgtcttttacaaaatgaacttctcaacagtaaaatatttcccttttaatatagtcattgccagtttccagaggcgaaatgttctctttctgtgaaatgtacacttggcccttaaatactaattgaatcaaacatttattgagactctattgtatgctaaatattatgctaagctctaaaaataaaaaagtaaatatgactgggtctctctccttaggtggatcgtggcctagtagagattaaatacttgtcagtgtctttattgtacttatttgcatatagcatacttctaggtaattttgtttaataaagatgaaataatatttgagtaaagcaactgaatgggtactttgtctttttaaaataatacctgtatatctacaatatgtcatcttcccacccctcaccagaaccatctactccatcctgtttttctgaccagttttacaaaaatggttgaaggaaatgcaattcttacaaggtggtgctgattcttcttagatatatttagtagactcaaggtccattgtagaaaatactctagctctacagatttagactgtttttcaacatgaacatagcatttcttctatatttatttttaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggta

SEQ ID NO: 132648 - DNA, 1070 bp, Homo sapiens
actataaagcatctgaaatgcaaatatttcttataaaaattgaaaaaaacctaatacattcaggccattgctctcagtgtgatagagaacatgttttaaagagtctgttgattaattttcttttgtaatgatttaacttaacagtatttaagtattttcttttttaggttttcattcattagcatattctcttgcatgtagcaatggtcctaaaataactgatttaaaaaggatagagaggcattatctcattgagaagtgctcttgagcatacagatttaaacagataatattaatttctttttgtattttttttaaggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacaggtagggtgccaacttttatacttacattagtattcagtaggatgaggcttaacttcaaggtcctgaaagtatacaacagtagcagcttaacaagacagatttatttctctctcacttaaaagtttggataagcagtcctggaatggtaaagtgttaggaacctaagatccttttatatttttgtttagctatgcatatcctccatttccaagttctgcttttggtccaggatggctgattacctccaagctgtcacatctactttctatccagcagttaggagaaaaatggatggagaggagagtatgtcttttttcttaagggatagctcctggagttgtagataatatttctacatatattttcttggcctgaactcagttattaggtcatatctgtctgcaagggtagctagaaaatgttgcccaggctggagtgcaatggcgtgatctcggctcattgcagcctcctttttctgggttcaagtgattctcctgcctcagcc

SEQ ID NO: 132649 - DNA, 1505 bp, Homo sapiens
tgtgtcaagggttttagacccctaacttacttagaaattaatctgttactttgtcaagtgacaaaagatgagagaagactctgcttttgtaaattttatttagaaattagagttaaaacagttatgtattgttgaaatgtaataaagttaagccatttttgttactagtgtgaagctttatgcccattaactatgttttaactttaatttggaatagaaacctgcaggaagttacaaaaatagtacagaattcaatgtagccttcacacagcttcctccaaatgtgacacctcatataactaactgtaatgtaatattaaaaccaggacattgacatagttatattactattaactagatgacagaacttaatgtcttcaccattaaaaaaaatgcatctgtgtttttatgctatttgcccattgacttttaaaacatatttgttttataggagtttatacagagaaatcctcttcttatcattagtgtctctaggaagagagaatattgatattggtaagttggttaataaaagattatgaaaggaagttttacattttattttcaaaagtaatttttaaaaatgtagctggtatgtataaaagatttaaaagatttctacttctaaatatatagttcaaatacatataatttgactcaataccaatttgaaatgaacggctgttgtctttcttaacaaattacaacttcatttttgaaaatttctttcagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtgg

SEQ ID NO: 132650 - DNA, 1027 bp, Homo sapiens
ccaagctggagttgcagtggcgtgatctccactcactgtagcctctgcctcagttcaagcgattctcctgcctcagcctgagtagctgggactacagtggtgcgcctggctaatttttgtatttttagtaaagacagggtctcaccgtgttggccaggctggtctcgaactcctggcctcaagtgatccacccaccttgctcagcctcccaaagtgctgggattacaggcctgagccaccgtgcccggccatgttgcttttataattgagatatttcatttgttttgggggttaggcaaatttaatttgccattcctcaaactcagtaacttcaaatataaacaatgcctagaatgaatatggttcctcattatttctatcaaactactacaaatactgaagaatcccaaagtagttttccacagaggcagaaaagcagttcaggggttgaaaatcttcaatattaataagccctgggacattcaaatggcacttcatatttcaaggtaatgcaatatgaatcataattcattatatattgtccccaagagttacttcaattccgtattcaccagttcttacgatttggaaaaaaaaacttgaatgtttccagatgaaatctaatccccaagccttgtgtgtcaacattctagtgaatctctatttaaatgagaggcgctccaaaacacttcctgcaccactcgacactggcacttggtggagcatcaattttctgcaacctttcaagaatctctgaagacagactattgtatgcaattccatattcattgtcaaatgcctctgaaagaaattttcaaaaatgaagttgtaatttgttaagaaagacaacagccgttcatttcaaattggtattgagtcaaattatatgtatttgaactatatatttagaagtagaaatcttttaaatcttttatacataccagctacatttttaaaaattacttttgaaaataaaatgtaaaacttcctttcataatcttttattaaccaacttaccaatatcaat

SEQ ID NO: 132651 - DNA, 1885 bp, Homo sapiens
cggcattgcctcagttccagcactccaggatcctggctttaggtggagaagggtctcaagtaggagaaggctcgcctttctggggcatggagctttttggccgaacggatggcaggcgattgcggctggagccgcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagttttta

SEQ ID NO: 132652 - DNA, 1093 bp, Homo sapiens
tataatggaatttcattcaaattggcttcttaactgtgacctgttccaggggctcttggccaaagtaaattgtgctaatgaggaataacagaaacttcaggaaaatcatgtactcctaaattgaagtcatgaatgaggccttggaaatcatctagtccagccttttcgttttacagataaggaaatgggtcccagggagagaagaaagagcgtgtctaggatcacgtcgccacttccggctctttctactgaaatgacctccactgaggggtgtgaagatagtatcaattatttgtctaagacttgtcatttcaaaaacttgtcgatgtaaattctagtgcatactagacttgtaggttgtcagtaaatatagactattttttcttagtctattggaattttttcttaaaactttttttgggtgtgctagacatgtaggacaaattttcttttaaactaggttgctttatggtttgtgaatggtctctgttttacttatgaaagttatacatgttcactttgtagaacggggggtgacaaactatgtcctgtgggccaaaagggttctgttttgcaaatcaggttttattggcacccagccatgctccttcatttacttattctctgtaatgacagagttgagtagttgagaccttaggacctgcaaaacctatatatatatgtgtgtgtgtgtgggtgtatgtgtgtgtatatatatgatttattaaatataatttttatttaatataattacacatatttattaatgcacatatttaattatacttataaccatatagttatgctatatatagatatgtataatatagttatatataaaatatataatatatattctttacacatatatataaatatatttaattaaaaatatacatatataaaatttattttatttttaggttatagcttactgtaaactcaaactcctgggctcaggccatcctcctactttggcctcccaaagtgctaggattacaggtgtgagccaccatacccagcccaaacccaaaaacccttcatagaaaaaaattgttaaaccctgctgtagaacgtctgaaaaaatacagag

SEQ ID NO: 132653 - DNA, 1043 bp, Homo sapiens
tttccctcctctccctttggcaaatgccctgcactgaaattttgcatcagcattatgctaggaatgaaatttgtgtagctgatttttcacggtgggtccctagctttactgcactcataatgtgtattttttactctaaaccttttttgaaacagctgctttcagttttgttttgttttttaatccatctcactctgagacagtacagctaatcaatacatgaagtaaaaagaatggaaaatggatgtaagtcatgacttttctggggtttccctttggccctaccttcaaaaattttccacctcttccataacttgcttagaataaagacaaattagttttcatgatgaatgtattttaatatcaactaaatacatctgtttaatcccaaattaaagatgccatgatatttcctatggatatttcttacagtacgtttgtgtatttagaggtcacctctacttaacgctgtgtttctcctgctccctgtattattgctgtgtcacactatataatgtagtggttatactttgccatggaaacaggcctttcctcagggttttctgcataccatggccacagagattgagatgttccacttctgtggtttggtgttgaagtttttcccctttactattttagttaaaatttacagaaggggaaaagagctctgaaggtgagggttgctattgctggcatctttattcctgctactatccattagcaatttaatttaaggtaatgtttctcccggttgggcttacagaagggcccaggttgtattctcagttattgtacttctgtatgcaaccgtctactatcagcaccaaaacaaacattcaatgtcatttcacgtgtgctgccttagacattgagactcttactcctggcccagggaacatttgtggatgttcatcactgcaggtgagcattgttatagttagaatcttagctctggaaaaaatgttcacataaagcacatccatgatgcaagataatgagtttcagaggctctctaggtcccagttcccattaacccatgg

SEQ ID NO: 132654 - DNA, 1072 bp, Homo sapiens
gtaagagtaggcatccttctcctcaaaacatagtgaatttgttaacccaaccaagaaccagatatgaactcacctctgcaatgctgccatcttgtcatctgggttgcgttttccaggtttcttatatacctactttcttcacaatttgtctttcgtaatgaaagacccaaattccagatatcaacaagtctagatgaaactcactaccctgaaacccttaaaatgttcaagggtcacctttgcctgtcagatagactggggtttccccttccttagttatttggtgctgttatgctcacttgtagtgtgggtctttaaggtactgctctccccagccacatgtcctgaatgcttcaggaaaagcactccatctctctttgatcatcacggaaactagttttgatcatgttgatcaaaaagagcatcatcaagagtcctgaatggaagtttgctttaaggatgttaccctagttctagaagaagaacttccttgaagaggaaagaggatgtccttcagtgcagcagcctgatttccaatgggggaagggattcttgcctcttttagaacaaaccacatcgtccaaggaggactgtctgtctctttcccaggcctcagaaatttgaatgaaatgtcacaaaacagtaaaaaaaagttggagcttattggccctgcaggggcatcctgaaaagattgcccatcagttcctgctgcctggtcccctagagcaccctgtgtctactgtttttaaacccaattcttgattttctttcaatccagtgagttccccattccttacaataaattgccctttccaaattaagcaggaagtttcttttgcttgtaaccatagtattccaagggctactccccaggaggggagatggtgaaaagccagacacagggaggaactgccaggaagtaagagaaacaaaaagaggtgtggagcccctgggcccaggaccggtaaccatgaaatcaccaacagcttttttaagtgtttcctccccgcctcaaaaaaataatgtttttaaatgctcccatctcagcacaagaaagctgttctagctatat

SEQ ID NO: 132655 - DNA, 1048 bp, Homo sapiens
tgtctttcttttcttccatctttcataagctgtattcgtcttcttaatgggaagacagctgctgcacttccaagcactgcattcccattgcacacaggaagaaggaaagaaggcaaaagatgcatacccattgtccatacccttttcagaaatattcctgaaaacagtgagttctgacaaataaattgtaaatagcagcatctgacaagtgctgcaagtaggtctggggaggcaaacattgtagttgggcagctctcagaaaaacggccttccgttaataaaaaaaaattaaggaataaatcgatattagggagttagtttgcagcatctgttgttgcatccactatgagagtagcttattttaatattaaggctgtagttatatccctaaaaaatagttccagagattgggtaagacaataacagctcaatctggagttgagcagttaattggattgagagttaatatgtcatgcttctgtgaaagtcaaataatatgtcaggaatggggagcacattttctattaagagccactgacctatagggagtagttcacaaatttactgtattttttaaaagaaagctaattgtaagaagagaaggttaaaagtttcagttctgctgttactcagcgtggcattaggtaatctaaaacttcattaaataaatgataggctcaataattaaaattattctcttttttaagattattgacctaaagagaatcagaggtaagtgatagaaagagaataacagacaactcaaatcaggtagaagtttgtcagctgtttactctgtgcaaattttcttttattgccctgatactaactttgctgcctcccccaaaaaacgctgtgcccaatacactgcccagatacagcatccatgtccaataaaattattagtagaataggaatgggaagatactttacatggtaaaagaatctctcaaaccaatcatcaccttcattcttaatgttgagacttcagaagtgttctcctgaaagccagggcaagagtaatagtaaccgtcatctctgtcattta

SEQ ID NO: 132656 - DNA, 1048 bp, Homo sapiens
tttgtcctctgaaaagagcctcctcagggtgtgtgccccattagatatctcagtgactgttttttatggtcatattcaacccctgtttctctccttgtctctcagaccaacctgtcagcattccttttaaataggagaatataacctctttaatatgcccatggccttataacatttccctttagaagtcttttgtctgataaaaaggaaactgatagggaaaaaagacctcaaaatggactgaaacttaaagtagcttacttataccaaccaaaatcctgaccactggctgctctcaagtttagttgatgaaaaacgtatgacctatttagatgatttccctagttgttatttagaatatctggatattctgtgattagttgttgcccacctacttattgctgcaactcctgagtctgtgtggtcatcatgtaggtttgtgagtcatctgatacagatacacattttgggggctgcttttcttgttccctgcctgaccgtgctgtgttagcatgtcagtgccagtgtaacatttgatcttcactgcacttgtgaagtctcaactgtttaatcagtttaaatacttagccttccacttcactcaagacacattttaaaacagcacttcaactgaacacttcattaatgtaatttagttaagaaaaacaagttctatcagtttttgctaaaaggatgtcccagtgtatccttttcatttcctatcttgtatcttgtctgtctgaatacattatagagctagaatgtgattgcctattcagagtgaaagaaaaactatcctgatttctaaaacagtttctgtttctgagaagcatattacattaggtgctatataaccagagaggaggggagcaaatacggaaagaggacatctctgagggaggactacattcagcacagtagaataaataaatctctcctattgtggataaaagaaaattccattttcttctgaaaagaaaaaatggggaggaggtggtgtggattgtctttagttctttaatttttaaaatatatcattgtagttttc

SEQ ID NO: 132657 - DNA, 1033 bp, Homo sapiens
gttatgctgtactttcatattatgtacaagaaaacacatacaaaaaattgaaaatttaaaagtaaaagactaatatgaaaagaggtcttgttattttcttttactactatgtattatcttacacacatctatgtaaacatatacattcatacccacacccaaagaactttggagttccttgatctagatagaggaaagagctccagtattctaattctattgaggaagatataaggcttgtagagaaataacccttgcaactatcagtagtccttgtttcataagctgataatgagaaaatgttgcatttttgacctggtgaagatgaggtagtcttaagtcaacactttttccccagtggattttggttatattaaaagtcaaactaccatggacataagttcttagcaaataaaataaactcttaatgccactgccatgatagtaaatccaggtttcacatttaatcgggaaaattctgtaagatagtccaaagattaaaattaatacttcttgacatctgtgtaaatctgtaaagattatattggtgtcaatcaaatgctttatgaacattttaaagtgacacattttttaaaaggttaaagttaataaggaaatgtagttaaatgtcttgtcaaaataatctcttcagatatatatcttttagttatttcatttcattatcacctttatttcctgaattcattctatttaatttactttatacttttttataatcccaaatatactttaatatttataatccagtactgagccctgtagccataatgtactttttatgactttgttcaattcagtgttcagttcaatgttgccgttataaatgttgagaagacaaaagtgattttccactattttaaatttcttatgctctgcacaggagggttacttcacaagtaactgaatagttctgacaataatctcaagatctcattgtaaactgacaagtagtggtgtttcgatgttcattggtcaactccaataacacttaattatgggccagttctatcag

SEQ ID NO: 132658 - DNA, 1051 bp, Homo sapiens
aattgtttgacattttaaaataacgtaccccccatcatagagctgatagctgcatttgttttctgctcctcaccaacacatcttaatatatataaatctcaatgtgtatgcatatatacaacacaatagtgttgtaggtgtagttaatagctgccagcaaacagtgccatctgtgttttctcttgtttctcacttactggaaaatgttactgaagctcaaattatgagtaggggcttaaagttcatgttcagtatctccaccttttaactctaccaccttttatttgcacaagaaaatgtgatcctctatagtgactttaccctgtttacagaataggagtgtgtgctattactgataggatgggcaggtcttacagtttaaaaatacccataagacaaatagatcctgcaatctttacatagtcatttctttactttgtacttcataaaaccctgcaggctagagcaaggaattgatgtaagttgatgtcaaactgactttacaaaaacattctggaattctaaatcagtgtgatttaagatcctgttatactaagagaggtagttaagcatttgacatccgatctctctagaagaatgtctgcttaccacacatacagtagtatcagatgggagaagctagtttctaaaacagttcggggtggatgtttgcctctgattagcctgtgtatgtgttagatgaatgagcaattgggaagtcatgaccatgtgtttgctgtcatttaaactgccagtctaatctaaatatacatgtgggtgcctaaggagacttctttcttttcaagaagatcattcttaacagctctccattccttgctgacacacatgaacttaggggcacttctgttttcctgagggctacaccgttttcttttgaaagaggtgagaacaatttctttgcttgctgtgtttctaatttttaaagataaactatatgtaaagtttatttactatgagtagtaatttcataggcaagatagcttctgggatattatgtaaggtaatgaaaaatggggtgagagggatggaa

SEQ ID NO: 132659 - DNA, 1023 bp, Homo sapiens
gtttttagtatattccagaattgtgcagctatccccacaatacatactggaacaatttcactggccccaaaataaacccataccctttagctatcaactctcaattctcttatctcccctagccctaggcaatcacaggcaaccagtaatctactttctatctgtacagttgcctgttctagacaattgatatgaatggaatcatataatatgtgatgttttgtgcttggcatctttcacttagtattgtatttccaggacttacttatgttgtaccatgtaccagaacttcattagtttttatgtctgagtaatattccattgtgtggatataccacaatttgcctttctgttcattggctgatggacacttggattgttttcaccttttggctgctgtgaataatgctgccgtgaatggctgaaaacaggtttttgtggattcagtgtttttttacataatatgttactgatgaaacattactttctgatcctactgcagcatttgcagtttctgacattcttgttcatgtaattttctatttctcttcagagcatcttgagaaggctgaaagaattctgatatatgttgagggagatggttgtttttctccccactggaatgtcacgttaggtcagttattaccaatattttcaccacacacaaaaaaacaagataaactatatggtctcacccacattcttattcttggtgacatcactctttttcccaatatgctggcatataactttcgtgagaaactgtcttgaaggatcccatcttttggaatcatggtggtttttttttcctttcttcctgtttattctttgtttttgacaattaccttattattgttttttaatgggagattcttttggagaatagttttgtttttttgagaccgagtctcactctgtcacccaggccatagtgcagtggcacgatctcggctcactgcaagctccgtctcccaggttcactccattctcctgcctcagcctcccgagtagctgggactatag

SEQ ID NO: 132660 - DNA, 1007 bp, Homo sapiens
tgttagattggcacttaaaaaatgcatgactaattactacataattgaaaaaatccaataatgacttttctcctctgtcaactagcattacttttatcacgcaataaaaagtggttatgtaaggcatagctgttggagtaaagaagagaggcattgcacatatttacagtcttcaggcactgaccttttcatagcatgtaacctaaaacattcagacctgtatttaattatatcagtgaatatttttgaaatcgaagggaaatctttatagcaaggtctactgtagatgatatagtgctacagttaaagatagcgttctaagtgagtaatgtgagcatttagcctttgaaatgcaacaatcagcatccagtgataaagtgagcataatcttctatgagtagtcctgacaaatcctcagattccagaaattgccgattggtaagtcctatagtgtttcccagtaaactctggaattgaatttgaaatacgtagttaaggaacatttggaaaagactgtggctgtcactaggtcctacctggttattatacctaacaatcctaatttctttattttttataaggttgactagagaatgcaatggctcatcctcatcagcatttttttttaattgagatggagttttgctcttgttgcccaggctggagtgcaatggcatgatctcagctcactgcaatctcagcctcctgggttcaatcaattctcctgcctcagcctcctaagtagctgggattacaggcatgtgccaccatgcccagctaattttgtatttttagtagagacagggttttatcatgttggtcaggctggtctcaaactcctgacctcaggtgatccacccgctttggcctcccaaagtgctgggattacaggtcatcagtcttttaatgataccttaggataaggtagaagaggacctggtgattcttgagatggatggatttgtactcactctacaaatgcatttaaagagtccatgtcagcctgt

SEQ ID NO: 132661 - DNA, 1004 bp, Homo sapiens
tggtctcttaagtacctttccattcttttcattctagtaactacctgtttatcctccaggacctaattcagatgttacttctttatgaatttttgaattattcttcgccccatgctcccaacagaattaatagttcccgtcttttggttgtcaacatctatcaatcatagatacgtcatagttattaagggtggggtccatgtgttattcatccttgtatcttctaggacaagcagtagttaacatttgttgaattgaaatgttttaaaactccatgcttcagatgattaagaaaacagctttcctcattaaattatttgataataacctactctcacctgtttctcacatacactattctcacctgttatattgtggtttttggtttatattaaaatatttttggtattttaatgatagcttgagaggaatcaaagaaggatcattttatgtagatctcttttgactcttcattgctatttagttttgggagtttcattttcttctcccctttttgcaggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagta

SEQ ID NO: 132662 - DNA, 1049 bp, Homo sapiens
cctaggaaaagtagtttcagcttaaccaggctaacacagcacaaaccacaacatcctgctaattaatgagctttgtaattgtagtgcttattttttttaatgtgtgtgtgtgtttttacagtgcgtgttatgaacctaacctcccctgtactcatgtgacgtgtcaattatgctaaacaaatatagaatataatttggagtgatctaattgggatagaatggagtgaaggttagtccaggcatgaattataagcctagatctttccagaaacagggctgattacaatataaacaatggggagactgcatcccctgttacatggaaggtgtttatagcaacataaacaccttttcaacacagtaacataaacagtttctcaaggaaacattctgtagcattcaggaaatgtttctttctttacaaacaaaaaagtgtgtttttctaaagatttaatttactttagggctctgtttagaacaaggcaatgattgtagagggataaagttattcccagagcacttttgtggtaggttacagttgaaatccttatagaaagcatcttgttaaaaattctgtggactaagcacaggtcagtacaagtgtgacatgttgcatattgggcaaacctatggaaagttctgcaaattgtacttttgtgactcaaactgtgttataaatttccaggagcctgttatttggtattgtcttatgaaaatccttcttgaaattatgaggaccctttgttacaggtataacattgactgtctactgtgagccgagggcctatgataggggttatgtatttgtctcaagcatatttaaattaatttgtgaagtaaatgcttcctcaaattggtcaattaggattcttacattaaggttctttaaaacattttttaacttggagcaactaaaaatagatttcatccacaagacccatcttaggcttgaaaaagaggacaattctttagtaagaatgctttgttaatagagaatggtgaacagatatacctattttcagtatgttattaaaaaatctagttccggt

SEQ ID NO: 132663 - DNA, 1058 bp, Homo sapiens
ataatttattgttcagtgtgtgttttttttaaagacaatgtttttagagcagtttgaagttcacagcaaaattgagaggaagatgtagaaatatcctgtgtaccctctcccctcacacatgcatagcctccctgtatcatttacagtgggttttaaaaacatattaaacactaaatgcctgttatgggctgagttatatcctcccaaatatatgttgaatcctaaccccaggtacctttgaatgtgaccttatttggaaatagtgtcttttgtagatgtgatcaatttaggatgaggtcatcatggattactgttggcccaagtccagtgactgctgtctttatgaggagatactttatatgaagatacagaggcaggaagaagcccatgggaagatggagacagagattggagttatgctgctacaactaagaaatgcatttcaaagattgccagcaacctccagaagctaggagagtcaaggaaggattcttttctagagctttcagagggaatatggccctactgacactttgatttcagaattctagcatgaatggttaaattcctgttgtttcaagccaccctatttgtggtattttgttacaatagccctaggaatctaatacactaatactaaggcagtatgctttagtgcttaaagttatattgaaacaataaaaacaatttgctcttcaaaagttacaaaagttaagccacagcctgggagaaaatatttgttaacatatgtctgacaagggcatgaatccagatcaggggtgtccaatcttttggcttctttgggccacattggaagaagaattgtcttgggccccacatgaaatacactactgatagctgatgagctaaaaaaaatacaaatcacacacaaaaaaatctcataatgttttaagaaagtttacaaatttgtgttgggccgcattgaaagccatcttgggctgcatgtggcctgtggtcggcgggttggacaagcttgatctagattatatgaataacctacagctgaataataagatggttcagttataaaatgggca

SEQ ID NO: 132664 - DNA, 1203 bp, Homo sapiens
tttcagacatcttcaagtgaggcataggaaacaatgccataagccaaggtaaggatgaatgaggaattactgaaatagaagagtttttattttagaacttataggctaacctcttcgaattcttatcctctgcccacttgttatttttgctgttacatatgtgtactttgtacagattccatttttattctgttattcatttttatgactttgtttttaaagtttcttgttctctgacatctcaggcactctggtttctacattccaattttgttggaggaaaaaaaagtttataatttagcaaataaggtgatcaccatgatgaaaagtcttactatttaaatttgtgattatgtgttgaggtcatattctgtcacttagtatgccatttatggatgatgttttaaaattaaccaagcttcttgcagaaagtgagtttaaaatcactgtcatcttggtttatttcctctcttagcttttgatctatttgactttgacacatgcatctcaccaacttctgtagattctcattttgacaggatgctttgattaccaccaacaccccaccagcaaccaccccctgttctggttcaagccatcagtcactaaattggatgttcttgcatctgttttgttcacttcatgtcttttgacttatggtgagcccttcttttttttcacctgaacttagtaatttttcctacttttgggctcctttccgtcaaaccatttttctcattgtggacaaatacctttctgaaaacatgggtctcatcaagtttttctacttaaaaaaataattttttaaattgaaaaataaaaattatacatatttatagtgtataacatgatgtggaaatctgtatacattgtgaaatggccaaattgagctaattaacatatgcattatctcaggtactcatcatgttttgtggtgagaagacttaaaatccccttaatgtttttcaaaataaaatacattgttatgaactgtagtcaccatattgtacaataaatctcttgaacttattcctcttatcaagtgaaattttatatcctttgaacaacatctccccaactctccacctgcccccacccaccaccattctactctttgattcaatgagttcagcttttttagattacacatacacatgaaatcatgtgattatttgtctttctgtgtctggcctatttctctta

SEQ ID NO: 132665 - DNA, 1046 bp, Homo sapiens
ttagtgaacatgtcaaatctttttagccgtttgggtttaaaacttttttttatgaatttattactttttgttctgttaagtttctttaatttacgaggctagtctacttgaattgtatgaagtctgactttgtaaagcagtggtttgttcttacccatctaaatcatttcttgtgcctgaatttttaatcttttgtcttcttcattctttacctctaagatttactttcagttcctccctacagttatgactggggttttgttgactagaatttcttctgctttaggtctctagatcctgggatgatagtgttggcactgcggtagtgtcctctcctatctctttctaccatctgtaaacactttcattctccttttagtggatgggcctcctgaggatacatgatgcagagtgtttgtgaaaggaaactgataggactgaagacatttttctttataaaaggggaagggcggaatgtggggtgagaggtaagggaatggatctgttgtcatccttacttgtttcaagtgttctgtaggtttttcatttacctgcagttttgtgagaccataaataagaacattatgatgggaaagttgcagtattttaaatttagagcagtttcaaaatctgtgattctggttagtaggagacagatgctaaactattttattgtgatgcattgaaatagaacctctccttttggattaagcagcagggaatatacatttgaatatcttaatgttattgaattaatttccagatttattatggctacctctcccctcatgtaaactgcttttattctttttttaaacaaatgtgttatattttgatgtctaatcatgattttaggcatactttatttggattgttatagattcttattgtgaagagtacctttccttttccttttattctattatgattttaacattaaaatgttgagccaattgatttatctatttttctgggcttgagatttgtttttttttttttttttccattttgggaatagactacatgacattttgtgattggttaat

SEQ ID NO: 132666 - DNA, 1079 bp, Homo sapiens
tcttaaactttctattaaaactatttcctaagtaaatctaaggtttatttggataacagttatattgttatcaagaaaaacatgaatgtattacttgggaggaatgtcaaggtagattattttgggtccttaaaaataaactgcttatcagaaactcaaaactcgtctttattatcacacctatcactgggctcataggttctgttctcgcctcttctgctctcaaaccgtctattctgccccaacaacaacaacaacgataacaacaacaaactgggaaggagatgttctagcagctagagtctagctgctagtggtgccgcatgtgatgagctgattctgctcacacgagtgatgtcagccttaattaaaaaacaaaaacttgaattttggtggctgaggaaattaaaagggtagatggaacacttgctaccttgcacctgaactctaccttgtatctactgggtggtcttttgcaagtgacttaaccttatttttggtgtgtgttaaataggattacgaatgcttccatttctaaagtgtaagaaggctctgatgtgagtgtaaagttctttgcaaacaagactccaagtaataaaatcctaaaaacatctttgctactgttgctcactgtcctctgccaatatgcttctgagaattgatcagagctttataaaaggaaagtggttacagtatgtcaggaagcaaaacccgtgagaaataagtaatccataaactttacagtcataaagggatccgggtgggtggatctgatgacttggcaactcagagagggaagcaagtgtaattgttgattttatcagagcaggtttgtgtatttgtttgtgcacgtagggggatgggggttgaatgaagacttaacaacatgaatttcgtgaggttacaaaagtctactgctgcataaatcgtaggtaatatgttcatgtctatagggtgtaatgttaatgttcaataaaaattaatatcaaagtctgtcatagattttatgttttggggcctccaggtaaatggtttgtatcatcattgggaatttatggaagttgatttaagtatacagt

SEQ ID NO: 132667 - DNA, 1004 bp, Homo sapiens
ttggtctagttgtagttaattaattagaaaggaataattaaaattaagattaaaattattgtttcttacagacttaaattctctttccaccgttcattaggcagttattaatttagccacttccgtttgagtatctgcaaagtagttaatttagtttttcaaaagtagtcatttttcaccctcattttattggttaacaaaataataaattacttaagtacaagagcaaatggtcaagaacaaaagcaaaaagccaggtttcggaacaaacaagatgccttgtactaagtatattatgggagaggtacttaatagctatatacatttgctctttggagggtgtcacccatgtattttacagagggaaagtaggtatccttgtcagattgagaggtaagtgaagtcagttaaaagtttaaagtatatataatcagctttgttttgctgaactttgttttattgagagttttgtgcaatttataatattgtttcattgattttctttcttattgcatcttatatggactgttgtaacattctgtgagtatattttgttcatgtcatccatttttggtgttcagtaattttaaaaatgaattttaagtagggacaggagcttgaatatgtaatttggttttatgtaccagaagatccatcagaaactgagtagccaaacttgtaacaacctgtattggtgcatattctgccagactatgaattttcttaagtaatagagaacagaggtctttaaaaaattgtgaactgagatttttttaaaggtgaaatgaaagcagtactgtacaggaaattaagtttttgggtaaggaagtggaattggtttgattgaaattgttaatgtctctttaatgaggggttatatgaaaaatgttaggcagaaagtgtgatccagttaaaaatcctaaatatgaaattgattcagtttgaacaaacagtatttggaactgaacagagaggaaaaggaaaattcttatgtggaagaaact

SEQ ID NO: 132668 - DNA, 1059 bp, Homo sapiens
tcataccagccaccattcattaaaaaaatcagtgaacaagctctttaattggaaacttatctctccctgtttacttgaactcttttgttatcttatttctcccccaacttttatttatttatttatttattttgagatggagttttgctctttcgcccaggctggagtgcagtggtgcgatctcggatcactgcaacctcctactcttgggttcaagggatttttctggctcagcctcctgagtagctgggattacaggtgcccgccaccacggctggctaatttttatgtttttagtagagatggggtttcaccttgttggccaggctggtctcgaactccttaccttgtgatccgcccacctcggcctctcaaagtgccgagattacaggtttgagccactgcgcctggccttctcccccactttttattctaatataatacatgttcatgttttagagtcttttatggattatcatgtcatacttatgtaataaaaatatatcaatactgaaaattaaaaatatcctatgcctcaaggattatttaatccagaagtaattgtataaatatttccatttgtggaatggagttgatcaaaataacatgattatattacaaattctgataaatgattgataaaaaataaaaatatttctgtttatacattcatctattgcatatatacaggtgttttattctttataaattcgtttattactagatgagaaaagatttggcatcatttttattttccctttttcttttctgtgtaagatgcaggcactgaaaaaacttgtcaaaaatgaaaaagggagtattatagcagtgccagtcaattgtttggagtttttctgaagttatatggcaaaactcacacagtaatctcatcagaacttatttttaatgatttgttggcagatggcttaaagaatggatgctcctgtaattttgtttgaagcaatccaacttgcaaaagcattttgttcccttttagacgtctagaaatgtttcttatttatttatttgcatcaagaccagtttgcttctagtgggtct

SEQ ID NO: 132669 - DNA, 1953 bp, Homo sapiens
ttgacaaaaactgttctaacagaagtgaaatgatatcttattgtggttttaatttgcatttccacaatgattagtgatgttgagcatttttttcacatacctgttggccatttgttttgtcttttagaatgtcttttcaggtcctttgcccattttaaaatcaggttgttttctgcatgttctcactcataagtaggagttgaacaatgaaaacacatggacccgggatggggaacatcacacaccagggcctgtctgggggtgggaggctaggggagggatagcattaggagaaatacctaatgtagaagatgggttgatgggtgcagcaaaccaccatggcacgtgtatacctatgtaacaaacctgcatgttctgcacatgtatcccagaacttaaagtatagtaaaaaaatacataaaatcaggttttttttattgttattgaattgagttgcttatatatttcagatattatgctcttattacatgtaggttttgcaaatattttctcctattaataggtcatcacttcactgtgttgtttgtgtgtgtgtgtgcatgtgcttgtgcacactatgcagaagtttagtttgaggcaatcccattgtgtagttttgcttttgttgcagttaaaaggtttttgttggaaagttaaaagcttttgttggaagttataagctcacctgcagcattatatgaaaataaatctttgtttcccaaggaatgatatgtatatgtgtgagtacacgtggtggtccttgtttttttctgtgtgtaactaagccactgtgtgcttttctatactacaaagacatgtcttctattttcagtgagtgataaagcctagagttttactcatggcttcttaattttgtatgaaatacagtttagcaattgtgtagttagtttacaaagtctaggtatgactcatcttcaggctatggctttttcaagttatgcttaaaggtcagaatctatttagttcttaaccctgccttttctaagtgggaagttagagtcaaaaaaagtaagaaaatatggaatttgttgggacttaatccagacctataggtttcttattttattgggttgctttttaaagaagaacaatcggtattgctaggaatttccagaatttctaagtaatttgaaagttaatcgtttaacagtgttcataaaagttggacctttggatttttgattttgcttaaatgtttggttctgacaaatacaaaaattggtaaggttcacaattcattttctactcatgtcataaatgtacatatgtctaaatctgttttgttgttatagacattccagaaatctcatttaaacaaaaatagtttgatgtaagtagcttaagaaattgttaaaactgtgatacatgtaggagaaataatttccatgtttgttagaaagtgtagtgtttatgtttagccatattaattttagtttcatttctcttaagtgttagtgaataaccttgaaaaaacacagtactttgactctgctgttgttgtttattactaccatgctagtaatgctgacggaagaaaattaagattctatgacttgattctttggaattctgactgttgtcactgtataaataaaacaatctctggctgctcatgcagtttttgtcccttacaatataatatcctggcatttttcatactctattttcaaagccaaggtctagaattttaagtgggaaattggctctgaaataatcaaatgccaaacaaagcccatctgaaagtccaataaagtaaaattatagtaattgcaaaatagcgttactgagctaaatccccacagtttgaggatctttcatttatagaatagatgctgttgtgttgtcagagtggagggaatgtagtttgggccagctgggggcaaatgaggagccaacggttcatttttctgctagggttattggaggagaaag

SEQ ID NO: 132670 - DNA, 1004 bp, Homo sapiens
ggacttacatggacttcttttgagtttatctagcagttcttacattcttatttagtcaaggtcagcagaagagctgactgtagtacagatcctccaaattgttgtctatctcttctatcatgccagccactaataattccctttgtggtggagtatttccttttgcaaatgataggaacttaaaggaatccttttctgtttagtagtatgtaggtctggattcagttgttgatagcagagaccactttagccagttttagcagggagagatttgatactgggaactacagaggatactggaggatcaggttttaggttaaatttctaggaatgattcccaaataatatagaactggccagccaggaaaactgctatgtctgctgtaatcaggaagctgaacacatgagcagtcttccattatcacagcagcagacttcaagaccctaaagcctagctggcaaaatggtgtgtgtgttcactcttctcccttgaagctgaaaactaaacactaggatttattcagaagcacagccccaccccacagtgcttatttctacctttcgaatctgtcatggctgtgtctggcagaagtctgtcttctattgtgcagtaatggggctagaatggatttgaatggacaagtctgtgataattgcccaagtggttggtatattggtatgaaagtgagagatggtcaaggtgaatctttgctgaacctggggctctttgtcttgctgggagaatttcacagagatgttgaaaaggtacatgggttaagagaacaggcgctgtgaaatgaaagttgtgttttcttctctggagggcatttcttcagattcatatcatctgaaaagataaaaacaaatggttatactcctggatcaaactttattatgttgtgttttgaaagatctcagagcctaactccacgtgaatatatcaggttagtgtctagcctacttcatgatttttttgtgcatctgaacattcagggccttaaaaa

SEQ ID NO: 132671 - DNA, 1028 bp, Homo sapiens
acactgggaaatagaacagtgaaaagagtattttgcgacaccttgccaaagaaaatgtacagatggcaaataagtgatgaaaagatgctcaatatcacgtcattagagaattgcaaattaacaaaaacaatgataccactacataccattagaatggtgaagatttagaatcaagtgctgggaaggatgtggatccacagggactcacattcactgctggtgggagtgcacagtgacacagccacttttgaagatggtttcacggttctttacaaaactaaacacactattactgtacgttgtggactgactgtttttgtgcccctaccaaattcatacgttgaaaccctacccttctacgactgtatttgtagatagagcctttgtggaggttaaagggtgggaccctgatctgatggaattagtgtctttataagaagggacaggatgttgtgtaccataaatatgtacagtttttgtcagttgaaaaataagagactgaaaagaggcctgcctgccccccggttgtttgaggacacggtgagaagttggccatctacaagtcagaaagagagtcctcaccggaaacagaatcagttggcccctttattttggactttccagcctccaaaactgtgagaaacaaattactaagccaccaagtttatggtattttgttaaggcaacctgaacagattaatgcatcatgtgattcagaaatcatgctccaaagtatttactcaaatgagttgaaaacttatgtccacacagaaacctgcccatgaatgtttataacagctttatttataactgcccaaaatttgaagcaatcaagatgtccttcaataggtaaatggaggagctggtgcatccacacaatggaatactgtttagcaatgaaaagaaatgagctatcaaactacgaaaagacatggaagaaccttaaatgctgatgcagtttggctgtgcccccacccaaatctcaacttgaattgtatctcccagagttcccacgtgttttgggaggg

SEQ ID NO: 132672 - DNA, 1051 bp, Homo sapiens
tactttaagttataaaaattatagccagttataatgttatgtgccaaattatgtgccccctacccatgcaccacaaattcgtatgttgaagttctaagaatgactatttggaggtagaatccttaaagaagtaattaaggtaaaatgaggtcattggggtaggacctaatctaatatgacttgtgtccttataagaagagaagattaggacagacacaccaagaaaagaccatgtgaaggcacagagaaaggatagccatctgtaagccaaggagaagcctcagaagaaatcagccctgctgatatcttcatcttggacttagagcctccagagctgtaaataaattcctgttgcttaagccaccccatttgggttgtttaaacccactttgttatagcagctctagtgaaggagtaagcataggtaagcaggttattctggtttatatctaaaaccacatgtaagttggggtaggggagatgatagggttaagtaaggatggattgtgaggctaaaagtctaatttttcatcttccattttaattttttgggatatgtgattggaataggtagaatgtttactcataggcttgccttatctttttctgatctcttaatcacttgggaatgaaaatatgataatataggttggcggctcactaattcttattcattctattcttaatttatttttattattaaaaaaatgtgttgcctaggctggacttgaactcctgggctcaagcgatcttcccacctcagcctcctgagtgactagctacaagtgtgccaccgtacctggcttcattctgtttaacatttcttaaaaacactcttcctttcttttccatttgggaattaattttctgtttttagtttcatgttccttagaaaccatctttcacatggttgtcacaaaaacttttttttgatacacattcacttatctgcttaaacacctttctcttaaagtattctttctgtgaaatatttcatattcaagatgctccctaaatggtgagttcacagtttgcatgtaagtttggtaat

SEQ ID NO: 132673 - DNA, 1001 bp, Homo sapiens
tgtctttcttccaacaaataaatgtaaattaacaattatttagaagtaaagcaaatgttgctgagacagaaacaggacctggttgattttaaatggtgctttggaacactaagcagatatctaagtttaaagaactatttggaaaaaaattgttttagttaaaaaatattagtaagcttctatagaatggcagaattggtgactgcagttctataggaaccttacttattgtaatctcttactccttttattttccatttctttttgtttctcttctgaaaattcaaaagcatgaaataggcttcacagaaagaaaaaacaaagctagtaattacaagacgctaaaactttcttatcttattggtcaagtgcaatacatgacaccactctgcagtaatactggtgttcagaagagttatggaagaatctagtaataaacatagtaagaagaaggagggatgaacctcatttgtatggttgaaaagtagatggtcttctgaggctcttaacagtatatgaaggtaaatttgttgtaaaggaaatcttattcagatttttaatatgatgtctatacaaattacttgtgggacaaggatgatctatttctgcagtaagacctctagctccttatggacaggattttttttttttttaagtcactgtgttactcagacctttgcacataagtggtattaaataacaactttatagtaagacacctttgtaaggccctagataaataaaagtacttcagtggcctactgtgtgccaggctgagtactgggtactctccaataattaccttattagtctaatgatccctatgaattgaggtactacctgtactatccccataatggatgaatttatcaaggttatagcatacaagattagtataaaaagatagtatttctacgtacttgcaatgaacaatctgaaaatgaaattaaggaaacaattttatttataatagcatcaaaaagagtaaaatacttaggaac

SEQ ID NO: 132674 - DNA, 1413 bp, Homo sapiens
cctgagcacatgcgtgtactatatgggttaggtgtttgtgtgtctatgtgcccatcccacatatcccatatacaaatgtagatttttttataagccatgtgagagtaaagttctgttaatttatagtcaaaacatataatttgcccatacatacaattcctttattgaaattctgaccacatttaaccttattgaaagcttctagcttgaatgagttttgctacattgaataaatactatgctgtatagttatttatgtgcttaagaagctgaactttcattccatcccagtaagttcccatgggataagttattttagtaaatcagaaaatttctctgaaagcaaagtaattcttaatttttggaggcttgaaaatggagaaaatagccatacgagttagcgggaagaagttctcattgattcatatcgctaaaaaataatttaaaatacttgtactcttaaattatcgtgagggggaagaacccaccacagtgctgctgaattgttttacttctgggattatatctttgtgtgtttataggagtgggaacattttatcttctgtgtttctgttgaggttgtttttcagcagtgccccaagaaaagtcctggagtctagctttgaagcccggtggacaagctggatatcaaagagccagaggaattcagcagtaattgttttatgactggccagaaatcagacctatttgtataggtagcacacaaaatagctgtgatttgacaatttggtgctatttatacccaccataaaaagagaaaagaaaaagttaaagggatattttggaaacaggaactaagctgtaaatgcaaattgcttcattttctcaaaggaacaaaaaaagaaagggtttaggaagtttttattgaagctacattattgaggatctgtctgctttcaggacactcaatattgtactcacattgaaactacacttctttctgtttgcagttttttccctattcccatctgactaaaattatttttgtggagcaaaagaaactctgggggaggagggatagtggagtcacaaagtttccaactctatcttagtagacatttacagtttcatattgctgttgttatttagcttggggtaagaacagtctgctgttgctacagctaagtatttttccatataaaagttacatattttccacagtcagttgcagatcatttattatagtgaagtgtgagactttgctaggtaagttttcatgtgtttttttagaaacacgcagaataaactttctactttctatgactatttttgatctggaagccagagacatctttttgaatacaaaacgccttaattatttgttcctctcacctggagaatattctgaactaaaggtgggcagtgtatcatggtatgtctctacttaagtgg

SEQ ID NO: 132675 - DNA, 2861 bp, Homo sapiens
gtcttgaccctggaattttttggcaaccgtataaaggcaggtattgcaagtcagaaaaagggttttagaatccctggctttactttccactcctgtaagttataaattattactcagatttctgaaactcatttcttctgcacctctaataattgactttgtgtaaacagaaccaccacttgaatttagcaggaaacattgtgtctgctgagaatcacattttctagaatgtgttctagcatttgtaataggcaaaaatgaatttttctcttttctcttttttcccttattctttcttcacttactttggatgcttaaaaagaaaagctagacacaaacttgaaggacttggccagctctatcatttttttactacctaatccatgaaatacaaccagccttttagctttaaaaataagagtctaatgtaattccagtaactggtaggagcagtatttagcagtgtggcaggaaaggccctggcctgggaggtagaaaggatgtgtttggactgaataagctgtgtgggcttttgcagctctgaaaatactgtttttcctttagttttaaaaaggataaattctgcaattgtcattgatctagtgtttttataacaatgaaataataactaccctttattaaatagctatattggttatcatgctagacaatagacatgtggagtatttaatttctgactcttcctaagtagtagttcggagaatgatattcttgagaaaataaaataccaatatatgaacatcagtgtattggaattttatcctttcttatggtgaatggacagtgaaatgggtgaaagacttgctgcagtaatagggaagtagaagataacatgagtaattcaccaaataagggattaagttacacttgtaaaagttaatttctgatcatatcggtgccattcacctcaaccatcaactattacttgtagattggagcatttcaagaactcagaagaccacccagtgttgataggaaacttcttcctcaattatggctcttgaccatgccattagatcgttgggtttttcatgcttttttgtcttttacataaaatagaccttgaaattgtgtcacttaatttgcttttctgaagtatcacttaccagatattacttgtgtttttattatcaatagagtaataattgaggactgcccatgtaagctaattgagggctgtctgtattatcatgtgaacagattagaagaaagtatatgaaatttttgatcatccaacatacttgcatacatacatataagaataaatagggttttctatttaataattcaaatgctgaattgaagttgttttgaaaagcaagtacttttctactcttcagttgtaacatgctgtataacttttaggtcaaagaaaaaataattttagttagcattccaattctgtaaaggaaattgtcaagcaattgactagagccgataatttatccaaaaatacacaaatgcagacatttaaaatagagctgcaaataaataggaattttcttacattgtaaaggctaaacaatagcttatagttaatgcttcttgacagagtatcttttttaggttaacatcattgattcagttcattttctgtgttagaatggctagatttgttcatctttaccccacattttgagaagtatgtgatagataaaaatacatcactgaaaagatgggaagaaatactatcgtagaatgttaatataagtgatctctgggacgtgggatatcaggaacttcttattgttgtcagtaaaattcgttggctttttcaagttttcttgaatgactcatattatgtgaaagtaaaactagtatttaaatgtatgtatgggcacatttacaataagatttttagttttttctacaagtaatttggaacatgattaagactgtctttcccaagaaacattttcaaattttgctatttgacatttttgccaccttgtcgttttgagtcttttcctttaatgttactatgagtatttgcacaatgtttcataagttgatcgtaagctttaaagggagacatgtagataacgttcttacctttcttaacattttgtattgaagttataaaagtaatgagattaacctgatttataaatgtgtattcatataggatagtcttggtaacagaaagatacccatgtgtaatatatcagtacagtatacatttttggagtacttaggaatgttttgaaaagttctggcccttttttcctgtggagttttgataactttgataattaacatgtctatcttgctgtgtagtgttaaaaatttttctagagcctacatctgactttaaaaatcaactacaaataaaaagactgtcatcatgttgcttagatatatggtgattatgttgaagaataaatagtattgataattggaaataaaagactcaattccaatgtgtgcatctttgtatataatttggaagttaaacatgaacttttaagaaataaaaagtaccaaaacaagtaccaaacataaggcatagagaaaaaaagatttagggcagagaaagaagtggtcctttttggatggagaattcatgcataattccataaattcaaactattttgatactaagatgattttattaatatttcatatataagctacaaaaataactagaggtttttacaaagggaaattagtacataattttatgttttatatacaatgcagattgatatgaatattccttaagcataactaaaaatgatttccgcaaaatgaggaggttaattttagttgtctcaagggtctctctgcaatctaaaatttatctaattaagtccatgattttatagtccgtgagaaaacac

SEQ ID NO: 132676 - DNA, 1047 bp, Homo sapiens
tctgccccatggttataaggactgaaatttaagaagcctgattgaatagattccttcaaaatttccccccaatacctacttaataagttcctgggataagaggttgtctcagaatccagggtgagatggggtagagttggggcagaactatacctatggaagcagcaagagaacaaattacttctgtggtacatattctgcaaaaatgcaagagccacagtcaagggcaattgacttcttccttgtaagaccctctttttctggttaaaaaagtttttcttctataaatctagttctctaagtctcataggccagccctgaaccacatggccatgacttgctgtaaggaagtctgggaaagtatctggcaaaggggaagaagagagccatggttggcttaggttaggggtaggcaaactatagtctgtgggtcaaaactggatgatcacctaattttagaatgttttcaagctaagaatagtttttacataaaaatatataccagagcatagccatcatgtcaaaacaagaaaagaagagaaaagtgaactttttgtgtcatgcttttaaggcacagtggattgtggattattttgttatcaaattggatgacaaagtatgtgtttattgtgcagtgatactatacctgtactaaaagataatatacatcaatattcccagattcatcacaatattcccaactcacagggagacaatggtcagaaaatgtgaaaatttacaatggaaaacgtcatcacagcagaatttcttcacaaaaataacaaaagagttgaaaccaaagtaattttctgagtggcttctttgttggccaagcaaagaaagctgtttactgatgatgagttaattaaatcatgtttgatcacagcagctgaaaaaattttttcccaagaaaataaacttgtttcagacgattaacctttcagtgagatctgttgtttgaagagttgaagacactgggagcaacatcaatagtcatgtacaaaacaaggtagatgattttgagtggttttccttggctcttgatga

SEQ ID NO: 132677 - DNA, 1358 bp, Homo sapiens
cttctacagcttcactttccctgctgttggtgagagcaggtcaccaggtcaagccagatgaaggggagagaaaattagcctacttttttttctgagggggtgcagcaaagtcactttgtaaagcagtttgtatacagagattgggagcaattggaggccattttttgcaaactgtcctggccttctaatggattgcttctatctttccccttacagtattgtcagaacagcagccagagtgattttataaaaacgtgagttagatctcttctctgccccaaactctccagtggcttcccgttgccacccaaagtaaaaggcagtcttgggattgtcctgtgaggcttgccatgatctgacccatttgttgcctctccaactccatttacagccactctctctctcttacttaatctgctcaaatgagcctctgctgttcttcagacatctgaggcatgctttcaccatggcattggcactgctactctttccgcctagagtcttcttttctgagatgacgaaactgctcttttactccccttcaggctactcgagtacttcctcagcctttccctgaccatccttttaaaaatagaaacctctctctctaatactgtctatcctccactctggtttacttttatccatagcacttatcttcagaaatgctatgtaatttactattttgcttattcttgtcttgcctctactaggaatgtaatctataagggcagggatttttctctgttttcccagtgcttagtatagtgtctgatacaaggtaggcatctcataaatatttcttaaatggaggaatgaaaggtactgcaacctttttcaggattaggtatctcttccattctttatggaaaagctctggaccattatctgaggaaattcctggtctcctttgcaagtacttttgcaatcactatttatttatttatttatttatttagatggaatcttgctctgttgcccaggctgaagtgcagtggcacaatcttggctcactgcaacctctgcctcctgggttcaagtgattctcgtgcctcagcctcccaagtagatgggattacaggtgcgtgcttccacgcctggttaatttctgtatttttagtacagatggcacttcaccatgttggccaggccagtctcgaactcttgacttcaagtgatcttcctgccttggcctctcaaagtgctgggattgcaggtgtgagccaccgtgcccagctgcaatccattttttaaaagaggtcttctagaccaagtattcttccacatccagactctaatttattctttgcaagaagattatcatgttctcttaactatatgcaatacctttcttgata

SEQ ID NO: 132678 - DNA, 1023 bp, Homo sapiens
agtttgagaccagcccgaggaacagagggagtccccgttgctacaaaaaattttaaaaaaactttagccaggcacggtggtgcatgcctgtagtcccagctacttggaaggctgaggatgggcggatcacttgagccctggagtttgaggctgcagtgacctatgattgtgtcactgtactccagcttgagtgacagagtgagagaccctgtctcttaaggaaaaaaaaaaaaattctgtttagccctgagtttcagccatatgactgcccttgagccgttcctatatagaaatttggtagtcaagagtgctcaaagtcaaatgtctgtcttcgtcatcattggaccctcctcctccaactaccttgtatatcagttattgtctctgctgggttttcataattgttagatttcctcttgcttttaagattgtgtcctttatttgaggtttgacattaagtacttttgtgtgatacatagttgtacaatatcctagagaaactattgagaaagttgaaaacccaaagtgttttatctactgctcttttattagtgcaattgatagattaattttcttggaagtattcttaggggctgaactaccttggcagataatgtgataattgcttatattaaacaactgttttgattcactgggaacttaaagacttcattaaaaattctctttctgatttaggtttagacagacaaaaaaggcatattgaaaggttggagataaatctttgaaaatcaaacatgcatttttgtagcatgtggtttatggattatattgttactggtttccttttagtaaaatggcatgacaagaagtaatatataaattgtttttccttaatgtataaaatacccaaaggaaattgagtttgaaaataacgtagactgctctccagactgggtgacaaagtgaaaccgtctctgtctcttaaaaaaaaaaaaaaaaaaaaaagtaggacacgtactacacttgccaatgctaaagtgaccatgtgtactgttttttgaa

SEQ ID NO: 132679 - DNA, 1049 bp, Homo sapiens
atattcatgtaaatgagtgacttatatcacaaaactagaccacaagcaccacggtcttaaatcagttccaatgtgtgaaatacaaagagaaaaatgaggaaggagtgggtgctgtgtttttatttgagctgttctggagactttgcaggactgacagttattcacagctataccgtaatttggtcccaagtgcaggatggacagttgtagcaatagtgaagtagtttccaacccgtacacagaatggcaatgattgttgctagcctattggctctaagacatattcttcatattcgttaacagtgtgatgaagcatggtggatttcgtttcagtgcaaagatgattttaaaaactatgggctttctcattcatgttttaatggagtaagcaatctcaagttatcttctgatactgacagcaatttgaaccaaaaatctggcagttttcttaacctctatgcactatagttgcttattggtaacctgggatagatatgcctaccttgagggctattctgaagattagaaattgtgcatgtggagtgcctaattcaatgccttctacatagcacacacttagttaatgggaattttacttaatcctaattgactgcctggcatactcatatcaactagtattgatatttggaaagaacttctaagggactgtgttcattaattttatttctttttaaggctgtgggtcatcttattgctgcagtcctaaaggaaaatggtttttcagaaaagattcaccaatctacaaatcaggtctgtgtttaactttatgctttaattctcttcagataagattgctactagctggatcacatatgcacctgtcttgtttccctgatagttcagatcacagtagaaatgcttttgaactgtgagaacttcattgccttttttgtttatttgtttgcctttttaatatatagcaataaaaaagttttaaatttattaaaaccctctaggaatgagacatggagggaagggctggagaggagtattcttatgactattaatgaaaaataatatgggtggaa

SEQ ID NO: 132680 - DNA, 1235 bp, Homo sapiens
agtacaaagtggtgtgtcagctgctctaaaatgtgcatcctaattacttggggaccttgttgaagtgcagattctttttccttagtctagtgtgggctcaagattcttgtctaacaggctcccaggtgatgctgatgctgcttttgccctaccacactgttgagtagcagagctaccgccgcatcggcatacctgtgaacctgtgaagaatgcagaaccttggactccatctaagagtgccagagtcagaactgcattttagaaagattttctacgtaatttataggcaccttaaagtataagaagcatcagtttagatgatggtaaaaagaagttttctataatgcagagaatttgggttactctcattttaatcctgattgtcttcaccgtgtgcaattgttagacctttaattatctgtaatgtttgaccttttaattcattttttcctatagttggttcctttaacttcagtcttgtttcaaaaggcaattgctgcaaggtgtgaataggaagcctagtttgagaagctgagaagaattggatacataggcttgtctttagatacgtggcacattaagaggtccgtaatcaatcacctgagttggcataatctggtaatgtttatggagagcccttatgtgaatggccgtttagcactataaatcagtagagagtaattgagtgtataagagccttaagttcctccaagggggattgtggatggcagaaacagaggagaggtgagcctgaagagcatattcccctcaagagagctatgattacctgagtcaatcataaaattgtcatgctgttttagagccttctttgccacatgttggttagcaatatcatccagccttagagaggcaactgatgagctgtgtatgaaagcataaaagggatatgagaaacttagaactccactgagaggtgttttctggttattctgtaggattaatttaaaatagaaggagtatggcaaataagtgtaagctttctgagcatgcagctaatctgtgtttttatggtattaagcactgtgccagtattcagctggggcttaagtatttcttacttctttttcttctaatagctgattaatttgaatcacagtgcaacagaatacttggtcatcttaaatggtctgtgctgaaccaaataagttgtaccagtatgggagtggacagaaaacaagagatatgagaaccaagaatgttaggcggtggtttcc

SEQ ID NO: 132681 - DNA, 1020 bp, Homo sapiens
tttgaatggaagtggtttactgaccaggctttgagaaacactggattagaatcatatgtagttaatgcagctcatattgcttaactggaccctcctttctaagcagtcttttctttagctttgtggcttaaacaagattaggcatagatatttaaataaggctgcaactctcagttacctttgtaactggaagcatagtgcagtacatttggctactgtgattagctaaggagcatatgccaagtataaaactctagacccatgagtctcaactctgtctgcacattagagccctcttaggagctttaaaatatatggatgactgggctttacccagaatgactgaagggttggtcttaggtgttggtatttttttaaaagcttcccacgtgatttccagcgtgcaggtaagggtggagaactgctggccaattgttgccatgaaacaatgggacttcattgttgccacacgttcagatctttcaatataaataaagtttttatgtgaaatctcctgactgaatgctgacaaccaattcaaacttttcaaaatgtagggtaggtagacaaaacacatctgctcacaagatgcaatcagtgggcaacaagtttgtgacctctgatgcaggtactattttcaagaatttcagaagccactttctagttatactaattaacatttttttaaaccactatgtagtatcctttagttcagactttctttttttctcccttttttatttggtctgaattttcttttgtttagctagaacccctcttttgtgtaacacacttatatttaagttatttaaacatttttttttttttgagacagggtctcactctgtcacccaggctggagtgcagtggtgcagtcttggctcactgcaacctctgcctcccaggctcaagctatcctcccatctcagctcccccagtagctgggactacaggtgcgacactacgccctgctaattttttgtagaggcagggttgtccaggctggtcttgaactcctga

SEQ ID NO: 132682 - DNA, 1053 bp, Homo sapiens
tttagtgctctagggaggggaggccgggacattggctcaggagaagtaggcacgggctagaatatgaaaggccatggcaaagaccgggttttacttaaagagccgtgggaagtcattaaaaacatttctttttaacttactgtattgaaataattttaaagttcgagaaaagttacaagaatagcaccaaagactcccatgtaccatttacccagatttatcagtgtttttgctctttgccatgtttgcattatcattatctctgtataattaataaaaaccatttgagagtagattggaaacattcaagagtgtgttttctaagaacaaggatattctcttatataaccagaatataaaattgaacattgatataatactttttataacatacagtccatattccagttttgtctgttgtctcaataatgtcctgccttttgccgccttactttttaatgtataggatctagtttaggatcacctgttgcctttggttgccatacctttttagccttttaacatctggaactgtttctcatcctttctttgtttttcatggtgttggcatttttgaattccatataaatgacgctgtgtccttctgaggttaatcacatctggaggtactggtgtccctcttgcccctcattggggattttaattttggctacacagtcgaggtagtgtgtggtttctgtactgaatagttatcatttttttgaactaataagcaatctgtggggaatacattttgagaccatgcaaatattctgctcctcattaagctcagcactcccaaccaattttcactgtgatgactacaaaatggtgattttcccaactccaccactccctttatgtttattagtggcaaaagagatagctatttggtttagaggtggaaatgactattaagctatcaatcaaggatattaaggagatatatcagattctgatttggacttattttctaagggaaatccaagttaaatttttttttacattagcagtatacttatactgctgataaatgtgctttctaaaattaaa

SEQ ID NO: 132683 - DNA, 1038 bp, Homo sapiens
cttaatgatgttgctcatcctctaactcttaaaaaaatcgacgatcagctattatcttatggttttattgtcaaagtgagcattttgcttttggggggttgattatttcattacttgaatatattacctgaagggatctcctgaggtataaatgtttggttttacttagcataatgtaagtatgacacctatacaatcaagctgccataagggattgaaaccagtggaatacattaatacaataattaattttatttttattttgctgaagttataacaacttacactcagggagccaccatttctggacagaacatatcatataactttttaaatttttttttggaaatggtctttatagtttttttgaaagcaggagttctaaggagactgagttgtagcaactacctaagatatacttaggtttaatttactggtatgtagccttttttgggagggtggtcaggaccttcttaagaattacataaaagttttggactttctcctattatagaaaatgtacacatgcatatatactaaaaattttacatatggtttcagagggcttgtagaaatcattatagaaaaatcagagaaagaagatgggaaaggatgtagtcagattcactcctgaaaaagcccaatggagttaaggataaagaggaaggtagggcagtaattgagaaaacatagctagtaatacttttcaagggccatctgtctctttgcagttccattctttctctctagctacatgttttgctcctgtttttatttcctcttttccttcttcttttccactcaggaaagtctttattcacaatttatgggtctaatcacctggggtttacacctaagatttataatcagacttttagaataagctgcacccatcatacagtcttccagttagcagtagccaccagaaaacactttatatgttcttctaattgtagatgtttaattgaaagattgggattataatttgctgctaaatgtctttaaggccacaaaaatgttgtagtttttgcctattat

SEQ ID NO: 132684 - DNA, 1065 bp, Homo sapiens
gtgactgcaggcattgtttcctcacacagaaaaggcaatctgtgtctgtcgctgaatttatgatgtaaatcaaatcatagctttcctatattcagagatgtagcaagaaggttgaggtgacctaaaggttacaaataacttttgctttttgatttgcctatcacagactattttttttaaccccctcatttctattaggattgatgtgtttatacttggaaaggtgaatccagttacagattttatcattgcctctgtgctagtctgggggaaccatgcatttatcattcactccttcctcactccattctgttaggatgcatgtactgtactgctctgtgctgttgatgatattaataaagagtgggaacactgaaatattaggtaccaactctgtgtgcttcctctgcttttttcttctctgaacagtgttgactttgggacaatgtgctagagggactgtgttaaattggcttcccatgatcctgtttattctgtcatttgcaacaacatgaatcaaccagtttaagagtttaaaaaggtgatttggggaaagtgtgtatgtgataattacgtttattgtagataggcatttggcactgaaagggaaacaaaaagattaagaagacacatacccagctttcatgctgcttatgctataatttaataaacaaacctatcttgatgataatcataattgtacccacttatgtagttcttctatttgctagatattatattaaatgctttacttaaaatagcaattaaaatatttgcaaatcacgaaatggggaagtgccaaaggaggtacaacaaattggatcatctattgcagaaaaacaacaacaaaaaatgcacacagtgaaggagacattagaggcactagagaccaatgaagggtgacctgactgcctggtttgtattgatcttgatatttagaaataatacaattctctattaaggagaaagcagaatctattggctatctcaggagttaggaaattcagattaaaaaatttctgtgggctcttcctggacataacacttccttctgaaataaaaaaa

SEQ ID NO: 132685 - DNA, 1412 bp, Homo sapiens
gattcacaactatgggaagaaagcaaaatgttgtaaggatagctagctatttatgttcattttaatattatgtatatgtcctaaaatgacaatatatcttcatgctagattttttgggggggggcgttacaattattattatttttaagagattgggagtctgctgtgttgcccaggctgaacatgaactcctgggctcaagtgatcctcctgtctcagccttctgagtagctgggactataggcatgcacctctgcacacagtatttgggtattattttataattaagttctgcattcatttattgaaggcctatgactttaacctttcaggaactgagaatttgagaatggtgcaaattgataatatcatggattttaggctgggttactttaagattatctagtctaacataatttttcagatgagagaaccgaggagagcaacattaaacgacttactgaaggtttcttggctagctagtggtggagttgggcctaaagcctccgttatttttatttttatttttttttgtggcagagtctcactctgttgcccaggctggagtgcagtggtgcaatctcggctcattgcaacctctgcctcacgggttcacgccattcttctgcctcagcctcctgggtagctgggactacaggtgcccgccaccatgcctggctaattttttgtatttttagtagagatgaggtttcactgtgttagctaggatggtctcaatatcctgacctcatgatccacccgcctcggactcctaaattgctgggattacaggtgtgagccaccgtgcctggcccaagcctccatttttttactctctctctaggtctgttttttttagtacttctccctctgtggtgaacttaaatataaaagacttgtgtgtaggtacatacataattggttacatttgaaaacattttaaatcactttgggatttcagattatctgtttttttaatattcattttttcctaagccctggtaatgtcttactccaccgaagtgatgattaatcatcagataccacatgcagaatctaaaatcagaacagattaagccaaggggatttttaaatagtatattgtccttaaggaagttcaacgtttgctcctgatgtcaaatcataatggcatcttggaaatgtatttctttatatgaaccttacatttcaccttcagcatctcaaagtagaagaaaaccgataagccatccatggatgctgttgacacccggatagtatttattctttggggaatacattattaaagagagatggagaaggaagtttcttaaatctcttttctgggaactttcactttgtatttcatacatacattatctgattccttcatctatctttttttagtttccgaaagtagaaggtgtgataaa

SEQ ID NO: 132686 - DNA, 1881 bp, Homo sapiens
tttctacataaagacagaatgttacttcaaaattatgcttgtttagaactttgataatgttaaagattagagagcctttaatgctaggttgctgagattgtcttttgaacctttttttgttatggaaaattagaaatgtacacataaatgcactcaaggaaatatattgtcaagtaaacattaggctttattttaaatccgtctcttctctgtggccttttgactttcctactgtgtgtttgcaagagagcaaaataatttataccagactgtttattttttataacaatgttttctgctatttcttctctttgatcttttaatatcttttttctcttgtttgctagcaactaatttttctctctgtgtataactaatagtcatttgggttattatggtgataaccactggtaaaaggtactgccggtcaaccgtaggctttcttcttgatgaatttagcagacataggctcctgattgaagcagatggtccgttgtttgtaatctctgggaaatgccaatgtgtctgtgagcaggaccatatccttaataccaactccagaattttgatcagaacagctgggtttgaattgcattgggattttcaagagcacccaggtccttcctatctaatacattagcctgttgagaagacactctaccatttgaatatggtcttttactatatctgccaagtgtggagatgatactctcagttaaggctgcctgagcaagtatcttgcagataaagggcttagtaccgtgttagaataacatgctgactctttactatcaggtatctatgttggaattgtagaaatgagagttcatttggagaattcaaaactaaacttaatttccctcaacatgttgtcattgtcatgtaacttgttttaagacatctgcactcagacaagctagaaaaatgaaagaaaagaaatttgtaccagccagcagtaacaaaaacagtagcaaattggattttggttaataaccagaggataaggtgcagttgtatagttaatccttcatggagttctgtaactttttttcatctcctttaagtctttataggtttagagaaaaaattacattgttcaaagctttttgtgtactttaaaattatcttttggtttgtgtattttttaatatcatataatgacttttttaaacaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggtaaggatagtagtatattatactgttcatgcattgctattaagaaatacctgagacttggtaatttataaagaaatgaggtttaattggcttacagtctggcaggctgtacaggatgcatggtgctggcatctgcttagcttctggggaggcctcaggaaacttacaatcatggtggaaggtgaagcaggagccagcacttcacatggctggtgtaggagtgagagagaggagtggcgagatactacacgcttttaaacaaccagatctcaatcactatcacaagaacagcaccaggaggattgtgctaaaccattcatgaggaacacctttgtgatccagtcatctgcaccagaccccacttctaacattggggattacaatttgacatgagatttgggcaggggcatagatccaaaccatatcagatagacgttttattgtgtcagttatcactcaagtgagtctttcaataactgggtggatctgctcatttagtt

SEQ ID NO: 132687 - DNA, 1003 bp, Homo sapiens
catcttgctttttggccatataatacatcattttgaatttatgtgtgactgtgtggcattgactaattctttctttttttttgagatggaatctcgctctgccacccaggctggagtgcagtggcaccatcttggctcactgcaacctccacctcctgggtcaagcaattgcctcctgagtagctgggaaattagcctggctaatttttttgtatttttttgatagagacggggtttcaccaagttggctgggctggtctcgaacttctgacctcgtgatccacctgccttggcctcccaaagtgttggcgttacaggcgtgagctgccacgcccggccgaccaattctttctttagtagagcacacttgctgtataaataaatttgtgtaataggcttgcagtctttcatattaaatatattcttcctggatacatgttacaaagccatgattctgggaacttctttaacaactcctttttccccctctattcttttaggattttcctgttgaactggtcataattggaatagctttactacttctacagactccagcaagtcagcagaagccaatcttaaatctaggtaaataaaaatacagtcactagagtaaaatgtaaatataacatgagtattgacaggattcacttgaactatgtatcctgctatcttgtgtattttgagtttccatctgtaatttttaaaattattaaatagaattttttttcttgtctaataagttgttaccttgtgcaagttttaatataacataatttaccaagtatctcggctgcatgttagaggttataatctaaccttatatggcagtaacattcaggaatatattgaatggcatagcaccttattcaacattgtacagcaaaatggaaagctttagtataaaatccttgaaagaaaagtgtttagtagttgtagttatttttaaaactctccataccttaactattcaaaatgtaaatctagctagaacaaatgaaag

SEQ ID NO: 132688 - DNA, 1476 bp, Homo sapiens
gattggattttgttttctgacaaaaaaattctaaagcctcagaaaatccacatttcaaattctgaagctatgttcttatattgtggttcatgtgtaagagaaagataatacagtatcaaacagtcaaatacttttattatttcctggttagcagactttttctttctctcgtaaaccaatatctctgatttgaagttaccttagagtgaataaactgtactgaacactgctaagccaatatatcatgttggaaagtaaggaagaactgtggggaaagagtattcaaagaaataggataaccaagagaatattgattattccaaatttaaaagatttatttatacattaatttttatattaatgtaatattacactatgtagttgttaactgtagccttgattacaaatagcaatttataaaaatgcctggaatatttagatttataatttaggctattaaaatactgctattatattcatttcctgttatattaaagataatggattttcataatatctcagaaacaattatggattaagaccaatatttaggcaagaaaagtaaattagtagtgttagagtaacaggtgtttgtacttaatatcatgttaaggtttgacctccagatgatgtaaaatagaatgctgacaactcattgacatgattcaaggcttgtagaatttttgctgtagtggggaaatcagttgaatattttgataatttaacgttgaatcccctgaataacatcttttagtaaatcagggttaattacatcactttgaaaaaaatattgtgaaaaaagtatatttatgccttaactcattcagttaatagtctagagactctacatgtaaatcagttattgtataactgtatgtatctggtgtgtaagttgtttccatgttaaagaaccattcactaattttttttgttgttgttattttggttctggactttgggactttcacaatctgcttcttagcaattacagctgaagggcagtcctgcttcactttgctgtttacttaagcatctgctaataggattcttagctgcctttgtaaaggaagcatgtatgttgggcttgttagccactgatccaggaattcttggtctcttagctctgtttgctgagggcaatactagcatctcagaggatattaagggcaaatgttgaattgtattttttaaaaaattcatattaacctaaaagagtatcatcaatttttcagttatatatgttaacagcttattttatataatagtttatttatactccttttatttccttttaggataagatttatcaacctagttatgtgtctgacccagttataaaagggaagaaaactttcttgcatatcattcttaagcaaaattgcattttgtttgactgtggtattaatttttaaaaatgtgcattattgttttgatgaatagctttgaagctcctctctgttactgaggatcagaaaa

SEQ ID NO: 132689 - DNA, 1046 bp, Homo sapiens
ctgtcttttgtcagttgtgtcatcaaagcttaacacaatctcagtgtagatttggccctcacatatttttgatggctggatatgtaactcataagagagttttctgtttattattgatgctggaatactctagaagttattctttttagaaatcctaaaaaccattgttttcttaattgccactttcttttaaagcaaaatgtggaatgatcctggtttgggggtcccaaagatgactaacacgtttagttattctctaaaagaactcacaagactcagcatagagctgtaaccatgcttaagatttattacagtgaaaggatagaaagcaaaattaacaaaggaaaaggttcatgaggcaaagtcaagaagacatcaagtgcaaacttcctagagtcctttcccagtgaagtcacacagggtgtactgaattccttcagcattgaatgatggcaacatgtatgggttctttgggaaatctgctattttattaaaccccaaaatattgaatctatctagcttagttacatagttgcttacctagatgagctatatttaataatatctaattgttggagagatttcaaactcctccttctaactctggtgtaaaacacattaccaatgacagacatagtagtagaaattgcacctaattatacattatactttacttataggacattggcttttaacttttatttgactagtcagactgccaaagatttagagctcacgtggcagaaatgtgtagctacttttgtccaagaaggaaattctatggatacaggaattcagtcactatagttatcatttatgtaagtttcagaatgttagcaatggatataactgttgattatattccttttttccctgctggtagttacatattggtaatgtagccaaccattacatcatgatttaagtttttcttatactgttttctaaataaataagttttctgactctgagagataatagtcagatggctaatgagactcacctggaaataaagtttaggccaggaagggtcgtggctattttct

SEQ ID NO: 132690 - DNA, 1064 bp, Homo sapiens
ttttttttttgagacagtctcgctttgtctcccaggctggagtgcagtggcacaacctcagcttgctgcaccctctgcctcctggttcaagcaattctcatgcctcagcctcctaagtagctgagattacaggcatgcaccaccatacccagctaatttttgtagtttttttttttttttagtataggtggggtttcaccatgttggcccaactggtctcgaactcctgatctcaggtgatcctaacacctcggcctcccaaagtgttgggattacaggcacgagccactgcacccggcctctccttcgtttttgaaggatagttttaccagatatagtatccagtatcttggttggcagtacctacccacccacccctgcccactcctttcagcactttaaatatattatttcactcccttcttgctggcaagatttctgctgagaaatctagtcatagtcttataggggctcccttaacagtcccatgattataaattaatttgtttatcaaggaacttaaacgctggaggagggaagagaaagcattgagttatatgaagccagatcttgagacagtcaattataggacacttaccagcttcttttatattaaaggcgaaatctgagcattcattgtattttcagcctctgaagggtataagattcaagattaggaggatcaagagctggtaattacatctcaagtaaatacatattcacaaggaaataataataataaaaaattagtccatcttttatgtaaaattattttccacagatgtctatctatatctgtgttttcctagtgaaacagtccctgttttattttttccatttaattggggactgaatttgggctattatgccttgagaactgtattaagtctaagattatttactgtaaacatttccttcttttttcatttctgaactggccagaggaaaagacacacccttacgtgctttttttagggccaagtctcataaaggaactgtgtactcttagacataaatacagtactttatttctcccctgacagtataattatagcatttgttta

SEQ ID NO: 132691 - DNA, 1034 bp, Homo sapiens
aatcattttctgaacttcagactgttcccagaattataacacagcagagagaatctactgttttagagaaatgttttagagaaatgtggtaattgcaccaaagatcattcattgacctaaccaaaggttttgacttagtgaacatatatacccaattgtagttttttagtgaatgagactaagtagaattctcccaccttaaggttatggtcagttatggttgataatgatagtaatgaatataatgatctgataatataagtgacagccatattgagcgttatgctcgtgtccttgggctaagcactttttatgtatttttcttaacaactctgcagtatagggattaacaccattttacagatgaggaagatagaccccagagagaggttagatatttacgccggatcttggtatgagaatacacttctattatttttggtgaacactcatttcagcaggcagtgaacatcattgctgtttaaaaactgatgtgtggtaaggacaatgctttcacatcctgtgcccaatatttggaaaagttgttagaacttaatggcaaggggctattatagcaggagaataccacacatgcccaaggacatttgattttactgcttctgtcagtcatctgagattgggaaatatctctttaatagttatattactttcataataagtaatcctgaaatctatttttaaaccagttttgagagaagaaagaattctaaactttcaccaccaaaaggtgaccatttttactgttttgttgtatttccttttcattattttttcctaacaggcatcaactaatttctgaaattaacattttttcttataataaatagtaatttagccttattgcttttatgattccattgttttctctgcccatcccctcctgttactataaggctgtacagtttatcaatgctttttaattcataagaaataccctgagtttggcactgactttcctcattccatttctctaagacatcatcattaactgtggttagtactgaagataaatt

SEQ ID NO: 132692 - DNA, 1047 bp, Homo sapiens
agaatacagcattccctaggagtttatgcataccagttatatgaatttatgttgtgtgcctatataggggtgtgtgtgtgtgtttgtgagtatgtgtgtttccatcattttgttagccatgcttattccaggtgtggattgttataaggtttatgtgaggcactgttaaccttggctttatggaatttctttctttctttttttttttttttttgagactaggtttactgctgttgcccaagctggagtgcagtggcacaatcttggctcactgcaacctctgcctcccaggctcaagctatccttctgcttcacccttccaagtagctgggactacaggtgtgcagacccgtgcctgactaattgtttttgtattttttgtagagactgggtttgccatgttgcccaggctggtttcaaactcctgagctcaagtgtcttgcccgcttaggcctctcaaagtgctgagattacaggtgtgagccactgcaaccagcctgaatttctgtattctttatggttatgcttaagcacaactccacacaaaaattactttcccttttttttgaactatgcaatcacttaatttttttttatttttaatgtttatgggtacataagtgtatatagttaaggggtacacgagatattttgacacaggcatacgatgtctaataatcacatcaaggttaatggaggtatccatcacttcaagcatttatcatttctttgtgttatgaacattccatacctggccctgatttgacttttttatatgctaagagataagggtcaagtttcatttttctgcatatgattatccagctttctcagcactatttattgaggtgactatcctttccccagtgtatgttcttggcatctttgtcaaaaattagttcactctagatgtatggatttatgtctggctactctattctgttccgttggtctatgtgtctgtttttatgccagtagcatgctgttttggttactatagctttgtaatgttatttgaagtcagtaatgtgattcctccagttttgt

SEQ ID NO: 132693 - DNA, 1035 bp, Homo sapiens
tagtcctagtccttaatagagggcagagtttattatgagacttcagtgtctgcttctttatgagacattttgagttgtccaggaaatgtctaatttcacaatccctccctcactgactcaatcagtttctacttattagaatatgcatattggtttttaaagtatttttaatgcatgagacacatttgatgctcaaaaatcagaaaatatggattagcagaattagaagcaaaaatttacccatatgtcactatccagatataactctgataataatttgccatatataatttcatgcatttttctgaacatctctgtatgtctatgggtatttttagaaatgagattgtactgaacatatttagtagaacctgattcttctcctcttgatatattttatgcatcttttcctcgatatatatatatatatatatatatgacacgtggtatatcattgtacatgccatgtattgtccatttactagtcctttattgatggatattttattagattgtttccaattttttactgtcatctacagtgctacagtgatcagctttagagctaaactgtagcacatatctctgattatttctttataataaatttttagaaatggggctgccggtccaaggatgtataattaccatttataaagatttctcccatatggactcctacctgtattatacgggagtgctgctttctctataagcttttctgcataggatataagttttttttatatgtgtcttcatatttgttttggaaaacattgttgaccattgtaactaaatttctgattctttcatttatgtagtaaatgtgaactgtgtgcaaatgctaacataataagcattattgatgatttggttgcagttatctgaggataaactatatgatgcattgaaataaatgtgaaaatagaaggaaatctcaaatgtttattatgaggttttgtactagaaatttacatttactttctattagtatggacttgcggagttgcaaggaggagtgctcagatatcttct

SEQ ID NO: 132694 - DNA, 1071 bp, Homo sapiens
taacaatgatgcaactcaaaatttaaaaaaactcttagtcttatggtcataagaaataaaaataattttaatttataaagttatttttgttatagaggcatatgagaggtgaccaatagcagactctgaaccattaaatatattagaataaaattatgaagcataactgtaatagaaatacaatttctttttcaaaaacattgtattattttatttttatttttttatttttatagatttaggaggtacaagtgcaggattgtcacatgacagaaatacactgtcgaggaagaaaatctatacaattttggagtgttagaggcattttttatgtggattttatgaaatggatgatggtagatataaattgctatggcattttatctaattgtataaacttagtagaatgttatagcaattttattttaaaatggaagtatttaccatatgttagaaaataaatcttttgcagtctttatacttcttaaatgccaatttacatgatttttcaaaactttttaggagttgcatgagcaaaaagtatttaaagactcctaccttcagttatgctttaaacttgattttcttttatcatatatgatttaattggcacaatttaaattggtataattggaaattaaaaagacacaacagagcatctggtacataattgctctttaatattatttcctccaggaactcctttctgatctctgctctcttccttaaccaggtaatttccccctctatatctagtatgaaacttctgcagtttctcttaacacaaggttttgtaatgcatgtttatgtatcagtctctactacctgatgctaaggtcctcgaagatagaaagtatgttttagcaactgacctcctcctgcaaagcgtccagcttagtacctggtacatagcagttgctcagttcacatttcttgaactgaacaataaagaagataaataattagtcttatgaaaatattagataaccttaagttggtttaagtgtcagggtttgtcttgtctatctctagtgaaaacttattcctttgcatattttgtaggaataattt

SEQ ID NO: 132695 - DNA, 1045 bp, Homo sapiens
tgaacatagtccccttaaaagcagaagtgaagaaatgtagaagggagagaccctccttcctcctcccactttcatctgtgtgtgtttagataattggttttttaactacttagaatttgtctggatgtgagccaaagttgaatttaatttttcccagagtgcttcttaagtcatttctatccctagtaacttcattagcttaagtttccctaaaatgtagtccaacctgtttacaacaagtccataaagcattctggaatctggcctcattagtggtctgtatgctgcactccaataaaaccaaaccacttacagtgtccttcaaacttttccttcctccaaacttttccatttcttttcctttgttcatattattccctctatctaaaattactttctttttcctctttaatttaaaaatatattttaggaagaaaaggattgttttaactcatcccatcctttgagagtttgtctgcaagctggagtcttttgttcccaaagttctttatactgttctaagaacgtttattctattttatactacaggtatatgtatgcatatattattttccccattcaactataggcttattgaaaatggagtccatgatttaattatagtgtattttctgaattgctttgcacagtgcttgcttcacttattcattgaatcagaatatatttattaaaactgcgctaggtcttagagatactaataaatatagtcaaccctatttttgagtacctattcaatccccatcactcttactagtttataccaattagttctaatctctgataggaaggtatcattttttattgtattgttacagaaactaaacctttgagaggcctatttatttgacaaatatttatgagtatctgctatgttctaggcaagtaacttgaccaagactgtagttaaaaagctaagtgaaagctgatgtctgaatccaggactttctagtttcatatcctttgttttcgcattataccatgttatcagtccctgccttctagaagctcaaaggtaggtaaagga

SEQ ID NO: 132696 - DNA, 1057 bp, Homo sapiens
gaaggtattaaaaatgtaattaattgcttaacagttatatcttgtgaaaacaatgtggaaatctttttacatttttaatttttggttcaaacaaacctaactaatcaaagagcagccacaaaaatcctcaaaatgcaaattagacacaataatgtacagctaccaattacagattttagtgtttttgtattccacagcaacaaactgccaagtcttaaaaaaaaagaagtcaactaaagcattctgttgttccctgagctctactgtatattctactggaagattttaagctctgtcatggacatatgactagaatcacaaattttttaaaaagtgttcagacaaggcaaatatctaactatgagctatagaagttaaatatattgagtatgtcagtgtttgcattttatttttggatggtatagaattttattagttttctataataatcattgcttatactggcttacagtgatttactgtattaacataagctttttatacagatctgagattgtatctaataagatgactagagtcatgaccatttagttaatctaaaaaatgaatagatttttaaaaaattaatttcagtggtcttttatgttatagagtgatggagtctaacaaaattttaaaatcttgtcacaaaaaaggatacagaaaagattttgcataatgttttattattatcctctctatgatcttttcgcttatcatttcagataagaccagaaattcccattcctgaagagttagatgacgatgaagatgttgaggatgtggatctttcagttcctggctcttgctatctcaaactgttgtcactcactccccctttggttttaccaggtgactcctatttggtagtagagaagctagcattttttagtggttcgatttgtctgattgtattcttttgtgataggtacatagtatagtttaaccttatgtgcttattttttaaccagaatgttaaatgcacccatctgttctattgaaacagcttgaggtagtatggtgtttaaatcatacgaaaaaacgttacatctgagta

SEQ ID NO: 132697 - DNA, 1404 bp, Homo sapiens
gtctatgtgcagatatgttcttgccccttgacatgtttcaccttttgccagaataggatccttctgagaaaggaagaaattactttctttcatcatagtgcctctaccctcacaaacagttgattcatagctgcattctgtaaagtctataattatacccactttgaagcagtccctgtgtatgtgtatgcagaaattggggtacatggcctgcaatcggatattactcatctgttttgtgtaaatgatgtattgatcactgttatgacaagaaagggtgggggatacattcagattgagtaattggagagagtttaataaagaacctatttacagttgtgttgtcaaggttaagggaaactcacaagagatggtaaaccgtctcagagtgcttaatgtctctggcctacagagataacgggaggaagaagaaagagtatctgtattataaattggggtgcctaaggggagccaagactttcagaagaggaatgcaggcaacctgtagcaatcctgcaagaagccctgtgtctggggaatacatctcctgacttcactgttttcaccctttgatgtcctgccagtgactccagtggttgaaaccaaccagaagccagaggacatgggagcctgttaatgcctttctttaaagactgtttttccagagcacagagcagggttgagaaggatagaggatagataagaaggagtaaatggaaaacgtcacatattggtgtttttgagctttgaatggagaatcttgattgcatctaggagggtcctgtcagaaatgggtatataatagacggtccagtgagctcttgctgcctttaatttaatcatattcatttaaaggagacttttagatagatctcttcagaatgaaattccagttaggtggacccttgctttttgtttctgtaagagccacatgcagtggttttcttttttcattttccgctacatatgatttgtttagctttaatgttttttgtttttttgtttgtttctgtattgggcaacctctagtggtccttaggaaaatcacatttgaatatgaacctatagtcttatcaaatattttgtttatacatcctgttgtcttctgacatcatatttctgttattatatagtaagtaaaatgtcaaatgataaagatcttgggcttaattagaaagaacacaagcaaagatagtggacaaatatctcattttaaaataattgtcctaatattgctaagtatagatagttatgaaagaggtttttctgaaaacacttaaatgataagaaggagccattctcatgaaaatgtgggactgatatgttccaggtggaagggatagcaaatgcagtggcactgacttaaatatcaactttgtgtttttgaggaatggaaagaggcca

SEQ ID NO: 132698 - DNA, 1041 bp, Homo sapiens
ggattccagcatgaatagaacatgacctctgctccttaggattgtatgagattaagatctaaagacagaatctgtggagtgttgtgggagaggcacatatatactggaagtatggagatgagaaaaattatttcagtaagtagaaatgagaggaaaatcggtcattcaaggaagaggaagcagtgagtgcaaaggtcctgtgaagtataagacaagcttgggaatcggttcgtaatttgatgcagccagaatgtaggttatataaaagagaggagcaagacatcaggtggagaaattggttaaaggtcttggccagcagttatttcttaaggtaattctaaaagactttgaacattatacaaaagagtttgggctttattctttaatgaaccatcaaaggttttgcaaagttctgagttaatgtattaacagtaagggtagcaccattggggatgtgttaggacaaggaaagattttaagctgttaagagatcagttactagatcatagtaatctaggcaggaatcagataggactaaaccaataaaggaaaaagttgggacatatatattaaatatttcagaagtagactcaagaattgagtctcaaggcaagggagattcccaagataaatcagaaatttcaaacttgggtaactggaacattgatagataatattgatgggaacaggaaagataacaggaagagtgggtttcgaatgatgatgacaaagaagtgtgcaaagtctaatagatggtgagaggtgaaagtttgagaagtacatgttctaaaacttgtgatttttttaaactaggtattttcaattctatttttatttgggtataatatgaatacactagagttctcacattttactgtctagttgtatgaattttggcaagtgcacacattcctccaaccagcaccacggtcaagatgagaaggttctaccaccctcaaacatttccccatgctcctttctagtcaggccctttccccacctccatctcctaacaatctcacatgaccaagagggctgaac

SEQ ID NO: 132699 - DNA, 1751 bp, Homo sapiens
tgtgtatatatgagtataaaggagttaggtccctagaagtttcttaagaatgatttcggctggatgtggtggttcatgcctgtaatcccagcactttgggaggccaaggcaggtggatcatttgagcccaagagttcaaggccagcttgggcaacatggcaaaactctgtctttccaaaaaaaaaaaaaagatacagttaaacctgcagtaactaataagctaccttgaagtgagctcttcctcatcctcacttaattggaacacaatcccaaatctaagtaaagtcatcacttgatttattatttcaaaaagtatttattgagtgtctgtcatgtgccaggcactgttctaagcacagaggaacagcagtgaataaagccccttctttgtccctccaaagcttatacttgagtagatggaaacctgtaataaacaaataaacaaatggaatatgatagaagttgattcatggaagaaaaataaagtacgatagagggaacagagagtgaatgaggcttgagggaggttgaggggtggcattaccattttctgtacggtgttcagggtctctttaataatatgacatttgaatgagacctgaaggaagtggtggagtgagccaagctgatatctggagaagagcattctaggaagaggaaacagcgaattcatcataggccctgggagtgtacctggcaaagcctgtgtggcatggagagcgcaaggatggaagtagtggacatgagagtagagaagttcgggagattgcagggtggagagtctttgtcagcacaaagaggactttgtgagtgagatggagaaacattggcagatcttaatcacagaatctgactcatgatttaaaaggaccactccagctgttatgttgaaaatacaccctgcggggcatggttaggagtccgttgcaataatttaggcaagagataatagtgttttagactaggatgttagtgtggaaaagtaaattgattttgaatctattttaaggcagatatcatacgttataaatgctaataattgaaatgaaggatgtgaaagaaagggatcaatcaaagatactccaagattttaactctaaacaaaagtatggcatttccatttaagacaaggaagactagagaaaagcaggtctgcgtagaataggaatcagattttggacttaggcctgagatgcctcattagcctccaattagagatagcaagcaggttgttgactagtctatagttccagggagagctcagagctagagaggtgaatttaggaaacatcagcatattgatggcatttaaaatcatgatgctggatgaggtcacttagggagtgaataaagaaagagaagatttcaaaagattgagccctgattctatatttaaaggtggggaagatgaagagggaaccaataaagcagacgaaaaattagttatcagtgacgtagaaagagaaccaaaagagagtaaaatcttaaaagccaaggaaagaaggcattctaaggagcaaccaactgtgtcaaatactgttgttaggctgcagaagatagggactgagaattgagcattagattcagtctcttgaaaataattggtggtcatgacaggagctcttttggtagagttattgagacaaaagccaggttctagaaggatctagagagagtggaaggaaataacgagagtcatcaagcataatcttttacacaagttttgacgtataacagaccaagaaatgggg

SEQ ID NO: 132700 - DNA, 1046 bp, Homo sapiens
catgtgtattaaaagtccatatcatccagaaatttttaattgtagtatagtttatccttttcatgtcacaaaaccttctgtagctaaatagattttgccttaaaaacagaacaaaaaatgatctaccttagagttagctttctatcaataatttcttaaacagacacttaactgtgaagtctgatctcagcagattatcactgttcagtctcatgtcttctggataaagagaaatagaagtgataatcctcccctgactcagtcctatggaaggcactgggaaatatctgttgataaaatgaaaactaaagtacagagagcttagatggagactcattcttgtcttgttttcccactttggtgaattgcagacatagtgggagagggctcagttgcatatcagagggggaggggatgctgggatgagaatgcaggctgtctttgacctttacctgtaatagtttgttctcttatgtagtctacatatatcctattaaaagcagtgctctgacatttgctgcaaaaacttgaatgcagaagaaactaccaactttctcctaaagcaaattataattcctcgtgtctagtagatattgcaattttccattctaaaattttactccagtgtgactgtaattttcatattcacaaagtatcacttcgtgactaatacctaaagaaaatatgtttacatgagtaaaactaattcatgttctcatggtattaccttctcatcaaaacttacaaagtggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtaatggcgggcgcctgtagtcccagctacttgggaggctgaggcaggagaatggcgtgaacccgggaggcggagcttgcagtgagcagagatcccgccactgcactccagcctgggtgacagagcgagactccgtctcaaaaaaaaaaaaaa

SEQ ID NO: 132701 - DNA, 1088 bp, Homo sapiens
cagatttgttctttttgcctagtcttgctttggctatgtggacttcttcagaaagctcccagaattgataacagaattcagcaaagtttctggacacaaaattaatgtacccacatcagtagctcttctatataccaacagtgaccaagctgagaatcaaatcaagaaccccaccccttttttttacaatagctgcaaaaaaaaataataagatacttaggaatatacctaaccaaggaggtgaaagacctctgcaaggaaaactacaaaacactgctgaaagaaatcatagatgacacaaatggaaacacatcccatgctcatagatgggtagaatcaatattgtgataattaccatagtgtcaaaagcagtctacacattcagtgcagttctcatcaaaatactaccatcattctacacagaactagataaaacaatcttaaaattcatatggagaaatatttgtagaatgtgattttgaattcctttgcagagagttttcagtaataattaatcaaaaaacttattattaaagctttcttgttctgaaaaccaggtttcagcaatagacaaattatttaaattcaaagcaacaactatcatcttgcagcttacaccttatattactaagaccttagttttgacttacgtttatcatacaaggcacatgtatggggacatggatgcatgacttaatctttttttaaagtatttatttttatttatgtatttatttagacataatctcactcttattgcctaggctggagtgcaatggtggaatcttggctcactgcaacctccgcctcccgagttcaagtgattctcctgcctcagcctcccaaattgctggcattacaggcatacatcaccacgcccagctaattttgtatttttagtagagatggggtttcaccaattggtcaggctggtctcaaactcctgacctcatgtgatccacctgcttctgcctcccaaagtgctgggattacaggcgtgagccaccctgcccagccgacttaatctttttaaagatttgttgaggccatttgaatttgattgggctaagagggcctttgaccgatga

SEQ ID NO: 132702 - DNA, 1044 bp, Homo sapiens
atcactctgttgctcaggctggagtgcagtgataccacaatcatggcttactgcaagttcgacctcctgggctcaagcaatcctcctgcctcagcctcaagtagctggtactacaggcatatgcaaccatgcttgactaatttttttattttttgtagagacagggtcttactgtgttgcctaggccggtgttgaactcctggcctcgagtaatcctcccaaccctggcctcccaaagtaatgggattacagatgtgagccactgcacccagcatagttctctttttggcttcaggttcaactgatacttactgagcagctgcatactgagctaggcattttcacatctgtttctcatggagttacatccatgtcacaacctaaacatgatactgaagtaggaatcatcatcactttggtttacagataaagaatgtgagtctcagataggaggcttgtttcagggtcatatgcttaataagtggcagagccaagagagaaacctgggacatctgacttcaaagccatttttctttcttacataacacagtatggataacacatttcaatagaaggaaagcagtttgatgctggacagtatactgtgtatttattttttttctgacatgcaagtgtcacccacacttttttttttaatattttaattcttccttctgctttttaactagacccagacctgaaagcctgactcatgatttaaagtattcccttatctaatgagatttcaggagtctagggcaagcctccctcaagtgaaacagtggaagtcttactagaaggtagttagtagatgcgggagtgtactccctcaaatgatagaattcacccagagcaaattcaccatgcttcccgatttaatggacatctccctgctgaaagaacccgcacacctggccaggctggtgttcgtgagcctatcactaagattttactgccatctagtggtagctcattgtgccattgtgatcctcacagccgtaactgtagtcatgcagtcatcaatgacccaagctttggttaatt

SEQ ID NO: 132703 - DNA, 1057 bp, Homo sapiens
aactcatggctcggaaagattacatgagttacatacagagttaatttggtgacaaatctagaaactaggaaccaggtccttaaagcttggaacagatttattttactagatgtaatggtagtttgtatagtattcatgtttcattaaaagtctcttcatatatggctggagtttttctggcctccgattttgaaaaaataatggggtagtacatttaaaggtgtgtaccttcttagccttggaattgaaattctaggccttaatatgacaaggccttttctatttctagctttttggtaaaagcagtaaaagatatttgcagtcccgacatgcttaatgtgcatttgtacttggagattttctggggaaggcatgaccgttaatacatctgctccttgctctttatagaattttgacccactggctatcttggacccaggccagagaggttcaggtaccaatgattccttattaaaacttagttttacttacccactgacaagtagtctacagatggcattaacgtaaatgtgggcctctgaaattaccattttcctttctttcagtcattctgtagctatggaaataggacaactggtccacagccttggcaatgtagtgaactttagacagctaaagttaccatattaaaatggaaaaaagaagaaaacttagtcataccggaagccctgggtaatactagttttgaagggcagggatctcacagtgtcctggtaagataggatatttatggcaggcttttatttttttatgtaggcttttaattgccatattatggggtacttggtctggcctacatatactcaaatcaggtactagtgaatcatcttatacccaggttcttctgaacaaaatgattgtgtatctggaaaagtacagctacttgttcctgatggaattttccaattgagtcatttattgcagtaaaaaccatctcatgaaacaattatgggaaactggaaggaaaagaatttaggagaaactcaggattcaactagcataaatgtcactgcttcaccattccagctcagcaacc

SEQ ID NO: 132704 - DNA, 1069 bp, Homo sapiens
accattttagatttgcttacatagcttaagtgattacttcaaggccagtcacttaatctaatagaattagttgcagccacaaagtgttgtgctgagattaatggcataaacatctccactttgtctctaggttgatatggcagcatgagatcattatctttccttcattagtcctgccaagttcactggttaatttgatcattttctgtctccacagttcctactgactatagctacttgcctgaaagcagttttattggagcagctattggcttcttcattacaggaggaaaaaaaggcaagtgagcacatttcttgaattttatcattctatctccatgttgttataagtaaatttgtgtaccctaagcatgcctctgtagaatcaagcaatataaatctgaaggggtgaatattttcgtctgctaaaccatctttgcaatagagatgaccagcagctagctacaataattggtacgtaaatatacacattgtgtggtttcttagaatcactgtctccgaccatgggtggctctgtgaaaatcttaatctcccatttggccctttccaaagtataagcacagattacttttcctatccatttcaagtgagtgtgatctagaaagagaaaatacacctgggtgcagtttctatcccgggatctgtcttgcaagtagatcttctccctgcatcttttataatcattctgtgttgttgaaatcactggctctagttcctatttttagtttgtgttcttttccttgcacacatttgagcctttgtgattctgtattgctgccacccccattaaagtacaagcaacttgaagacagagattgagtgccttttgtttttaactggagccagaacagtgccatgtaacttattgaataaatgctccttaataatacacatatagttttcagggctgtgaggaaaaaatggattagaactgaacatgtcatggctcaggaatcagcttcgttaccgtgatattctttcattgatgggtttgctaattttattcttccttggctaggtcagtcttccttggttaggtcagtctggg

SEQ ID NO: 132705 - DNA, 1490 bp, Homo sapiens
ttctctccctctctctctctgtgttagtgtagactcgtaaattcctatgttatttaactattcagttatctattattttgatctttaacttgtccaataaattgaacaaaatattaaatttgaccaataagaacctctacaagttggctcttgtgtccttttgacatgaccccctcattctttgactgcttcctttgtggcacaagaagatgtcctaggtttattttgtactatccccagccctgtaatagatactccaggtttcttttagtggagcatggtatttagaagctaacatctgtgtgcaaagcatctcattgctgctggggtaatctttgtctctaggccgtttcagtggacagagctgggaaacatatgttcttgttctctctcatgtatttttatttctgtatttagctatatatgtaataaaaagggttcaatctgtctttctttttgtatttgtaactcccttctctgacagtaagaaacttgactctcattatcctcaatatatttactcatttgcccaatcctcctggatgtaagtaatctcctgtccctgctggaccacggtcctaaactgccttcctcactcaggtctccactgggtgccatcctactttgtggccttcctgattttaagaggccttgggatatttttgcttttaataacaaaatgttattgaaatattcggtcttaacatagaaaacctatcaacctttagtgtctgtctgatgtatcagaatcatcaatttattttaaaaactgtcttgattgtagtttctttcagggggctaggcatctcctagttcccactaataggcaatgctgtaattctctctgcctgtgttttctatggacttagtgtagaaaaaaatcgtactcatccttttcatcttgatttaaatattctttccttggtgggggaagataggggcttccgtgatgttcccagattaagttagattacttatgtgatactttcctatatattttcatggtgcgtaatatatgtgtcatcattttcataattatttatacttctttgtttaaactctgtcttttccactaggtgtgatttcctcaatggacaggaagaatagctgtgttttatcgtaaatacttagaacagattggcatgtaatagttttctaatatttgtttatctataactttaaacatacacatatataatatatatatacacacacacatacatacatacatacatacatacatacatacatacactagataattctaagctaagttacctataagcagcatttagctggagaaagtaaagatatgtccaaaccacaaaagcaatatgctagcgatggaaaatatacagactcaggctgttagtctacttgttgccagacttttactctaaggattacacatgtgaattgtggcattgagatctgatcctctgtgtagccaaagtatgtgcgataatgggtcctgttgtaatgcattatgt

SEQ ID NO: 132706 - DNA, 1050 bp, Homo sapiens
gccacaaaaagataaatatcacatatgtggaagctaaaaaagttgatctcatatgcaatgccaaagaaagttgatcttatatagaggtagagagtatagaatagtggttactagaggttaggaagagaaggaggatggggcaataatgagggattggttaaaggaaacaaaatgaggaataagttcaaatacggggaataagttctggtgttctaaagcactgtagggtagtgactatagttaacagtaattgttatttccaaatagctagataaaaagattttgaatgtttcagcataaagaaatgataaatattggagatgatggatatgttatttatcctgatgtgttcattgcacatatgtatggaaatatcactctataccccataaatatatacagttattatatattattgaaaaatttataaaaattttttaaaaagagaagaacagagggagcaagcttttctggcaaatggagttgaaattaagagcacagaattgaagcgttgatcgcaattgaatatgtgatatcagatcctttgatgctagaaggaaagaaggaattgttggcattttccacttccatgatagtatgcaggtgttttactattatttttcactgtctgttataggtcctgaatctgtgcctccttcccttcttaaagtagtgatgaaacccatagcaactgttggagaaagctaccaatatcctcctgtgaactgggctgcacttctctctccacttatgaggctaaattttggtaaatatcatgtgtttttaagtcttcagactttgattttagtatttgacctgaatggaaaaacagattctgtgtcacaatgtgtagtgactggatagacttttcagatcttgaggtttgtcatgttggatggaatggctgggttactttcactcagtcattgagcccctgagggtgaggaagaagaggtctaaagacacaggccagatacacctgccaaaaacaatgcttgactgaggtttgcgcactgctgggaatgtggtacaggttccattaagcttgcc

SEQ ID NO: 132707 - DNA, 1982 bp, Homo sapiens
cccagctgcctgccacttactgagcccttgctgtgcacctggtacctgcaagcactcagtgagtacttacagaaatcagacttaatttctctacagcctgacgggacagttttaaaagtagctttgttgagttataatctatatagcctaaaatatggctgttttaaagtgtaaaatgtgatgaatttgagtacctttacaggtttttcaatcatcaccaagaatatttccatcacctgacaagttccattgtgcttgcttgtagtcattccccactcccagcttcagacccaagccaccaccaatctgctttctatttgtagtattgcctttctaaaataacctttatttatataattttatataaattatatataaatttcatataaatttttgaaattctttagaatggaattatacaatatgaatttttttatgtctgtcttgtttcatgtctgagagatacattttattatttccattttaacagaattataaactgaggcaaatggaggtcaagcaaagtttgcctagctaataaaagagagagctctatctatctgagttcaaagccctgttctattcactccttcttacttttgaatcagacctatttccagcctgttgggttggccttcgaaattttcctaaattttacttatcctttcatttatcttttagatctgtgctactctgtgcatttgtctttgattatttatctttattgttatcttggttaataaattaagtttgtgagttcattttcttaaatatagaatgatctgagatggcatattctttaaaatgaggtcttgagaaaactcatgcaactacactgatctttttagaaatttgcagaaaacattgttcctctgtccctcccctatttttgtgtgctatcttgaaaaaacaaaaatagcacacaaaaaagtttttgccagattttactttttagatcacttattttgccagattttatttttagatcacttattttagacttgctgcccctttagtagcatgtttatgttcctaagaatttttgaagcccacttggttgaagtctgtcatataacagagctgttactaacatgccctttcttggctctcatgaactctaaggtgcctggtcagttctacgtgctcagctggtggttttactttggtcataaatggtcccagcatgtcacttctccttattacttccttattttttctcagaagaagaaattaatagtatcagatgctctgtttagttgattttcagcagttgagcctttcatcttccagagcttttcttgccagagaatgtgaccttttaaaactgaaaagtaactgtcatgtactttcagaagtagcattttattcccgtcactgaaaccttgaaaacatccaaggtttaagctgagtagttcacagatgggttggcagatcccatataaacacatgattcaccctggatcagaagtaactgcagaagccaaaattacatgcattggtggcccattggaccgtgaagctgtgggaaaatgaagggggaaggaagtaacctgaaccttttatctctcagtctaccctcaaacacagtgatgatgtacaggttttgaacattgcaaacccagacttgcctatttacattcaaccccttctgttttacttccagctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcgggtgaggaacaaaaatatttacattcctgacaatttatgtttgggatattttaaaggct

SEQ ID NO: 132708 - DNA, 1045 bp, Homo sapiens
agaccatcctggccatcatggtaaaaccctgtctctactaagaaaaaaatacaaaaattagctgggtgtggtggtgtacgcctatagtccccgctgctctggaggctgaggcaggagaatcacttgaacccaggaggcagaggttgcagtgagccgagattgcgctactgcactccagcctggtgacagagcaagactccatctaaaaaaaaaaaaactcctgtatcagctctcaaggtattcagcagggaagtaggtttgactttgccaggtcatttaactaaatgggagctgtatccaactttaccatatcttatgcttggtccctgtctcatctcctccacctggggaaggtattgcctaagaactgtaatcccagctactggggaggctgaggcaggaaaatcacctcatatatataggtccaagggaataactgttcttttgctgatggtaggattctcttctttgacactatttttcatttttaccctagttcattgactggctattcagcatcatggaaagccctaaagaagccctctcagcacagtccagggatcttttgaaaggtattacttccatgttttatgctcaacataggggaaaaaccattattgttgtctgtggagcagaatggcattctagtggttgcaggttgagtatctcttacccgaaatgcttgggaccagaggtgttttggattttggatgtttttggatttgggtatatttgaacatacataaggagatgctttggggatggaacccaagtctaaacacaaagtttatttatgtttcatacataccttacatacatggccggaaggtaattttatataatatttttagtaattttgtacatgaatcaaggtacttggtgttaagtacttatgtgtggaattttctacttgtgttgtcatattgaggctcaaaaagtttcagattttggaggattttggatttttagattagggatgctcagcctatattggtttctgaaagagataatctggagctgtttagtgtggcattttgaaccagaa

SEQ ID NO: 132709 - DNA, 1047 bp, Homo sapiens
tatgtgtacaatgtggaatgattaaatcaagctaattaacatatctaccacctcgcttacttttcgtggtgagatttgaaatgtactcttggctattttgaaatatacattattaagcacagtcaccctgctgtgcactagatctcaaaaatgtattcctcctaacaaactttgtaccctttgaccaacagctcccaatttcctttctatattctctacagtactatgatttaacaaagataatgtatttgatatttcaatgagaggttacttgattcttaaagaatggacaatcaggttcttactgttttcaagacaattattctttagatccacttggcatagtctattccaaaattaataattcttccttttgaatcaaaacaaatttagaaattctaacatgatttacagtaacaagctctttttatctgctcatcagtagatagaaaatatgtgtttttgttttataactggcttttatatactttggttattgttaatgtcgtcatcattttatgttaaacaccatgtccttatgtttttcccttagttaccttaacatgctttcttattttatgtcttcagttttgaaaactttaatcatgtcttacagaatgctccttaccagtctaccaaatccattgcagaagaaagcatatattctccaaatatcctcaagctctgctgactgatgatctgaatgatttgatcttaagttttaggtttatatttaggctatataattagcctactcatactcaataattcattctgtgttcattgagcatgtatactggtgcataaaagagaggaaggaagcaaagaaacagactcagacatcctggtaccccccccccccccagagcttacagtctagtcaaggaaatggacattaatcaaagaatcatacaaatgtgtaattatgctgatataagccctgttaagacagcagtccccaacctttttggcaccagttactggttttgtggaagacagtttttccacagaccagaggaagaaggatggtttcaggatggttcaagc

SEQ ID NO: 132710 - DNA, 1034 bp, Homo sapiens
attttaatggaaagtcagattatttagtctagcaatgcaaataagcacctgcttcatggctaaaaataaattagggtaaaatctggctttttgcctaaaaggcaaaaaggaattcctttgggaattccttcatatttgttctcttaagagtatgtgactgtgaaatctttagagggatttttgacaaacagatccctgcttgccctgatcagaaatagaagtgttactggcaaatacagaaacagtttatgtgatttgggctcataaatggaatctccgtaagcacaatcatttaggagtattagtttttagtgttttggttgagaaattttaaaaattgagtaaaaatgtgtaaaattaatagtgcaggagtgtttattatgacacagagggaaggatgtataattgaatcattttaattcaattacaaatgaaatattggcatttaaagcatttctcaaaaagtgatggagtaatctattaagggtttcctataggggatatcagtctaatgttatgacacaaaggttagtgttggctattttcccctcttcttgagttgaaacatcctaaagcagcatgaataaaaatctcctcctcaggcttctgtacaagcaaactgaacaaagccccttaaaatcaacatttcaggcttgatagtgtttctgtactataaaagtcaagttgttttgattaaatttactgaaatcaactagttttccaattcaacatttttttctaagctaataaagtttgcaagctcatttcggaggaggggattggagaggagaaatacctagttttgatttatattatcatttcttttatgcttcttttggaccattttaacttttccattttgaaaagtaaaagtatcaaagtttactatattttcttatatgatttttattgtcgtgtaattatttcaaaaattggaagtccataaatagctacgctatggttttgcccttttccccaaagcgtataaaaaaataaaatatatgtcagtcaaatgattattgtcttttagtcaa

SEQ ID NO: 132711 - DNA, 1001 bp, Homo sapiens
ttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttgcatttgcttgcatttatttcttccctcaatctgttgtagttttacaaaggcaacgctgttcagttaatttttgagatcaaatttgtctttttttttttt

SEQ ID NO: 132712 - DNA, 1260 bp, Homo sapiens
tgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaacccc

SEQ ID NO: 132713 - DNA, 1032 bp, Homo sapiens
tgatggtgatacgcttccacagagtttttaacttcaatgctttttttctccattggctcatattataattttcaagatgttttcttttcttttctgattgccttgatactgacccaaatcctttacctctaaatattctttctctaggatttttgtcaaattgtaaatgatatatgagctcttttcggctacagactaggtcgaattatgcagaaggaattttcaagatttttaggactcttactgtgataagtctttctgtaaactaaaggatcatatcttgagctatttcttatttttgcagattttaaaaaatttgagatgtcttttcctttatgaggtagtgtagtgtagtagtaggagtgtcagaatgaaatgcacaaagatctgggtcctagtcccatttctgccattttgtaaccatgtacatgagttggggcagatcgtttaatctgttttcttatttgtaaattgggggtaatagtagaagagattatatggtgtattagaaaagagggaaaagcaaaatacagctgtgaaaactatgtaagcaaattggaagacaatttataaaaaaagttgggtttttttagtaattgtatttaaatttatttcagtgttttattgttttatgttgtttttgtctaacttaaatgtgagaaaaaaagcagagttctggatagaaggcagataacctttgttctcatccaacctgaagcacttatttgctaaataattccagtcaaaaacagaagaaacgtggtattttagttttatcttgaggaaaggtcctgcttctcttactctatctaaaagcctagaaataaaatgataattattctatgactcatatacttgctttttatgttattggcttattatgagactcaaatcaggtaaggtatataaaactgctttgagaatggtaagaagctgtacaaataaaagttctaagatatggcttataaattcttttcaaccctccgtttttcctttcactcctacaaaagtttgcttttgaaatgattaaaa

SEQ ID NO: 132714 - DNA, 1084 bp, Homo sapiens
tttctttagttagagacaagggattttatgtgaaatgtgtggaaattctatgccagaacgatagtacatgtagaattctttgtaaagatagaaatcttgagagaccaaggagttaattgtcaaggatctcaagttcttctcctggttagttcacattcctcatcttcctttgtttctggagttactcattatctgtagatctcttttaaaagtggtttttacacattcactttaaagagtaagaatgttcagtaaatacaattgtattttaatgtttaataaatactaatgtttaataaatactgtttgatgtttcatgtttttaagcattgaagttttaataaaaagctttgcttttaataaataaaatttcatgttaattttaatgcttttccaagaaataaagtagcagtcactattctcgattgtcattatttattattactcagggtattaaaacatacagaaagatcacattataccttcatttcatgcctcttggagtatattaaactaagctgctaatttaacaaaaatgtgtagcacaaaagtgaggtagttttagtctacaacttttataagcatctctttatataaggataatttgtttaaagacatcattgtacaagctgatcttgcctatgaaggcttttaagaactcacaaaacagctttagctgaaaattagattcacagtgccttatccattcgttatattaatggtaatttgttgcagggtcaattggccaggacatacagtttattacaagaactggtttatttattttacctataacttagttttaaaaacttgtttcatcagtttatttgggcttcttttgccttttgcagagttccatgtaccctcatctacatcagttacagacatatccagtgcccccttgacctcaatgtagttgatgagctgggttccatgtgtggaaatgaacattgcttgccaagcgccatcctccatagctgaaacgtgttttactctaattactaaacacctgaagcttcttttttgattcgaagtgaacaatgtttgtggggagaaacccaaacccctaaaacttcagatttag

SEQ ID NO: 132715 - DNA, 1021 bp, Homo sapiens
agtccgccagggtaggtagcatataggggagtgtggctcaagaatctaagtttttcacttattttgaattattaagagtttgcgttatagttctcttttttgttttacttctatagagtgcttctacaatttggaagaggggaaaagtacaataaaatggcaaatattaaagtgaccaagaaggcatagcattggttacagaaaagttctttcacttctccttaggtaattctgtgttggattttcttctttgtattttaaatctaggttctttgcttagaggtaattttgattctgaggagggtagcaggaaaggaaaatgaactgcatctaaaaaccagtgtaatccgacaactgacgtcttatttctgccaaatttcaggtggacttgggccacgttagtaaattggatatgtataaaataagataaagaaatcatctcagaaagtcctgctctagaagcttctagtatgtgaggtgagactattttagagtccaaggtttgaatacaagcaaaggattgatttccccaaaagtcaaactggtacgatcttactatctaaaataacttgagatttttgagttatagcacatgttgaagtagaaattccagtcataaagtcattattgaatgattatcctggggagttttgcctcactgatcaaaccttttactgattatctcaacttcattaactaaataaaaaatttcatataagaagcagtggactaaagcactaaaagtgtgagttctctgaagtaaaatccacataaagtaaatgaagccttaaaaattaggatttaagtagcttttaactagagtggtttttgaagtaaaaactggtaatattgtcacttgacattttcttttcatattctgtgccgtgactcaaaactcatttcctttttataggtgagaatggaagtagataaaatttgaaaacaaatacacaaaccccagcttttttgcagctggactttaataattttataacatggctgcatgtttcctagcacgtta

SEQ ID NO: 132716 - DNA, 1036 bp, Homo sapiens
ataaattctgaaaagtgtataacagagacaaagtgtttaacctataatgtggattgttggccctttttggaattttaaacgagaagggaggtatgaaatgctttattctatatttaagcatctttttagaagtggaaataaattggaggatcacttttatgtacagtgtaatggctagatagctattctagaaactacaacaaatgcttgaggaagtaaaattagaaggtagtataaaattgtgtattatatttttacaatttcaaggagattgcatacttataaatttcatatcctcaagtgaagagtgttgaactgaataaaatagaatttttctacataccatgtttttctcagattaaaaaaaatagtcatcttggtttgcctaaaaaactaagctgtagttaaatttggttggtacgtatttgggataattaaaaatactttaattcatgtactttaacagttcttttcttcagtaacaggtttttataagaaatgttttacttgaaacattgacatttaatgacagatgtcattatatttttcatataattgccacagtttttcttcattgtgtgtatctaggtagctttggcatataaacatcgggggggctctaaacaaattttaactgtaaaaaagcaagagatgcaatcccagattattaacatttgaggaatgaaatccagctttaagataaaatggctttttgaagacactttaaaatacatataatgataggattcttagagagtaatgtttttggtagttcttttaatcataaaatgaattaacaaaagaattgatgcttaagtttgaacagcttcttggtttcacaactatttccttagaaataatctcccaagtgattcagaaatttttatggaagtgaggaaaaaaaacagcaacttttgttggatctagggtaggtcaatcttaactaagaaacagcgaaatttgatctttgtgttataaactgtagtttcactgaggacttcttaactatgtcatctttttaaatacaattaagtgt

SEQ ID NO: 132717 - DNA, 1128 bp, Homo sapiens
tagaggctttagaaaatttacggatgaaacagactcatgggtatgtggctcaggggaaataagatatatatacaaataaacaaaatactattgtatgatccaggcaaagatggaattatgtgagttcaaaggaagaataaattctttccagaaaagagaatcagggaagatatctttgtggaaaagggagaatttgagtgtagcattgtgacttggatataatttagacatgttattttattgaaaatgattggatgttcctcaatatccatgcctggaggcagggtccaccttccccggggggaacagcatctttccctacaagtcccttcaagcaccaacttttctgtgtcttttcatcttctggatggactacttacctctgaaatatcttaaaatctaacattcagtccactcaacataatctccaattcatctagggagcttctgctttcatcttcatctttgctttgctgtcattagtatttatagtccttaattgaacaactttggagctgaaagacctgaagtcaagtccaagctctactacctagtagctaaaaaagctgctaagttgcttattcatcctaactctcagcgtcctcattttcaaagtggtatatattaccgatagttcccatctcacaggatggttgaaagtattcaattaggtaacgtacaaaaagatggtagcactctgcctggcttaaataaaagcacaataaatattaacttctgtgttgtatatctcgttattactatttacaagtccattcttgtcgtattttctttcttactcacactgaactatatgattgatcattttcaagtctcttttattagaactatcaaatctcatcctcttgtccttctgacacacaccgtgtaaacatccagacttggatcaatcaaatggctcattcttttctgttcctactcacagcctgctgagtgctgctggatgaaatcacccaatagtgggtttattgcgtttacaatgttatagccttccactatcctgtggcacttaatgccgcaggtcaattctgtgacgtatctctggccaattcttctcctacttaactactaaaagcctttcctattcctttcaagaatgactgaacttgt

SEQ ID NO: 132718 - DNA, 1052 bp, Homo sapiens
ccttggtgaggattctccctcccgcgagaacttctggaatgccgccgggccagattttgcagctgaggcctccgacgccactaatattgggccaagcagggagtgctgctcttccttataaggttttagcgaaagttaagtaagccaattaaagtgcaaaacacacagtctggaacaatacagcgctctataaatggtctccattattatcattatccgttagttataactggggataaaaaaaaaaaaaaaacgacaaaaacctggagaaccggaaaggtctgcaaaaggggcggaacgcgggaacttcgatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgg

SEQ ID NO: 132719 - DNA, 1118 bp, Homo sapiens
ctgggaggcggagcttgcagtgagccgagatcgcaccactgcactccagcctgggcgacagagtgagactccgtctcaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcc

SEQ ID NO: 132720 - DNA, 1009 bp, Homo sapiens
gaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagtt

SEQ ID NO: 132721 - DNA, 7207 bp, Homo sapiens
gcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctgatgctttccctccccactcccccaaccccacaagaggccctggtgtgtgatgttccccttcctatgtccaagtgttctcattgttcagttcccacctatgagtcagaacatgcggagtttggttttttgttcttgggatactttgctgagaatgatggtttccagcttcatccatgtccctacaaaggacaggaactaatccctttttatggctgcgtagtattccatggtgtatatgtgccacattttcttaatccagtctatcattgatggacatttgggttggttccaagtctttgctattgtgaatagtgccgcaataaacatacgtgtgcatgtgcctttatagcagcatgatttataatcctttgggtatatacccagtaatgggatggctgggtcaaatggtatttctagttctagatccatgagaaatcgccacactgtcttccacaatggttgaactagttcaccttcccaccagcagtgtaaaagtgttcctatttctccacatcctctccagcacctgttgtttcctgacattttaatgatcaccattctaactggtgtgagatggtatctcattgtggttttgatttgcatttctctgatggccagtgatgatgagcattttttcatgtgtcttttggctgcataaatgtcttctattgagaagtgtctgttcatatcttttgcccacattttgatggggttgtttgatttttttcttgtaactttgtttgagttctttgtagattctggatattagcccttagtcagatgcgtaggttgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttccccatgcctatgtcctgaatggtattgcctaggttttcttctagggtttttatggttttaggtctaacatttaagtctttaatctatcttgaattaatttttgtataaggtgtaaagaaaggatccagtttcagctttctacacatggctagccagttttcccagcaccatttatgaaatagggaatcctttccccatttcttgtttttgtcaggtttgtcacagatcagatgcttgtagatgtgtggtattatttctgagggctctgttctgttccattggtctatatctgttttggtaccagtaccacgctgttttggtgactgtagccttgtagtgtagtttgaagtcaggtagtgagatgcctccagctttgttcttttggcttaggattgtcttggcaatgttcatggttccatatgaactttaaagtagtttttcccaattctgtgaagaaagccattggtagcttgatggggatggcactgaatctataaattacctatggccattttcatgatattgattctacctatccatgagcatggaatgttcttccatttgtttgtatcctcttttatttcattgagcagtggtttgtagttctccttgaagaggtccttcacaacccttgtaagttggattcctaggtattttattctctttgaagcaattgtgaatgtgagttcactcaagatttggctctctgtttgtctgttattggtgtataagaatgcttgtgatttttgcacattgattttgtgtcctgagactttgctgaagttgcttttcatcttaaggagattttgggctgagacgatggggttttctaaatatacagtcatgtcatctgcaaacaaggacaatttgattactcttttcctaattgaataccctttacatctttctcctgcctgattgccctggccagaacttccagcactgtgttgaataggagtggtgagagagggcatccctgtcttgtgccagttttcaaagggaatgcttccagtttttgcccattcagtatgatattggctgtggggttgtcataaatagctcttattattttgagctacgtcccatcaatacctaacttattgagagtttttagcatgaagggctgttgaattttgtcaaaggcctattctgcatctattgagataatcatgtagtttttgtctttggttctgtttatatgctggattatgtttattgatttgcgtatgttgaaccagccttgcatcccagggatgaagcccacttgatgatggtggataagctttttgatgtgctgctggattcagtttgccagtattttattgaggatttttgcatcgatgttcatcagggatattggtctaaaattgtcttttttggttgtgtctctgccaggctttggtatcaggatgatgctggcctcataaaatgagttagggaggattccctctttttttattgattggaatagtttcagaaggaatggtaccagctcctccttgtacctctggtagaattcggctgtgaatccatctggtcctggactttttttggttggtaggctattaattattgcctcaacttcagagcctgtttgttattggtctattcagggattcaatttcttcctggtttagtcttgggagggtgtgtgtgtccaggaatttatccatttcttctagattttctagtttatttgcatagaagtgtttatagtatgctctgatggtagtttgtatttctgtgggatcggtggtgatatcccctttatcattttttattgcatctatttgattcttctctcttttcttctttattagtcttgctagtggtctatcaattttgttgatcctttcagaaaaccaactcctggattcattgattttttgatgggttttttgtgtctctatctccttcagttcttctctgatcttagttatttcttgtcttctgctagcttttgaatgtgtttgctcttgcttctctagttcttttcattgtgatgttagggtgtcaattttagatctctcttgctttctcttgtgggcatttagtgctataaatttccctctacacactgctttaaatgtgtcccagagattctggtatgttgtgtatttgttctcattggtttcaaagaacatctttatttctgccttcgttttgttatgtacccagtagtcattcaggagcaggttcttcaatttccatgtagttgagcagttttgggtgagtttcttaatcctgagttctagtttgattgcactgtggtctgagagatagtttgttataatttctgttcttttacatttgctgaggagtgctttacttccaactatgtggtcaattttggaataagtgtgatgtggtgccgagaagaatgtatattctgttgatttggggtggagagttctgtagatgtctgttaggtccgcttggtgcagagctgaattcaattcctggatatccttgttaactttctgtctcgttgatctgtctaatgttgacagtggggtgttaaagtctcccattattattgtgtgggagtctaagtctctttgtagatctctaaggacttgctttatgaatctgggctcctgtattgggtgcatatagatttaggatagttggctcttcttgttgaattgatccctttaccattatgtaatggccttctttgtctcttttgatctttgttggtttaaagtctgttttatcagagactaggattgcaacgactgcctttttttgttttccatttgcttggtagatcttcctccatccctttattttgagcctatgtgtgtctctgcacgtgagttgggtctcctgaatacagcacactgatgggtcttgactctttatccaatttgccagtctgtgtcttttaattggagcatttagcccatttacatttaaggttaatattgttatgtgtgaatttgatcctgtcactatgatgttagctggttattttggtcgttagttgatgcagtttcttcctagcatcgatggtctttatattttggcatgtttttgcagtggctggtaccagttgttcctttcctccaggagctcttttagggcaggcatggtggtgacaaaatcctcagcatttgcttgtctgtaaaggattttatttctccttctcttatgaagcttagtttggctggatatgaaattctgggttgaaaattcttttctttaagaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggcgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgctttggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaagg

SEQ ID NO: 132722 - DNA, 1021 bp, Homo sapiens
cttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgtttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccatacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttg

SEQ ID NO: 132723 - DNA, 1100 bp, Homo sapiens
gtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaa

SEQ ID NO: 132724 - DNA, 1038 bp, Homo sapiens
agctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggagg

SEQ ID NO: 132725 - DNA, 2208 bp, Homo sapiens
tcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatc

SEQ ID NO: 132726 - DNA, 1038 bp, Homo sapiens
tactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttag

SEQ ID NO: 132727 - DNA, 1034 bp, Homo sapiens
ctgccccgcgcccagacaccccgactccccttgatcccgccgcctgactcctcggcgtacgttctctctccggtctccccctccatgtcccctcctccccttttcttccacatcaccgatcctttctggactctctcccttcctcctttccagctgggagacaggaaaagcggtcctgtttgggaacagtaaaagcagggcaaggaaaggaaggagcggcagaaaggaggggtgagtcgaggacacaggggcagccggagaatgcggaggagccgggtcctgagcgcggtctaagcgaggctcggctctcgtccaggaactcggacgcgggctcgccggctctccgcgcgcgggaagtcgagcccaggacgccgccttcaggccggcgcgctgacccggtgccccgacccggagcctgcggtctgcctggatccgtcctaaacctcgcgggctggacccgcggcctgagtgggtgggtgtgtgccagaggattcgggactaggcccagctccgggaacctggaaatgtggcccgcttctcagtggcttcctgttcatgcgcttgggcctagtggcctagttgaagaagtggaaccacagcgtgagccgacagggccttacagatcagacgtcaagccccccagaccttacaggggaggaaagtgaggcctgcactggccgagccacccacttaaggcggtgcggtagcctagaggagcggcagacttctctttccccatcccccgccccatcacttgacgttgctgccggacctcggtacaaacccaagacaaaacggggccctttggaaaaagtgagatttagcgatcactcttacgtagccactctaaatatctatctagatatttacaaatgcacctccccggtaggtagatttcactcagaatttacccaacaccgtgctttgtgctggggccacatgccacctttctgtctagtatggctgctctttctccctcttcgcaaatatagctctttttccttcaggtctcttctgaagtaagtagcccttcc

SEQ ID NO: 132728 - DNA, 1076 bp, Homo sapiens
ttgaggataatctgctttttcaagtctactgacttaaatgttaatcatatctaaaaaatacctccacagcaatatttagactggtgtttgactcaaacactgggtaccacagcctagccaagttgacataccaaattaactgtcacattatcccgtcatgcctgaggggttctctgaccctcagttttctgaggatcaaatttaaattgagggatctatctttgtttattggagccatatagctcaaagtataatcattttctctccacaggaactagacctagggataagggtaattgcttatttcagaggaatgccatctgaataaaaggataattatatagtaagctctctgttcaaaaaatgtaaatattaaagtttgaacatctaaattccatcttggtttcccccactgccgctgcccaatacctgttctctttcagttgcagtatgcaggggaattctaagtttaatattagtctcagcaaaatacaatggtgaagatgactctttctagcataacaatgggtatgtggtattccaaatacttttggaatgcggagtgactattggctatgtgctcttcaaaaaattaataatgaagaactgagcatgtaatttcacttatattacttattttatcctcacagtggcctttcaaaattgggattattactcctgttttacaggtggaaagaatgaggcctagaaaggctcaaatcttgaacacttcatggccagcaagagccagggctggaatcatcaggcaggcctttgggttacaagccttgtgccttttctgttgtcccaaaggccagggtcaatagggagtgagttatctgtgggtcacttatgcagacagaatcactgaatattggaagtttttggggttctcttccactggcctaaaaacctgagttaattgagttttttttaacaggggtaaataattttctgttttagatcagcaaattcattccataggcagggataggggagaaaaatcttactgaatatcccttgtcttgttctcctcctccccaaacttaatgtcctatgacactagctttatccct

SEQ ID NO: 132729 - DNA, 2697 bp, Homo sapiens
ctcctttaaaaatccctcatttgttataccattattctaagaattcaaaagaaatgaacacttctttaaaatctatactattaacaagatcccttaatattagcttagttttagagggtgatagtgaggtgagtactgaatatgaccactagccaacggtaaagtacaaaagagttgtccgagattgtaaaagaaataaaaaatatcagtactaattaaagcaggattcgtacttaaacattgaataagtgtattttaacaatgaagataaagatgcattatttatgaagatcctttgccattcaaaaaggacctaacagttgctgcaggaatatttttgtaatctgggcactgagtatgataattaaagaatgagaaacctatagaactatatattttttctcttatgcatcactcataagacactgctaacataaaaggaactaagtactgtggttgaggaatcccgtctcattctcaattaacctctatgagaaaacaatacaacagatttcatatagtagcttagaagtttacattgattttttccatgtactatgattttgtagaattccttaaatccaatctagaatgcgtaacttatactttacttatctttatcgttgaaagcagacagacaagataatcttcttccctaaataagctttccttttctccttttctccccaattcagtctattccttgcatctctgatcatgagatggcagaacaaaaaccactaaaaaaagcttaaacagtgggtttttcaatgtctctctttaggatttttgctgggtaaaagcctgttttacgcgtggaatgcacacctccggccaacggagactcctgtacaaatctacatcggcgatctaggttccagccccgatccgccgaggccgcgccccgcgttcgcgcgccccctgccggcgaggccctggggccccagctacctggatcgcgcgcctcccgaaacggttgactccgttgggatccgcgccggcttccaggagctgtcgcaccttctccactagtccccgcgccgcggcgctggccagaccctcatcgctgccgcccccactgggcatgcccttgttctcctcgcgcattccgcagcccccagacgcgcagcggcccggataatccaccgttggccgtaaacttaacgacactcttcccttctttcccacgctgctccggcgcactctctccttcctaggagacctgggctcagcttcattaccctcccgtcgtccttctgcggcttggggccccgtgcagtggccgagcggccggtcgttagctccgggcttttcctggcgctcaagaaccagcgggcgcgcctggattgcttctgggaaaaagcgcctagcgcggacgcagccgagctcaaagccgctctggccgcagggtgcggacgcgtcgcggagtcctcactgccccgcctcgctctggcagagtggggagccagccggcaaagaattccgttttcagctgggccaaggggccggcgtctccccacccccttaggctccgccccctgtccgctgtgatcgccgggaggccaggcccgggccgacgcgtcacgagggcggggaagcctgcccaaagatgctaggacgcatgcgccagagactgggccagggagccgccaggaatgctggctgcactgctcgctggatgtccagtaaagccaaggctaatattttgggaatgttcaccactgccctcagctcctaatccccagtaggcggagcagaggatttctgttccttcagccagccagttggtttcactgtggagacgttggtggctcccttgtgaccgagagaaagtcattcaaaataactccgtgtttcttaagatgtctgaaagcgacagctctgcacctgtcatacaagttaaattcatccccaggcagtacttgggcttcacaagtttcataacttgtatcaaacttagcaattttctcttggatgtgtctttctgtttgaattagtcaaccataaaaatagagaaaaatcccgagaatcatgttttgcgtgtgctttttaattctttccatttttgcattatggatacaacccttaaaagagaaaaaaactagttcgagattgagagtggcaacctggcacacataagacaaaaaaaaattatactttaagaatctgagatcccagtttcatcatatttgtacagtaaatctttgtttgcactcttacctatttaaacccactttgtcaggtatcttatttttatttatcatgagtaataaaggaaatttatgcagtaataatgaaacatcataagagaggggtgtggtgctgggcttgtcattaaacaggctgaacctgtcattaaattctcttctgaagatttaaatgccaagtgctttttttccccttcctaatcttcctaggtgagtttgaatcaacatttattacttaaaatatttaaaacatttcagcggatgctacattggataggaagagaaccgcaagttatggatttgttgcctaaaaactttggtgaggaactgcataagtggacctctcctaaaagtgaacaatttttgtttacagaatcattttggttcggagtgctgaggaagacaaagtcttaacaggagggcaattgcttgtgtattgcaaaatgagagtcttcacatgttttttttaggataccttagctctgactcc

SEQ ID NO: 132730 - DNA, 1188 bp, Homo sapiens
tttgctaacctgtggtatagtgaaaggagttcaactagagtttgattatggctgtgccattctagttgggtagttttaggaaagttatttaatttagatttgatgtagttttctcatatgtaaaatggggataataaaacctgcttcacaagactactatgaggagtaagctatgtagctaaatatagcaaaatatctggcatctaatagatgcctaataaatggtgactataatgattcttatcattactgtattattttaaacatttatcttttttttttaggttgttgtctaactaaggtatttagagaaaataagtgctgctgagggcagctggaactgttttgctggttcatcactgaaattctagttcttgttggtgcttatttcataattatgaaactaattcttttgaaaagaacttgaagtagagcaacaagaactaagatagaactaataccattctctctcagttcttattgctttacttcaagttcttttgaaaagaattacatagatatgggtgcatgtgtttgtttattttccttgttgggtaatcgtgaatatgttgattggcgtcaaacatgggtctcacctatacccatggcagtaagcttctattgatttgaattcagactagccctggtggccctgtgagtgggaaagtctaggtgtgcctagcttggtctgtggttccacgaggggttggatgcatctgttctacttgtggaatgttggcaccaatatattggctgcttctccgagtatttgcctttgtcttctttgtgaaaggtcactggctggtttgagctattgggctgtttatgccacatcctgtgcatgccacactggctttctttctgtggtgtttccagagataagtttgcctgatagaagtcagactctgtggctttttatcattatagatttttctagaaggagaagaggccatgatcacatctgaggatcctgagtcattgtagacatgtactgaattaaagagaattttttgactaaaggagaattgcatcaatcacggtgaaggagatgccacaggacagggcctgaggtgttggcttagccacagatgtaagggctacagttaacagacaactttcagtttccactattggaagggatgatcagtccttccctcctctattttcttgagccccgtttttcacctt

SEQ ID NO: 132731 - DNA, 1299 bp, Homo sapiens
ggagcctcatagaaattaaatgacaagttcaaggtgtcatggctatttcattatagtgccagtgtttgaacacaaatcaatttgactccaaaacatcattactctactcaattctagttcaatccagatgttcacaaacaaccagactatagtggagatgtgggtggtgggttgagaaggagatcataaccaacatcagactgtcagtgaagcagactgggagaagttttatgaagccaagcagctgtgcaaggtacagtagagatggtcagattgttcatgtgtatggattccatcttctgaggaatgaactccttgatattcctgagttagtccagtttaggcaggagtaaacagaaggtaaacagaagattggagactgtgtgtgtgcacgaatgcctcctttgtagctggatgtctaacatcatgatagccacactcacatgaatacagagatacacaatttacaaattaatgtaacataaaactcccatgcagtctgatttcatcttactgacatttctgtcagtcagtgttagcatcttaattatataaatgtggaaactgaaatactcaagaggttccctgacttcccaggccacacagtaagctttggtgccagaatgtatctctaggctttctcatctcaacccagcattcattatactattgctcactgcgtgtagaatcagatttgatttctctgacttttcttagtcacttctgtggttttgtaccactccctctctcactaaataactgcctgcaaaagtaaaaatttccatgaaaacagaaaacaaatgtaccagaaatgttgatggtgtaagagataaaactgggataaagagaaaatgtgttggaaagtggtgtcctttaatgcaacagaaaagtatattgggagaaaaagaaaagagagaaaaatagacaatctgaagtgatgagaagagcaaatgctacagatgtacctgaacctcttcagtaggtgtgatcctgaagagttgtgtataacaacaatgaacaaaaataaaatgtactgtggaaattgtctagctgttgagatcctcctgtgcgatatttttcaaagtgaaaactccaatcaaccctagcttatttatggagaagactttgccccacagtacccagaaagtttcttgacaatatcatatatgcataataaccctgagacaatttttgtttaccaggaaaacatataaaagggaacattaaactttgtctagttctactgcataaacatgtgataatgtgcatggtgaccttctgttgtaaatggaaagagtt

SEQ ID NO: 132732 - DNA, 1090 bp, Homo sapiens
acaaaactttttgctcttctctttcacataactcccgtggaataatttccattgaattgcatggaagaggctgttcatggggttagtctggcagataagaggtctccactggattttttcattttgcaatcagtttcatacatatacgtacatacttttcttggagtcatagttcattctcaggtcttttagagttaaatatctttcatttcttcttttaaggtcttaatttcttgtttttcgagtttcatgggagatatccagtcaccaatccaatccatatcggggaaaagtacaacaaatgagtgaaatttgtaaccaaccttggatgatggaataagacatttgggagaacacaggagaagtggggaggttaaggagggatagctctgtgaaaattttgcattactcttgcctgaggtctactcttccttgtcatgttggtggctgttttgacaatgagaaatatttaatggcaaacttagtcttctaatttgaaaatggaaatcataacagttcttgcctcttagggatagtgtgagacaagtgaaataatccatgtaagaggtatagtactatgcttgccattctttaagagctcaacaaatattcactttttacctattagtatcaatcttaattctaaaattctattatttaatattttccagtggtgtttctaaataatatctaatgactaggctaatacactatgtggttcttctagggttcaagcatcactgttaggtgtgctggaatcctttcccgagtcagtactgctttctagaagaaaaccggggagatctatttggaatgtatctaactccaaagaaaccatcagaggtaacaggtaggagatatgaaacgaccttttagatatgaaccctaattgaataaaagttgccaaacaactgttcccaaacatctaaagaagagttttagtctaagtggaatggctggagagtatgggaagagttctttcctactctgtccaaacacaagcctctgtgacatttatcaaagaaatgcagccctttaaatctgggtataagtccgaaaggtgctttccttgtgaagcttcttttgtcct

SEQ ID NO: 132733 - DNA, 1037 bp, Homo sapiens
atcagatctcgtgagacttacttcactatcaggagaatagcacgagaaagatcggccctcgggattcagttacctcaccctggatacctcccacaaaatgtgggaattctgggagatacaattcaagttgagatttggtagggacacaggcaaaccatatcactataccacaagtttttttaaaaaaacaaacttttgagaatcttgtactgataattaatatctggtctggaagtgaagcacatttctttttcttgcaactgattggccagaaccagctagatggccccaccaagccaacattgggggagaactgaaatatttggcaaacagcaaccatgaccatcacagctggaagttctcagtctggaactccttccccaggcctcccatttctggaactctgagaacaacaatccaggaatctgatgacatcttttcctttactagccaaaatctgatgacattttttcctttactagccaaaagggagaacaataagcaaataaattcaattttctcccatttatacttttaaatctgagaacgaattgtgtgtttataagaaagtgagggttgagcatcatgaagaaaaatataaagatctttaaaaagtatatattgggcctattagctacaaacatggatcattattaatatgtgtctgactgacatttaaaatgcataatcaaaatcaagcctgttagatacaaaattcatccattaatagcaactaaatttcattaggtaagtagtagtgctatgtttaaaagagtaatctatttggaaacaggaattaatactcagaatattattattaatatatttgaaaattacttgtgtttatttgtcccagcccttacaaggtgtgtggtaatggttaaggtatttctcctctatatgcctgagttttcttctttacaaaaggggggagggaataatagcacctgattttacttttgttgtgaagattaaatttgtacatatataaatctatatatctatatatacacttatatatgtatgtaaaatatgta

SEQ ID NO: 132734 - DNA, 1139 bp, Homo sapiens
gaactttgctatttagtgtcctcatagaggggatggaggattcttcacaaaaagttcagttttgtgacaccacattcccctgattttactcttacctcttgagacaccaattttttaatgaagaagaaaattatgttgcctgcttaaagtaaggaaagcaggtgttggtgggattccttaatagaaatatagaggtttaaaatacctacaagagtaggagatagaattgatcaagtaaaaaaattgaagagattaattgaggacttaacatcagagaccatatgtttgttgtgacaataatccaaattattgtaataatgtgtttaggagtatttagccttgtaggtaccaagattgcattgatcctgtgttaggagtttgccaggtgtgtgcaatagtgagaaagacatgaagggatttgaggttgctgatgagtgaccagtttagatgacaactactgtttcttcaactctttcttcaacttcaactgtctgttttgggaaaggctagtggcctgtgaggaaacgaagaccccggagctggaggactcaaagagtttggagagcagacgtgtgcaagtgagggttttgtgagcactggaggacaggcagctggggaagagagtgtgttatttgcagttatgatattgggtgtggagctatttttggtggcagcaaagctcaggatgtatttttttattattcccataggtgatggaggctttttattttgccacaaaaccactggtgacgttgcctgtggccaccttggagaagacactggaggtacacaggatgtatccctggaagtggcagggggtataagtttagtaggagatttgttactgagtatttaaggtctaggaacagattgagggtgttgggtggattgcccactaagacactgggttttctagcatgatgacagaaattggagtttggggggagaagagttctattgtgtcttgaagaatgtgatcaggaggtatttctaatgacacaaacatagaagtatacacactggtatagtcagatggcatgagtaccaaggtggaagtgtggtggtcctaaagtggcattaaggagccaataaattgtcattcctaccttagctctgtgtcagatgaaatacacagcata

SEQ ID NO: 132735 - DNA, 1075 bp, Homo sapiens
ccagttcagcaaaacacaaatttgaaggcaatctgtacgttagggttcaggtgaagaaggcaaaggaatcaatgaaattgtaaaagctttccaaatttgccttttctcttaagattgtctttctctcattctcttctccctatttcaggaatgcaaatatcctgtttcatcaatcttttgttttctgactcaagataacaacaataatttattgagcacaaaccatgacttttgggtctgtgtagccccgaagcttcatagttcaatatctgacacataagaggggcttactctacacttaaatgttagttttgtcctcacttttttctctttctcagagatctcccttttcccctacttgtataagcatgaagaaatctttcttttcattctctccaagtttaatcagacaactccacatacatacatctttgttcacaactatgaacaagacagaaaagttgctggacctcaaggactttacaatcaatctgggaaggcaaacattgaacatataatgtccagtctgataagtgttagggaaggaaagctcagaatgcaagggaatataatctaatctaggagatcgtgggaaatatcactggggaatttggaactgaaagaaaaataagatttgattaggggaaattgaaggatcagggagtcaggcggagaagaatgtcccggcagatgagacactatgtaccaagcccgagtttgacagagagcgtggtttacagaaggaatctaaaaggtgtagtttctgtagcagaagtgtaagggtgttactcgtaggaggcctctattgaactcttttccagtgacgtagtgtgtggtctttaagtggctttgcaatgatagtaagatcagcattgcattactgaatgagctcctttagtaaacgtggatatgtgctttctgaatctatttgtttgtttttcccaagtcataaacagtgaatcaagcaaatgaaacataatcaagcttggatagtatcttccactaatttccttggtcttaagtaagactgacagtaaactgatggtcaacctgttcaatgggctttaacaagtag

SEQ ID NO: 132736 - DNA, 1010 bp, Homo sapiens
ccaccataagcagactgaaaaagtcaatctagttgaattgttttactttataatgcttttataagatactcagtctgaaactgaaagataggtagctctagaaatgtgataaatggccacagaagtaacaacttttaataaattaaattatggatgttatgtcaattttaagtaatgtctcagttttatatcttgttacctgacctaaatatcattccctttagtaaaatatctattaaagctttgtggcaaaataagaacagaaaaatggtttttgattttcagctttctctggtgaataatttgttttcttttatttttccttctaaaataatcacacgtttcattgcaaccctaaccctcttcaacacacacacacacacacacacacacacacacacacatggcttctagattctacatgtacaagagtgcaaatcaaactaccatagaaaaactaagaagagaggcctagaagcaagaggctgatacactatctcaggcttcaacaaaatatttatctctgactataccaaggatgggcagagcttgcatgtaagtggcttgggctagcagactgggttttgaaggaggacaacatggccatgttcttggttcggtcatgaactgtctatggcacataccttaaatactgttggaaggatccgttagctccagagactgcaaccaactgcctatggtcataactcagctctcagacacattttgttgtgcccacagagtgctgtttgcctgtttggtttttaaaccaacacttaaaatgcagggaatttaagataaaaatttgataaaaatgggaagatttggccgtattgggctcatggtaactgagatgcatctgaatgacaggcattcctttgaattgcacatttgctcttgtttttactataggccactctcactttctgtttttttccccggctttgaaacgatcagttttagtactgaaaaattatctaggatactaaaaccagaatttctctgctaga

SEQ ID NO: 132737 - DNA, 1702 bp, Homo sapiens
cctgtctagtttctagctcagaaaagcaaagatattctactttcatatgtatgataattggagctgagctgactttaaaaacagataatttttcttttttatccctaataaataatggtgcttacagcaatgagtgttgctggtaacagattccaccaatgggtgtggtgtgaagtttagcatttgtggattttgcagcttctgctattgtctacagcatttcctctcttgtctcggaggttcatactttctcaggcaaggacacttttaactccagataaatgtctgggttttctcactccaaggataagaaggtgggggtgatggagtggtggtggtagttgtggagttgtcttcctggcagggatttcattgtgggggaaagtctgtctttagaaaagaaatgtaaactgggcaagtagtctcatcagttaaatgatttccttgttgacataaggtgaggaaaagaagaacaacttttgggaaaagtaactgtgagaatacaagggaagaagaaaaataaggggttgaacattgaggaagacttatgagacagataaagtataaaggcaggtaatttgttctttcaatttggcatggggacagtaaaaattttttcttactaaacaaataaagcccatgtatttcttctgctctgggagcaccaattatattgagcctctaaataaagaaagtcaacatccacaagtgttctaaattccatctcgtagtgagagtcctgaaaattgcaatagctagagtcaatacttggagtatatgcataagacgtggtgtctcaaataggattaaggcctactcttggcatcttctgttattggtgttgtttctctgtattgattggtataacgttagacaaaactgcaggtcatctttgagaaaaactcagtataaacaatgaaaaaaatgtgtagctgcacatgtaatttgcatgtaacaaaaccaaaggatgctttagatagtaacagcagcctgtactttactccaacccattagttttatgataaatgtggtctggggaagtgctcgatctaggttgttcactttgtgtttttgtttctttctatcattcgggtgttgagtcacctgtttgtctgtgtcagtgtcagagcactgggtcacatcctgcattgtccaggttttattggtccctttcttaaattaaagctgattttccacttaaagagaattctgtctccttctgcaattgttcaaagtctagcatctcaagtgcagactctaaactgtatgtatatgtattgtgcaggctatctatcttcttagctttgaattctctagaaatattccagaggtgtgattcctctgttattcaagagtgatttccaaattgcctcagccaatgtgcctgcacaagttgtttgtaactcagggtgtaatgggaaatgctttagagccacatttgtggcttttgatgggaaaaaaaaaaaatcagtgtcctcctaagacttatacagtccttgaagccttttaggctattcctgcatctcatgttgcatccatacggactatttagccatattcaacaccatcctcttgctattttgttaagatttgactgttgttgttgttgtttttaaatataaatgtgtgatcacatgcacatacacagacaatgatgtgtaactcataaacatgaaaagtaaaaatttgaattttaactgaa

SEQ ID NO: 132738 - DNA, 1211 bp, Homo sapiens
ttagcaagtcgtttgctaaagtactctagaaatttaatttgatttaaaagtttaaaagtttgagggtccttgtataccatgcaaaataatttggagaacacttagtaatctttaaagattaatagtaatattaatttttaaaaacgaatgacaaagttttagtttgagcagttgagtgaataccagcagcaagaaaacgagaccccttgttctctttagtggggactgatattaggggctaaaatctgggcaccaagtgtgttcaatgctactgtggtatttctgcctctaggtctttttgtggtctgagataagaaatatatacaggtatatagacatataaacacctaaatatatacttactacatgtatttttatatacacataaattagatacatatacatgtacacatatatacatgcatataaatgtatacgtgtgtgtgtgtatatatgtatctatttagaaatcttgagtccatgctgataccactgattctgatccagcctcactaagtgcttgctttctctgtttcatgtttattagcccccttttccacagcaagaaaacaagtagctcccaacaacttcgatacatttactaatttgtttactcttataatagatctaaaataatttcagaattgctttgcccatacctctgaaacccttcaggatttgtctggtgttctctaccctgtacatgtaacttgcccaaagctaagggtttatagtcaaatactgtgatcataagctactcagggttgtcctttcattgccacaccgtccctgtaatatgctacatttttctttagaaataacattgggttcatgtttgcgtttgctttcattttctttcctttcttatcctttttcaaattatgtttattctttcagtatgtagaatattaagataacttcatgtcaaaccgtaaaaacaggaattgtcagggaagtgtcacactttgcatatatgttccatacgcttcccctgaaaacttcatagttttcacttttcctctttctttttgtaaagatatgcctgatttcttacttcctaatcttttttacacaaaaggtggcatactatatgtattcttctgcaccgtgcttttggtcatttaacaatatgtctgggaaattgctgcacattagttcataagtatcttattctttttttttttacagcttcatggaacttagagagcaac

SEQ ID NO: 132739 - DNA, 1046 bp, Homo sapiens
tgtcctctggaaattgggatttcgaggctagtcatagacagggagatttcgcaatagggtaatagagactgcaaaataagctgagtcagcagagccacggaatccgcatgaaataaacatttcattgacagcctgggatccacagggttagatgtagacatcagagctcggttattgtgcccaaatctgagaactggagatgaaaggaggcccaaacatttcaagaataaacagggagggactcaggatgatcttccagctagaacaagcacgcttttcacagcttcttttgaagttctgcttgggtgtggtgggtcagctgagtttaacagatctaagacacaaacacgtagaaatccaaggcctggaatagaatggcatagaaaaggtccagagaaggagttaaagtgagtaaaatataagcatgaagggaacatatttgaatttgacttctatattttggaaagagatctaggatgagatgtaatgaaggagccttattaaacaaatcctagaatacccaaactcaagttcttgagtagatatgtctgaaaattaagttatattttaaatatcaggtagtaaatataagtaatttacttccttactaggctgagaatatgcctcgccgccagtataaattcttaggtgagtaatttagaattaactgaaagaaagtagacacattcaagtaattatttttctttttggtaagacaggatgtaagagcttatagtgtgatcaattgcagaacacctttcccacttcttctttctctgtttactcctttcctctttcattattgaatttgtgacaaacatctataataaaacctgaaggccaagagaaaaatatacttggttaaatttgttgaatgggctgtatttaagggttttcttagaattaaaaaataaaagggaaattaaatttgatttaaatttttagatagtcataacattttttctgagcttaaatttttttttttaaataaacaaataattgtatctacttatgggcaacagcgcagtgttttgatatatgtattc

SEQ ID NO: 132740 - DNA, 1035 bp, Homo sapiens
gaagtcaagaccacttgcctacttgcgactggggtattgcattggttttctatggcttctgtaacaaattaccacaaacttggtggcttaaaacaactgaaattaattccctcacagttctggaggccagaattgtgaagtggttccactgggctaaaatcagtgctttcacagaaccacacctccccctggaagccattcttctcacagtctctaagggagaatctgttccttccctcttccagcttctggtggctgcccaagttcttggcttgtggctgcatcactccagtctctgtgaccacaggccttctcttgtgtcaccacgttgccttctgcttccctattataagaacacacctgactatatctagagttcacccagataatccaagataatctccccatctcatgatccttaatcgtatcttcagaatcctttttaacatataaggtaagattcactgactccagaaattaagacatggatatcgtgtgtgtgtgtgtgtgtgtgtgtgtgtgtgtgtgtgtgtgtgtgttttggggccagggatggggagggggggttgttgtaattgttatccagcctaccacagatattagaaactgttccataaatgactgttctgaaagtaaattattggctataatgctaatggttttcttttttttcctcatccaagttctagttaggtgaaaacatagctctctagtagtttgctgcacatttcctgtgaaagtgaagattctcctttcttaatgaagagcagctcatatatgatgacaaaacagaggcaaggttagcacttttgggacatgtttcatattttagttttaatttctgatctaggttttctgtattctctggttggttatgacgataaaaatcatggcattgtaactatttatgttatgaaatatcccctaagaaaatatattagactaccttttaaaatgatacttatatttattttctgattagaaaagttatagctcatttcagggaatttacaaaatgcagaacagcgtgaagaa

SEQ ID NO: 132741 - DNA, 1158 bp, Homo sapiens
gcctgcagttacggctcccctgcctgtacatggagccccgtcccttacttcttgccaccactgcatccccacagggcccacaatcatcggacaccttgcggcttttgcgtgagcttattcctgtgtttggaaacgcccctgccttgtctgtacttcaagaatcaacttaagctagcttcattctcccatttccacaaaaacttccagaactctgtacacatttcattcgtaggactcaggactgtgcatcattggatttttgtctagttacattgtttcctttacttgctgaattttcagggtgagtcacttgtttgttttctgtcatgttttgagtacccaatgtgtttttgttttaactgaatcaatacataagttaacaaataaagcaaaaccaatgtatagtaaagctaatgctagctactgcaagaaatcagtgccaatcaaatatatttattcctccaggctccttccattttgtggctctgccggtcttcttgaacacatggctcctgaggctggggtagagaaaggtaaggaatgtggagaattgtttctttgggggcatatgggccagaccaggaaacaatgcacattattatacttgcatttgattggccacagtcttagttcaacgctaactgtaagtgaggctgggaaatctagtctagctgtgcacccatgaataagacaaaacgggttttgaacagctagcaagtctctgccacaacctttatttgaaattaatcgacattgagatttgaattcccattactttacactgagatagtaatatactttttaatttaatttttttttttgttagatgtgtgctcttgctctgtcacccaggctggagtgcagtggcacgatcatactgcagccttgacctcctgggcttaagcagtccccctgcctcagcctcccaagtagttgggaccacaagtacatgccaccatgcctggctaatttttaaattttttatagaaacggggtctccccggtggctcacgcctgtaatcccagcactttgggaggccgaggtgggcggatcacgaggtcaggagatcgagaccatcctggctaacacagtgaaaccccgtctctactaaaaatacaaaaaaaattagccaggtgtggtggcagacgcctgtagtc

SEQ ID NO: 132742 - DNA, 1080 bp, Homo sapiens
ctgtgagaggtagttgatacatgctgcctattgaaattctataagggatgaggtaatacatgctttttaaaaaaatgttattgaagcacagtatacatatataccccaaaaacccagaaaagtgcacataagtgtatatagcttgatgagttttcacactggaaattcccatgtcccgggcctccagatcaggaacagagtaagaccagcatcccagaagctttcctccattaactcactctgtaattttttaaatttcttacagatacaagaatattgacattggtggacagatagggcctttaaaataaaggtagtagaagcgtgttctaaaactttaagtttctcaaagacaacaaaaggttttattgaatgactaaatccatactctctaggtcaggaggcagcaacccttttctgtctaaagagccagattgtaaattccttgggctttgcaagccattggcctctgttgtaactactcagctctcttatagtgctgaaacagacagataatacataaacaagtgggtgtggcagtgctccagaaaaacttcatttacaattagcagccagatttggactgacaccctggtttgccaatgcctactctattattgttgaaaatgtggcctgtgtattgaaatgtgaatattcacaataattgcacagttcagagtatgggatgtggtattaacttttagctgtttttcacaaaggatctggtggggtacaccattcccttcaggccagtctacttgcccctttgatgttctgctgattgtcccgtgtgtcctgaactattttgttcctcccctcaagtctgtcctggaatctgttaccttctttgcatgggtttctcagtctcttctaatgaaagtggccaaaattttcttcaagtacagagtctgtttagttgctcactagtgatttgcatccagttttcttcacaaatgcatgcacctcatcactgattgtcagcaaattgctgtcttggtgttgtatcgcagctctgcctgccctctgctctgatttcctgtccatgcttcagcctccctacagtagtgtgagaagttatat

SEQ ID NO: 132743 - DNA, 1061 bp, Homo sapiens
ttttttttttttgaagcaggttctcactctgttgcccgcccaggctggggtgcagtggcacaatcttggctcactgcaacccccgcctcctggggattcaagggattctcctgcctcagcctcccaagtagctgggactacaggcatgcgccaccacacccagctaatttttgtatttttaatagagacagggtttcaccgtgttggccaggctggtctcgaactccttgcctcaagtgatccacctgccttggcctcacaaagtgctgggattacagatgtgagccactgtgcctggccttgtcacgcttcttataaatggcaaatcccagattcaaactgaggcagccagagccaggagccgcctcagttggaaccactgcactctcctgctgaaggtctgttttacaactaaccgctaggaccctgtttccctcgtcctgcaccttcagctttccccttctttgctgcccccaccccctcaaccctgcccttaggctggagcttgtggagctctcactcctcagggccttttcctgtgccgatctgtctttgtagaataccgttctcctggttgcttggctaactccttcttcaggtctcagtccaaatcttaacgtcatttggagagtccttcctaacatatttgtccttgggccctaggtgttctgtcacatcatcctttattctccagatgctttgcctgcttccctccctggcagcatttatcaggttctgcaactgtattgtgctttctctttgtttatgtgtttgtctgcttctgcccagtggaatataaactcctcaagggtaggatcagggctttgtccttttcattgatacattcctaggtccagaacagcgtctggaacatagtaagtgcttagtaaatatttgacaaacgccttaatttgcttgccaactgtcgttgtttttcagaaatcagcttaaatttttcagcgttggctttcctgatcccaaatccaggtagatttattatagtacccccattattttccttggtacctataaaagccacctaaaatttggtaaactcagca

SEQ ID NO: 132744 - DNA, 1034 bp, Homo sapiens
aagctctgctgattcacttttagtgacatgagagtgtgagagtcctgctgtcagagaaatgccattatagcttttgatagctgagatagtgtaagtaggacccaggctttcacttttgaagccagaaatgggaggtttcccagtgcagctcttgacgttggcgcatgcaaagattctctcttgggctcagtgaaatttctagagcagtgtcacatcttcagtaaagagtatttaatgttccttttttgtctctgtttactttctgtttccatcttcttgacctgagattccattttgcctttgcttatacctcatggaggaatctgaaaataataccgagcaggaagcgttcttaaaaaatggaaaaaaaaaaatctgctgttccagcattattttttcatactatgctaatcatttttgaatacattgtacagatggtaggttgtattttagcggagggtttttttttcaagccaagttcatagacatgatcttgaatttgtaatgctgtattcctaagtgtcttttttggctgtcaaaatagtgctgtctttaaaaagtacaatgtagctactctgggtaaggctgattatttctgctttctttctttataaaaataagtattttctcttattaccaaagtaacatttactagagaatattgggggaataaaagcaaaaagagggacagtaaattggtttaagtaccaccctcaatatcagctacacccttttcttatccccaatcctctctttgctttggtcatacaatgagcactgtgatacaaattcattcagtttcatcttgactgtctttcactgagcccaagagagaatctttgcatgcgccaacgttaagagctgcactgggaaacctcccatttctggcttcaaaagtggcttcagaagtgaaagcctgggtcctacttacactatctcagctatcaaaagctataatggcatcagatacacaggggataacaatacctagcttggaggacgaattaatagagggcttaactgtgtgattttca

SEQ ID NO: 132745 - DNA, 1471 bp, Homo sapiens
ctcatcagcttcacgaactgaccacagaccaatcagtgaattcctgtcctgctttcactttgctttccgtgctatgtggaaataagagctctcctcatgggtccagtgtgaggaacagatagcaagcactgattgggtggaaccagccaaaggtagctatgaataatagtacaaaaataatttttattagggaaaggtgaagccgattagccctcaaatcctccatttctaagcatagactcttgttaaaggttgtacccattaatgtttatccccaccactgatccaccattgttacccagggttattctgatttaggtgccgcagaggaactggaatggataagtcagttcattgagcaaacccatgagacttatcatagtacccagagcttcaagctgcatgtagcctggtgttggtggtggggaaaagtccctgctgtgcgtcacatgaggtggtgacttaactgttaacctgaatcaccagtgtgaatacccagttaagtagtaaggcacagcccctgtgagagtaagtcctcatttcagtgatgagtccagagagtaagaatagcataaagatggcagaggacttcacagtggtataggggagcaagcatcactttactgggggagggtacaggggggtctttatcatcaccagcatcatcttgttcatgcaaaggtcattatctgataaagtggatggaagttccaaagaagaggacagggactgtaaactctgggctattctttattctgcaacattgattaaaagttgctgtgacaggctctgccctagggctccaggatacagtgaataacacagatgtggtgcctaccctcatgaaggttaccttccattcagggaagacaggcatgagtaagtaataaaaataattatagatttgataagggttttgaagggaacaaaaataagaggctgaggtagagaatcattggtgaagggtgagaggaagccatttttcaaagaatattagggcaggagatattgaaattgagacttgaatgagaaggtaacaacatagtaataaacatttgtgaaaaaggaaacatacaaaggccctaatgtgtttgaagaagtttgagaaaaatgatgtgacagttcatggttgtgttagggttacacagagaaatagaaccaataggagatacatatctatctagatatataccatatatataaaacatttttgtgtttttatgtataaaggactttattataaggaattggttcacacgattatggaggtgggcaaatctcaagatctgcaaggtgagtctgcaagctccagaccccggacagccaatggtgtattaataatatgagtccaaaggcttgagaagcatgagagcttgagacccagaaggagccaatgttcatgtctgaagggaggaaaaagtcaatgtcgtagttcaaaggcagtcaggcaggcggagtcaggcagaaggag

SEQ ID NO: 132746 - DNA, 1035 bp, Homo sapiens
cttcatttctagcacttaccacatattgtggaaataaagctttaggagatgcacaattaatgccctccttccctttgtgactttttagcaatatcttacaaatatgtactttgaatcaaataaagaagtattatataaaaactgcaataccagctgaactacattgcctggtaaaaatgcagggctggaaaatgtatttctaatgaatcaaaagcagctgtggcttcactggccagcatttgatcactttagagcgtgactcatgtaattggttttcttgctgtcatatgacagacatatcaacccaacattatattagaaagctgaaaaataaacagcctagatagggatgtctggagctaggaaagaagaatgcctgcagtttagcactggttgctcttttaaagtttgttccgcaaggtgtggccttgtgaagagaattatagtcaacgggaaagtgcgcagatgtcagtcattgttaaatcaaggatcttttacgagagatgttggcgagatttcaccactgatagtcctgttcacctgtgtgaacagaaagttgggcaggtataaaacaactgctttgtttttccaaaacttggcccattacagcatgaaattcacattggcgaagtgaaaaggattaagcctttttcagtagagcaggtatgaggggactttttacttggtaagaaaaactgttgtacaggaaatgaacatagttcacactccagtcacattttatgcagtcaggaactgggtgagcagagtatcatcccaggcatatacagtctgaagatcttttaaggttctacatagtttcctgtgatacagcagatatagtcaagaaagatttcccaggacccagttccctggcttgctggcaggtttcagataactgtgattggcctcatttggggactttgaggtatatagagacaaattcacgtaactagtgctgacaggttattttatcttcaattaggtggtggcatgcaccaagatcagattgttctacctgagttaaagatgttcctc

SEQ ID NO: 132747 - DNA, 1049 bp, Homo sapiens
caagtaggtagggaaaattcatgtatgaactgggtctctagtcctgatttttctcatcttccccatggatacttttatgtggctcatagtctgtagatacttttcacatcatggaaatttagcatctcacacaatcatcttgaagtgaaatctgtttgtgtttttaatccacacaggcagtttcccattataatgaagctttcacagttgagtaccactgatctcttgtgttcttgaaagtgattggtgatcaaaatcaccctttttgcaagcagctacctactattactctccacagagaataatgaatcactacacacagaaatattaagataccacttagagtattagaattttaaccacttcatgtggctgaggcacaggggccttttcagccccaacgctagttttctcaaaattggtcctgcggcccagctttgctcttatgctctcctgggcccaggctgcctcctgcagtgtggtgtgaaacttaactgtaatttgttgtgactgatccctaatgcaagtgttaacagtggctacttgccatgagtaggagagtgagagtaagtgttgtttatccagacaagaagtgataccaaaatgagactggaggtgtgattctaatttgcacctccgtttcatttgcccagaggaactacatttttttgtcattatttctgaatatatatagtgacaggggaaggcttaccaaatgcactgctaacagatgtggcaatcacacttctgtgtatcccctctttttgttcactcatgctttggttaaatcaccttgtgttttgaagaaaaaggcccttaccagaattgcctgaaatatcatccaggtaggaaacatagtaattatgccaaaaagcattgtgaaacatgctcattgtgctttactatgttgtaatatacatagaagcatataaaatacatggcattatataaaatatccatatgataggtggaatagtgtgtgtatgagtgtcagagagaggtaggaaagacagtaaaatatttcagacacttttaagtggcctattccg

SEQ ID NO: 132748 - DNA, 1041 bp, Homo sapiens
tgtttcttggttgagtttgaattctttacatccagactgatggttaactgtctaggcaagtgaattagaaattgtttgcaagctagaatgtgaataccagttaagtgtttctgcattattttgcatcatttcccctctctctattctcccttgggagggtgctaattgtgcccacctgaaagttctgcttttatctgcccagtttaaagaggcgcatgccttgtttgatatgtctagtatttgcctttggatttgtgttcaggaatatgtggcagggagaggcactaacctctttaccaggtgattggagggcaatattaacattataaatgttttatcagttaattttctttgattggatgagtcaacaactgggtgactagttgcgtccccacttaaacctctcattgttggagatatgtggaagcatcaaacacactcgagagcttgtcttcactgggagaatttagtctcaaacaacagagaagactgaatgaataacagagaatgtgaggaaatgcagtgacatagagggatgaatactgacttattttctcccatattagtccagtggactgtgtgcttctcggtaccaactgaggttaatgaaatttatgtaatagtctcatgaaaatggtccatggagcagtcgctcgtcgtacttatttgtatattaagttgactcacttattgcactctcatactgatggatgtttattaagccctcgaaggggccaatatctaaggtgtaggtatctctaagaagaggaaataaatggaagagaggggaaaaaattatgtgaagatacagttttcatctttagtatttttcttcagaatttgaagaagagttgtgaaaaatgagtaatatatgagtgaattcagtagtattggcctgttatggaaaatagttcattttttcatgtgtgagattgcaggatttaatgacgctcagtagctcagtagctgcttaagataataagtgagaaagacaagtagaaaagcatttgcaatactgaatggtgagtatgagtagatcag

SEQ ID NO: 132749 - DNA, 1340 bp, Homo sapiens
tttattggctcaaccagaaacagaaaccaagaacccacggctgtattcctctcccttggacacccccggcagagcgttaggaatgaaatggggggaaatgcgttaagatcagagtcctaattaactttgcaaatttatggtttgttccgcggggaaatattctttagaataacaaggtctgaatatcaaagatgagttaaggtggttaatgagaaggagaaacattgttatatctagaggagagctactcttgttagcagttcagaaagtattgttcttcctgctttctgtacatagcagaatatcagggtattatctttttcatctaagggaaaatttactgccaagggaaattgaagaaattctctgaaaaggagtccctgaatgagtagtcagctatccttgtcttcatccttataatcatcttctgtcataattatttgagacttcttgtctaaagggctttacttaacattttgatagagagcaaatacctgaggttctagccttggagcttaggattcccctcctgaatgttcagcaaacccgaatagcaaaggtactcctaaggaatcctctttggccagatggatcagggatacatttccaaaattagtgctgcacagagaattctctctcatggactaattcttctccccctctctgaggaccatctgtctcatgggcagaagaaaaataggcatctgttcagatttgcagggttgccacctggacctgttcctatagtgtttccaagcagagggttgggatgtctgtgggccaacccaaggccttaagtactaggatcttcagtgaggaattacagcatcaagacaaaataattttgacctagaaccaggttttgcagagcaagaattagtgaatgctccaccattctagaccagggattggcaaaatttttctgtaaagagccaggtaatattttaagctttgcggaccatatgatctctatacaactacccagctcttccactgtagcacaaaagcagcagtagataatatttaaatgagttattgtggctgtgttccagtaaaactttatttacaaaaaaagtggctggcaggaattggcctgcaggccgtagtttgctgaccctttctctggattacaagaactcaatctgtataggagattttcccatccaaggatttggattcatgcgatgcagttgacaaggctgctgttgtgaagtctgcaccctttggttttgtaagtttggtttaagatagtttagccctgcacctacacagtgttcagtctctattcgcagttgtagtgatttagcagtaacgttatcaacgcaagatgacaccaaaag

SEQ ID NO: 132750 - DNA, 1040 bp, Homo sapiens
tgcgcctttactttcactcccccgtcatcctttctaagctgactccagcaggaagctgtgtggagctgagcaccacctggatgaagtgtgttaatagttaggttctgatctaatgatattcagtaacccatatcttcagagtttaattttcttagggaaaaaaaaatgaatgccctgcttatttgaacattaattattcttttcagtggattgatcctacttactgtaaagctttgttgatcttttggcttatgtcaccatgtaatgtttatgtgattaatttttgtttgcatgaaaaggaggttttacttaccacaagaacatttttaacctctttgctctagagacatttggagttcgatggaagtatcctgtgtgaatacctgtggttttgatagtgattgtcgcagggtgggttttcttctttctggaggccaactttgcttttatgatgacctattatccctgcgtgtctggctctgtctagtcatatgtatggatctgttcttcctgtctggtccacccaggcttgggaagtaacttgtcaaccctgccctcagagcctgcttgagagggttggcaaactctactggtcctgctgtgaatctctcaggcttgcgagggacgacagatggttgagctaaactgggagccacccctctacgtaatgatgaaaaatgaccagcctcctggtaagtggaaatcaggaccatgcaccttttaattctaataaacaggactttgaaacaaacagagtgaagaaggaagaggaaacccttccataagtaacctgtctttgttagtactctttgtacttattagtaggaaagatcttcacgtatgtatatactattgtatccatgtagtcactacacatagactgctgggactgaaaagtaatcccgtgtgcccttttggatataaacaatctctgtaaaagccaaaaaatgtgaggcagattacaaacatggatgcagaattgctttctgtactacatgagcagcatggggcccactgttcttatggctccttccataggt

SEQ ID NO: 132751 - DNA, 1059 bp, Homo sapiens
tctggaactcactcctgtgataacggcattaattcattcatgagggcagagctgtcaatgcctaatcactccctaatgggtctacctattatattgtcacaatggcaattgagtttcaacatgagatttggaggggacattcaaactgtagcagatcctttgcaaccaattctggttacttttactaagggctggaggtggagtctacagtagttccacatttatttgttaaaagttactctgcaaaggactatggttgatggaaaaaactgttctgtggttactagaggtgaaaatctgtgtagagagaaataggccagaggaataatatgcgaactgtttccagttaaccatttaatgggttggctaggggctttactgtctttgtccatggaaaagaaaaaacaaattgcacatctctgcttttctaaatgctacttctttctaagaattttgataacttccatcatttctctagccaagtacagccaacacatatcagaacccggcggttgacatggccatttcgtttttccttttaaaattgatttagggcagttcttgagcagccaaggcttggccacctcctactttgccttaaggtgtttttatgtgtttatacgctgagagcacgggtacctttgaggggttgcaaacagttcggttgatcagtgtggtcaggaagtactggccctcaccgttgtaagactgctaaatctgtaagactgaggaaacaggaggatttggatattggatgagtttcaataggtatgtttgtgttcttgtcaaaatgaaaattcttttgagttgatacgtattcttgtttgtgttgtaaagtcttaatatagcagtggcacaggaaaaataccccaaaagtaagtttttctaaaggatctttttcctgtaatgtttaaaccattatttatcttctctggatggcatcaagtacttggtatgtcttaatagaagggaaaaaagttgcttcattacttgtggtgggtgcaatccttagcaaactctactttttagaattttgggtaaagcctgggtatgtgaagt

SEQ ID NO: 132752 - DNA, 1080 bp, Homo sapiens
cacagacctctatgtaccaagctattatttagaaactgagtagtatcatatgagtgaaataatacctaaaagtattcaaatacattttacagtagcacttgctatctaaattgacgtgcataaacatgaaggatatggacttgcctgaaataaaatgtgcagtatttcacacagtgttccaactacttaccaccatatcaccttcaacatgacataatcttggttgccaaagtagattgctaataaattattatagtacatagaataagacctggactctgttctcaaggtcttgttgttctaattatggcccatggatcagcagcattgatgtcttttggaaatttgtaagaaatgcaaacttactttataatagcttctacccctaaacgactgagccataatctgcatcttaacagaagtcccaggttgatccattcgcatatttaagtttgagaagaagtgatgtaaggcagtgtttcttgaacttgagcattcttaagattgacccagagggcttgttgaaacatgtatacatagattcctgggcccaaaaagtgatttcataggcctggggtatgtgcattgggagttgtcttttccctggacatcttgcagctttggttggatgtcttccagggctgggatattccaagtgtcgtttaggtggttgaactcaattagtttaagattgtgtcttagtccattttgtgctgctataactgagtaccacagactgggcaacttctttttaaattttattttaagctctgggatacatatccaggatatacaggtttgttacacaggtaaacgtgtcccacgatgatttgctgtacctatctaagcccagcatgcattagctatttttcctgatactctccctccccctacacaggccccagtgtgtgttgttcccctccctgtgtatatttgttcacattgctcagctcccacttacaagtgagaatgtgcaatgtttagttttctgttcctgcattaatttgttgtggataatgccttccagttccatccttgtccctacaaaggatatgatctcattcctttttatggctgcat

SEQ ID NO: 132753 - DNA, 1044 bp, Homo sapiens
tttcatggtgtactccttttgagaatgctcctcgtcctgttgaatgcatgcttcagaaacaacccgcccatctgcggattttcttgcagacatgatgagaccagcagccattctcagggtgactcactctttggaatgaaacacagttggcaaggtagttttgttatctggattgcgggtttttaattgcagtgtggcaaaggtgcagcagctggccatgagaatgggggagggaggtcatgacccataaatctatgtaggcatccaaaagatgcagtgcttcattccttggaccttgaagaaaaaaagcagcccatcaggaagtaccattgagcaccttgttgaaagaaaatccccgtacttttacatccatgttgtagatcatctatttctttaaaaatgttttgttatgccttaggtgtagtagtaattataagaaataatgcagattttcacaccaagaaaaaaaaaacctgggtgactatcagaaaggttaagcagatattactagaaatgctgaagcagaaattgcagttgttactttatgaaatgttctttagtagaaatttcatctcttgagaatggttgctgcagtgtgttttctgtatgtagagaactatatgttgaatgtattctgtttttcaggggttactcttaaagaagtacctgtgttctattcatacattgcataaagaagtcctctttgcttaagtaaactgctacttatgttttctgtcttaagatggcctgaggaccagatgataagccaagcattcggtctttcctacataaagggtggtaagaacttttcataaatttagtctgaaacttatcctcatcctaataatgaaaatttattttattttttgctgaaatagtagtacattttaaaagttgtgcttcccaagctcgtttatgtcatgagtgcctgtcctgagggggaacctttatctccacacacgtacaaccacttctaggccaagcagcacaccagggcttatgtgtgggaagctctgatttaaatagtttacttttttaaaattt

SEQ ID NO: 132754 - DNA, 5479 bp, Homo sapiens
ttgtttcctacctggcctttgaaaactgagtaggacgacacttcctgtagcgtaatttgaatacagcatccagatcaggatctgaactcttggctttgttgcacactggagtgatggatttttcttttttccttctctagacctcagctgagcacatttgagaaatgggagggttagcttgggttgtccataaggttttttctacctgtaattatacctccttgattctaaaagatgaaagcccttcaaagttgggaaatgaaaggaaaatgtatagaattctgtaacctgcagagtttgagtatcaatgccataatttactagccctgtggtcttgagcaagccacttaaaccctgtgtgccttaggtatctgcaggcaccaacagagttgtgaaaatcaaaagtagtataaagaacatgtagctatacattgatcactttgaagctacctgatgagaaccctaaagttaactatcccagagctttcgcacttcctctctgaaaggtatcctcagatgaccgtcactgtgtcccatgtactgacccttgtagagagaaaccattcattggaagaactgtcctgtggcagtcggtgcccattagcttaaaaacgtaaaaagacccagcattctgagtcttcacatataatcagtgtacagatatcccctcggaagatggcagtaatgagcccaactttcttgaacatcaaggggaaaaattaaaaactgaagtttgctaaatgtgtgttttgcaggttggacaatctgctcaatatggcttatggagtaaagaggtaatgatagaggttcatgatactcataatccctttccacagttgattggtttctttgattttgggagtgctattcacacccctcataagtttttgttgggttttattttgcatgtgcaacctaatgaaaagctgctctttgaagcacaattgactcaagaaatttttataccaccggatgccacctggtcttttaaaaacccatcatttgtttcgtattgcgttacgacgttacagcatgtttacgtatgtgttgatcccttcccctgccaatcctgcttaattcatgaagccagttctaaatatatttctttgctattgtggatgatattcagtacagtgaataatggtcatttcataacttattaatatctcagtagtctagcatgtcactgcaaagccacacacagaccttggtcaaaacatgaaatagtttatatatttgttgggggaggagagttactaaaattcttggggatggaaaaggtatacgttcattgctataaccaacctctgtttttattttttgtgtgtatgtgtgtatttcctattctgtttagcaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaagaacagtgtggtgagtaggtctttatacacaattcgggggcacctgtgctcagtctaataagcagacttgctttcttgaattaaaagaagttccctgagagttttagtggaaagcagtgttacctcttagaattccaaaaggcaagttaattgaagtagaacgtgcagaaaatttttggactgaatgacaccttctgattagttttcaaatactgctaaatgagtaattctcacaggagaacatactctcatctgctagttgtaaagtttgggaaatcggatatcgacaccattttatggctgggattcaaccttcagctttttgcacagataatcacccttacacgtcagttaaaaaccaaacaggaggaaagtagcttactcggcttccactggcaatctttaattccctcatgggattaagtgttgctgtgtgaaagttacttttttgcacaaatgctagattgtcaagagattgttccctaaaatcagaaattcagtttctgttaagttagtgttgttgtgtgtcacacacgttacaaaccatgaactctgccaaccccgtatttcgcatagaagttcagttcttgtatacacccttaacagatctgtgaaggttaaaaggatttcctgctgatcttttgtgaaaggattctacttctatagaacttcagacaaatgagtataataatgaaacactttttttttaaacaaagtatactaaatgacttattttaattttattgtatctgtcggcttttttggtaaaagccattctaaaagtaattgtcttgaattcacaacctactagtcaagagcgtagttgagtgacaagacacttccttttttcaacatgcaattagtcttaaatctccatactccctcttcttattatatgaatttaatactctaattttgtgatgttggaacatcctcccctcacctctctcctcttgcatgttttatcggtattttgattggtttgcatgtcagcagttcttttataattgagcagatagtggaaaaattctcagcaaaggaagttggtatagtaactactggtatatttgaggagaaatttcgtctttctcccttttttttttttttttttttaacctgtgcttggaaattatctgaacaatattgaaattcagttttagagcggcctacgtgaaattcttaatgttaacatcattttacattattataatctgagaaaaaaatgttagcaatttaaccattctgtttttttaagataaacagattgcaagatttctactttttataagaggtttacaaatgaattgtagtggaaactgacaactgcttgcttacagcgtt

SEQ ID NO: 132755 - DNA, 1741 bp, Homo sapiens
gcagtggacagacccagcagacatatttctaggggcttgttgtagtagtccttgtgtttgagctgctgcactattttctcttacaactgcctgtgttacagtttgccaactgctactggatttggagtgaatggtgcccatgtagagcacccgttgccttttctgagctcccatgggaaacatgaatctatggcaccgagaaagctaggaaatacttctgggctcagatgcatacagtcagggggcttcagcagtgcctgggcactgttttctaggttccatgcttctccctacactcgttggtgatggaggagaagaaagattagagtggataacttggcttagttccaaaggaccaatttttttctaaaatgagagagaagtgaaggaatcagtgaagatcatggtatcatgtaaaacttcacagatagggtaaaaaagatgccctatcataatttggagggtcctcggagatcctgttataaaaaattcgaaacctcctgtctggggatgccagagatggaagtgagggagatggaggatggaaaacgaaatgtttctccctcactgcatgtacagtcatgcatcacataacgtttcagttaatcacatgtacgaccgtggtaccataatatagtagactgcaaaaaattcctattgtctagtgatatcatagtcatcctaatattgtgcaatgcattaccttttctatgtttagatatggttaaatacacaatacttagcattgtgttagaattacctacagtattcagtacagtgacatgttatacaggtttgtagactgggagccatagcccataccatataactaggtgtgtggtaggctattaccatctaggtttgtataagtgcattctatgatcgtacaacaacgagatcacctagtgacacattttcagaacatatccccattgttaaaaaaggcctgacggtaattcacttcaggggcagatttggtttctaccctgtttgaaaattctgaaaactcatctgtctctgggccgtatgcttggtgtcctgagtgggtggtagcaaagcatgacctgtccctacatggatgcaattaatgggcatagatgatgtaacttttgagtgaattgataaggtgcctctgcattctgggtcttctagcactttggttggagacctcagtatgcggttctcttctacaggtagcatatgccaaatgcattctgtgttgatcattccagcaatttgataaaattgtattgttactttatgattggtggtgctaatatgtgtttgtctttattgctggtagttgtgatccttattcttgactataaaggcatggcatctttgactgtactcacctctgcaaaaaataaaaccccacatctttttacttatgtgcagacaaggtcatccaaccaatcctcttactagttttcattctggactaagttgaccataattttggtaacctcattgtctttatttggtcatcacatatttattataaactatcagtgaccctggcttgtgctcagtggtgcaatgagagggtggtgggtcaaggcacgcacacacacacacgcaccacgcacacagagacacactcacacacgaagatcttttgtcattgtgatctgttctgtttccttacactttgcataagctcagttcttctcatctttacaaaacagaattttcagtggagactgagggcagggatgtgggaggctatatatttccccat

SEQ ID NO: 132756 - DNA, 1223 bp, Homo sapiens
agttatgttttctagcttaaatctatgcatttatttttttcattggaatatttgcagtgctgaagagagtggagataaaatcagttaaaaatagctccttttaaaaaaatactaaattatgttgcttgagatatgagaaggaaatttgttatgaatgccacattaaatttcaacttaagttggcctttgccgtgggagaagaggtggtactgtcaaaagcattgagccttgtacttcatgctctgctgtgaggaaaaggcattggtattaaaaaaaaaaaaaaaaaaaaaaaaaaaaaaaaaaaaaaaacctttgccacctttgacttcccatggtagtggtgatcagactagtgtgggagatgcgtggggctgcctgatgcttgcctttgtggagaaagaagtctcacaaagaaagccctttttcagctctgcacataggtttcctctgtgacatcttaagtgaataatatatgtataaatatacttttttaaattgcaaacgtaggatgaacaagcctgaaggaattttacaggtatttcctaggcagcttgtccagttaatttcagagctctttggggccttgaaaatgatctcgagtttagatagaacaaagttcttcataatgtattggttgatttttaacattgtgaagttataaaatgtttgctgttagtggaaagctatattagctactttttttttccagattgaagcaatgattttgtttgatagttattaagtaaaacaaagttcttggaatcaagattgaattcttaggaagattgagaagacaggatttgggagagtgcctgattattgaaatggcaaggcttgtaggtgactcaggtgctaggttgttgatgggtgtcagcccttaggtttacctagcctccatccctgcaggctctgtgctttttatttttggttgagtaaagctttacaggatgttcttatggtcaaatttaattatctttttctggcccattctgtgtttttatcttttagtaccatatgttatcattaacttgaaaattctttttccttcactcctatagaaagacattttggaagaagagaataagagattgtcagttgtaagggaaacttggtttcagaaaatgggagaaattgttattctctcttcagatttttaactgttgtcccattcaccccatttctcattcctcccatgatccctgtccagataataaaatatgaac

SEQ ID NO: 132757 - DNA, 1027 bp, Homo sapiens
gctactaaactgaaagagaatactcaggtttactgtccagtacttttattgacaggatctctggtttgcttttgtcagtgttgttggttttattactattaatttttcatctccatgggcacagagagaatctacttgaggaatagtgtcttttgctaatattgaaggtggggaccaaaggacagtaacctacagcagtgattcttaaccaagggtgatttttgcctcccagggaacatttggcaatgtctagaggtattcatgttggcacaacctgtgggggtgctactagcatgtaatgctagaggtcggggatgctgctaagctcctacagtgtacagcatagccccagcaaccagaagttacctggtccaaagcaccaataatgctgtggttgagaaattctaatctgtagctttctggggttatctgaattgtttccagggcttcagatttccttttttttttttcttaaaggattttattctcatgtgtcaatttttaggtcaagctgtttctgttacttcactttatagtatgtgcaccattaagggtatataacctatgtgactacgtgaagtttctacaaatgagttcctctcttccttttcaaaattgtttacaaacaggttggcagactttctctgtacagtaccagatagtaaatatttaactttatgggttatggtcactgttgcatctgtcttgtttttgtttttaaacaacctgttaaaaatgtaaaagccattcttagcttatagcccatacagcaacaggtgggaggcagtctccatttggcctgtcggttgtaatttactgacctctctgtagttcatagaatgaccgtggctttagcccaaagaagacactctatctcactgacaggtgtacatatgctaactgtttaagttttattctgatcctgggataacaaaccaggagtcattcaaaaaatctctaatctgcatgtgagaagaacagtgactttaagaagttaagcagagcagagagtttttggtttcataag

SEQ ID NO: 132758 - DNA, 1116 bp, Homo sapiens
cctgtaatcccaggtactcaggaggctgaggcaggagaatcacttgaaccccagaggcggaggtcacggtgagctgagatcatgccattgcactccagcctgggcaatgggcaacaagagcaaaactccatttcaaaaaataagtaaaaaataaaatgaaagcaatacttgttctttaggaaacagttaaaaaatagagaaacattgtgaggaggaaatattagctgtagtaccatagactgaagcagccacatgaagatttgtgaggttgtttttgtttgtttttttaaggtagcttttctcctcactgtttgtttctctccccgccacccgtataataataataccttggaggcatgttgtatattacaatgtctaattcttttaaagcagtgacttcagaagaaaattgagccagatttttcattcatcaagtgaagatccatttagttgatctgaatctaatcagaggagcccatattacctgcctctgtgttgttaattggcttcataggaagcaccacctttagagttctgagtagagagagctagcactacatgcatgcctgggagaatagcctacagattttgctgtcatgagactatttagtcaagtgagagtatataaaatacagcctccttaattgtgttagttaattcataatacttatacattgccaccctgtgttgttatcacatagactaataatggtgttaaatagaaatccaggcctagaaataaagatgaatttgttcaaagcaacaaaaatattttttatttcatttgtgctttctaattcattcattctgagatcttgtgaattgagagtaggtttcacctatgacacaaagtgcgtctcatcttttacctgctagtccatcacaggtggacctagcttgttttagtcagcggttctcaagtatgtcccgcacctgcagtatcagcagtcttctggaaccctgctaaaaatgcaaattattgggcttcattcagaacctactgaataaatctctgagggtgagccacaggttgttcttaggtatgcttaagtaggaggaccaccgatttaggtgactctagctgtgtagaggctgttttttttttttttttttttt

SEQ ID NO: 132759 - DNA, 1050 bp, Homo sapiens
agtcacatgatctggaacagagtaacagctgacttgttgggtgctccctcctgtggaaaaaaaagccatagaatcctagatagggatgcacgtcccagctggtgaggtttcaccttttctggataattgagaatcttacacgagaaaagaaattaagttttcattgattcatattactgaatgcatatataattcattggccttgtttcatcagtttatagcaatcccaagatttgattccatctaagttacattaatcacttgaaattggccacttgttcttcacttacatttaagttccccagtcttcattgttcttaagtatttaggcatagagaaaacaaatagcgtatgaatagttatgtatgttttctccaccactattccaaattccttgtttcttctgtagaacaggacagtgctaatataacttccaaacatagcctttggaacaacaggtatattttcacttgttaatgagcaaacggtttgaataaagaagagtattaaatgttaacaccattggggcaggggtgtgaaagataacgaggtctttataaagtagtataaaatgtggcttatatttttttctggaaagccaagaaaaagtggcaacagagagctgtgggcacaattcaaattatggggaaaatgtttggtgcttcatactaaaagttatttaagtattagtgtaaattgggaaagtttgttgttaactggattaaaggtgggtaccaataataaaatgagcaggcagtagttatcactttacctcagcaaatcaatcccagacacattgaccatttttagtaataatctgaggatggcgtatattgtgaaatttctgtcccttgaagtaggctagtccagaatattacagctaaaccaaagggaatgcgatcaggaatagctcatgagactaaatgttggcaaagataggttataggcagagagtcatcaattacaattggggcaggagatctggatgacttgaactgacccttaaatgctctggttcagtaagccgttgtggatctgcatgatcaatgg

SEQ ID NO: 132760 - DNA, 1045 bp, Homo sapiens
aaatggcattgcttactcctgagaattagaaagtaacaaaaattaatttaaaaattctaatgatgatgtgtagtttctttggttaattgtaattagtggccacttctcttttcttagaaaaaattactcttaaaaatattaatggagccgggcgtggtggctcatgcctgtaatcccagcactttgggaggccgaggtgggctgatcacctgaggtcaggcattcgagaccaggctgaccaacatggtgaaaccctgtctctaaaaaatacaaaaaaagccagtgtggtggtacatgcctgtaatcccagctacttggaaggctgaggcaggagaatagcttgaacccgggaggcagaggttacagtgagccgagatcacccactgcactccagcctgagcaacagagtgagactccgtctcaaaataataaaaagtggaataacttttaactaatttctagcaacatcctgttttctgtctgtggccagtttctctgtgtatgcctttaagaaacagccaggattcatttaatttttcccaactcagaacaagtgaactgaaacactcacttaccatagtattattgaaggaaaactggatgaggagaccaggacacagaaagagaaagatcagagtttgaacccagaattcaacactagttgtgtataaccttaggcatgttatttaccttgtctgtgcctgtttccccagctataaaatactaatatgtatgctgcctacctcatggggttgttgtgaggcacagacaaaatattgtagtttgtgaaaatgccttgtaaatggtgaagtctcataatgccctaaatgtaagtttaacattaaacattgttaccgacgtaagtttatatataatctaatcactcctgtcctgcctgtggtagtggaaaatggttctttgacaatgtcactgaaagatactgtttttgagaaggtttgtcttggagcctttttaatgtggctgggaactaaagatacaatataaactgaagagtggacattggggaaaaaaaaaatcacataac

SEQ ID NO: 132761 - DNA, 1029 bp, Homo sapiens
cccccttcttctgtgtactatacttctgagctcattttggaaggtccgatgtagccacctgtccaaatatccatgatgctgtcacaagacctttgctactgcttacttagagcctagagctaacttttattgagttatagtgtcatttttcagatagtcccacgaagactccatctttaaaaaatatgaacagcaattaactgtccgtttaaataggcataactgtgacctttcagctggagagattgaaaggagctttttgaaaaaagtctaaagtggcaagtgtctaattttcaggtttaatgtttgtagtcctgggtcagtaattgacaagtgataaaagttgttcagtggtgatcttagcagtgggtgacttctcaaatgtttttagtttaaaaaagagggaacttctttgttcatttatagaccttatcactttaatctattggtattaatgtccactgtcactgatctttccattgatgaatcagagaaacgagagcagttgtgtgtttggacgaaagcatttagagggacttctgatagtgatgcactgggattttaaacattgctatgtacatttaataaagtactaattcataagatggttttgtttctttgtataattttgatcaacttgtgtttgatagcccactcttagtgtatgtgttactcatctttgtatgtttaatgtatcattagttttagctgctgatgaagaaatgagcttttaattacaagtaatacactatatttcaaacggttccattttcaagacataattcaataaatatattctatctttattttgtctagtctagtcttgtttgtgaagaacagtttgagaagccatgggccatttacttacctgtagtagcaagtacttactgcctccccgtccctccccttccctcatataatctcagtattgcttgtctttgtttattatatcactcgtagcttttgtgagaaattccagaataaacctgagttttaaattgctatctttggagtagattggtgttcagt

SEQ ID NO: 132762 - DNA, 1091 bp, Homo sapiens
aatggaaaatcccgtgatgaagagctaagaccgcgagtcctacacccaactctttttctttgtgtctttggaaaagttgcttcacctttctgtgcctcagtcttcctatttcccagatacaaagaaattggactaaatgatcactgtattttctttttgctccaaaattaagactccccccgccccacagcctcctatcagcaccatattactttgttgaagattgtgtcgcctctggggacttgaatccccaatttgagaaatgaaatttcatttttgaaatgattaatagaattttcattgtagtctgtacacaaagtaccaatgcgtataatgttgggtatatgacaaagattgtggcttctgttagcttttaaacagtatttcagaaataaactctcaatttaatatgtgattataaatcatcttcattacagtgagtgtgtggtagttaccaggatgtacaaagtaggatgatgacaaggtttcttatttcaaggggttaagtcagtcacaagaaagggttaagagataagtacattttggttaagtcagtatttaagaaaacaaggcatataatgcagtgtgggtgcaggtaagaggcacccaactcagactgtagtggagaggactgattagtgttgactttagggactaggtgatacccatgaggtgtctgaaatgactgaaatttagctgattggaaggagggcagcttatttttaacacagagaagtgagagcaggaagcttggaatactaccgaaggttttgtatacttgtatggaagaggtagccagtgctctgaccataaaggaataagaattctaaaatttatctgaaagtcttagggagccctttaggtaatttaagttgaggatgacattatcaaatatattccgtggtatctctgaacttctcacttgaattaaagcaattgtttagtcttaaaacattcaacaaatccagtcacgataaaatttaaggttctgtgtgtattttccactgatagttttctaaatcctatattttggaatatccgttaaagataactgccctaacctttaataccttttataaaatttcctgttt

SEQ ID NO: 132763 - DNA, 1106 bp, Homo sapiens
aaacccctcttccttccctacccagtgtcttgatatttgagctttctagccagggcctcaataaatgggaatttgctctattataagagcttccacacattttatgctataattttttaaaggaaaaaattttttgctatatgcaaacttaatttagaaacccttttgacctgtaaaccaaatgttgccccaaagctatgtgaaagcagtgcatactcttgccaaaaggcttacagtgttttccccctgctcagagttgcaaaaatgaattaataagaaaccaaggatttttcttcatgttcttcattaagcaatgtctgaggggaattgtaaaatatgcattgtctacagtatatgtatatcctggtgcacaaagtcagatgaactgtgaaggtgaggggtaaaaacacccctctcacctttgtactttgttctttggagtattaaagaacatttatctgccaagtggcaaaggggatactatttggcggtttaattacagccagtgagtgttattgatgctatcagtcagcaagacccagggaaagggcctggtaccaaatcattcagtgtaattaaatatctcaggacgggattctcaaggtgcttctggagatctgaagcaggagaacactttgtcttagaacaaagataaaggtggtagttcccctcctcgctgcccctctttaaatttctgcaggtgttgcatagatggcaatgatatggtctctttattgcgtacagtgaaggttgtccatgttttccttaaaaactctttcttttaaaatcttcacaactgtcacacaaagggttttgggaatacagtaattattttttgttaaagctgttagggggaatatacagctcaggtgtctaatagatacttggagaatgaaggattgtctttgaatgagactattagtcttgcaaatcagttcatttaaaaaaagctttccctatggttattctctaatgtctaatcatgttgtgagagaaatatcttggtagacttaaagtcataaaacaacactcactaatgtttcaggggttatccccttatgtattgaataaatttttcatagttgcataacttatgtcagccccac

SEQ ID NO: 132764 - DNA, 1081 bp, Homo sapiens
tttctagttttggttgttaaatgtctatctagaaatttgtgcttgccttaaccaaataaccatattcatattcctagaaagagtcattgagagaagctcctaacttcatagaatcaagcacagtggcctttttgaagaggctaacccagttgagccacatccagccagtctgggttcttggaaatatctttggatgagtttcatgggctttattttacgtctgcatttttgcatttgcaggtgatttatattcctaaatgctttgctttcaagctacctggcatttgtcttatttagaaactaacgatcagtggatggcaaggaaaagggcttggcatccgtggttgttatgagctatctaggaaaccctaatatgcccagagttttgaggattatttcaaatgcctttacacaagagactgccaacactttaatgtttatcaggatcagtggggtggggtggttgattaaaaatgcagatttctacaccccaaccaggacttactgaatctgattatctgcagagagagactgaggaaattgtatttcaacagccaccacaggtgattcttaagcagatggtggcctgacctgagaaacactgttcagtggatcttaatgatttgcacttgggtaggtctgtggtgcttattttaaaacaagtctacttgtaaaaaataggattttcatttgtcggttacatcaagatatgttgaatggctgggattcactaatgtgtttttaatgaatatagtgctggatttacctaagaaataatgcacgttctcacacacaatttgctcattttcagggcatttgtgtgtcattaaatacttcaacattacaattatgctagcataatttatttgcttctgagggtatttggagaattttcagtatggttctttagggcctatccatttaaaatgggtgtcttggccaggcacagtggttcatacctgtaatcccagcactttgggaggctgaggtgggcagtcagaagttcaggatcagcttggccgccaacatgacgaaaccccatctctactaaaaagtacaaaaattagccgaacatggtggc

SEQ ID NO: 132765 - DNA, 1154 bp, Homo sapiens
gaatatgtgtagacttcctccctcctctgcataaagaactctggataggtgattatcacataacacagtgaaatggatacgtggctcccagcatctctctcagcttttccctcctctacaatgggcctaggatgctttatttttcctgaaactggggttgatttatctggaaagaaggagctgttatctcagggaatagaatgttttattgttattggtaagttctgacccctcaaaagaaaaaaaaattctgtctagaattaactaccatagaaaaactgcccgattttggtcttgattaaagaaatattttccttaatcattcagctatagaccaggctaaaatttacctttgcttaaaagttattaattggtatacaatcatgaaatttcttatactgaaataaaccacaatttaaccacatttggaaaattctattataaaaatgagaatattataaatagtattatctattttttgtgttcagtttgagagtgattaagcaaacctaagaaacctgtattctaagctactgtattgccattaactttttgttaaatttatacctttttctaactagcttatcctttcctcattagtaaatgtcatatttatacttttttttttctgttcagcatgagcttgacccttaacataggaatatagaactacatttctgaaatcttactctgtctaaattaccttactaaaatgatttaactggctgcttaatcttggacagagcttttaaccatttaagtttccatttatatcgttaaaataatttattcatcactgagaattttcattacctgctttttaggagaggaaaaaaagcttttcatggtctgctaagttgcatattaagaagaaatgttaactttttaaacaaattcatgtttattgcataaaatgatttgatgaaaagcagcaacctctcctgaagagagaataattttaattgccttcttctttcactcttgaaagtttaatagccactgtaaactttatatggggatttgagtttctagttcaacctccttttgcgacaggattattgggattgggttggtttttctttatcattataatttgttcttttataaaagttaatactggccagaaggaaatattcttagatgctgtgtaaacc

SEQ ID NO: 132766 - DNA, 1036 bp, Homo sapiens
attcacagctttaagaatgttttggaagttgagttaagccttttcatttcctgggatactattccataaataagtctttttccctcgtctaatctatactggtgatggctgtcagcaccactttcttacacagcaccactttactcgtgttactgctcactcaaaactctatggtgtttctctactgttttaccctatcatctggctgagttttgtaggagtgatgccagtgctattgccgttctccactgttctcagactggctctttacttgtaagctgatcttactcccagcgtccatgcatatgcttttgcagctccgactttttggtataccctttcacactcatttttagtttaactgtggtcatctcatcttttggagcccatctaaaggaattctgtccttcagcttctgtctttccaggttgttccagctcctgctgagttcccccttctttgaagtctatattctttacccttgaggaaccacagaagttttggaattacagggggacccatatgtaatttaggcttaagcactgttctctgtccacagtcagagtggagatcttggtggtcatacaatttagccaagaccaggcagttgaagaaagagctgcgactcaaacaaatccttgtcttctgatcgttatatcaaaactcttgccaggacactgtgctttactttagaaaggtacagaagattggttagtatatacaagtgtttgtgtactccaagccacttagaatttagtatgcgtttggtaaaattcctggttattgggatattgaaacagtgaatcaagtgctgtgaaaggtggtttatttagcagtttctcctggggctccctaatagcattagctcagtagggttttgtgcagtagttggtgtgttgaataaatgacagatgttcagtatttccatggtgagtgaagtgaagtccctcaggctctgtgaggacctaaagcatttgttcccaaactttggttgcatcttaatcccaagggaagtgagttagaaatacagtttctg

SEQ ID NO: 132767 - DNA, 1045 bp, Homo sapiens
cgacattattgtacttggtaaaggctgtaaatatgtcagggtacaatttactgaacactgacagattcttggttgatgttttctgtcttcccatttttatggctaaggaaactgaagctgaaaaggtattgcctgttaagccctctccatagcacagagatttatccccacagtttatgaagctgaccttgtcttgctgatggtatactctggctcaggcagggcatggatggtggaatcctttggggatgtgtgttttttttttcctaaacagcactgcttgctgagttctaaaacttgaaaatgtagtagacaggagacataaagacttcatgtatatttctagaattaatagagagttctttttactgttgaggaaatatgctggtgttaatgacaagaccatatgccaaaatgaaagttgatctctgtcaacagtatagaactaatatatgcctttttccccttccttttcattagggcagagcttgggatatggctttgtgaactacattgaccccaaggatgcagagaaagctatcaacaccctgaatggattgagacttcaaaccaaaacaataaaagtatgtttaaagtttttttatatctacttgcggaacagaagtttaaaaaaattaagatttatttgtagttctttcctttcttccttttgggcccatataaacagttacctgggagacatagtggaattttggtgtttgttgcaagatggaagaaactgtttgttcaagagtgctatgtataatcattcatgtattcgcaaagggggacagagcaacaactctcttagataaatgttataggaagcctacggaatcaagtctccttcccttatagagaattacttgccctataacttgaggaaaccttagacttgttcttctataaaggtctgggtagtgaataagcaaggttttgcgagccatgcattctgtcacaacttctcaactctgcctttatagtatgaaagcagtaatagccactacataaacaaatggatgcagccgttatccaataaaacttt

SEQ ID NO: 132768 - DNA, 1020 bp, Homo sapiens
aataggtaacttgaagattttagaagaaacacatccacgtgtacctaaacaacgcaactgtgaaacagcagtcatccctgcaagacctttcttagacctcccagcagccccgttgtagccccagctaggttctcaccattaaggcagtgatttctcaacatggtggttgtacgttagtcaccaggattttaaaaagctagtaccaatgcttcatgacagactgataaaatcagagcccaaggtgggaggatcgcttgagtccaggagttcaagcatggcccagccaatgtagtgagatctcatctcatatacacatatatatacagacacaaacacacatatatgtatatatatctatctatttttgggagtgggattcggggatcaggtttttttgttttagttttttttttttttttttttaagctttctagatgattccattgcagtcaagtttgagaatgcactggggttagaagctgctaagatgcaggaggaggagtatctatcagtagaaagggcaattagactatgctgatacaattgatttattttgtcatagaatagcagtatgacaaaactatatttgtattgcccttttctttttctgttatatttgtggcatcttttttatttaactttaaatgaatatacttaaaatctttaacagtaagcatgttattttttctcatgttatcttttgactagggtgacgatccactttcatcattaatgaatattttcatcattgcatcagcaacctagttgggtaggaattaccctcgttttagagagaaggaagctgtggttcagagaggtgttaagtagcttcttcaaagttgcacagctaactgcgagccagtaaacaccagagccggtattggaagtctgtctttccactataagctggttccttgagcagattttgttacattcagccaatttaattctactcaatgacaataggactgcaacacattttcataagaggggcacaatgcatgcagtaaacacatgata

SEQ ID NO: 132769 - DNA, 1021 bp, Homo sapiens
gcagtttgtctgctgtaaaccttcacatgggccagtcttgcttccaggatggggggtcggtttgcttacctctacatagatgccttacgttcagcgtagtatgcttttggcttgtctcttttatacttctttacaaatttgttcttctccatgttcctattaccttaatttgtttgtcaggaaacacctgaatttcatcttctctgttttgacacactaaagagttctctttttcaagctggtcctggttaagcctgaaacccctgcgatgcactttatgtatttcatgttcattaggtgcctgcctctctcccttgtttactgtgttgggcttaaaatttttgagcatcttagagggcagagaccatgtggtattgatcccatcttttttccaccgctatgaaatcatgctatgcgtatgaaagcattttaatgcaatctgctgaggagagaaatgtcttgtgtgggagaccgttttggcagtagcaaacatgtttggctttagccataagaactgctttctgagtttggaaaaggagtatgtaaatcaaggcccattttaaatggatctttttataatgcagatacctctcatctatctgttttgtaatgatggatttgttttgggggcttaagtggtttgtgcacctgcaggatgtccttccttttctttcaggtcattttttttttctttcacagatagtctcttggatggattaagaaagaattgaagttccagtcaatttatttcatgacaaagaacaagaaaaaaatacagatgtatttggagattataaatattctgattggaaagttgtaaactttggatgtacaggattctgccacaaagtaatttccacacatggccaaaggcaacaaagtgtacacttttgaaagactgagtttggaaaggttgattgtagtgtggaaacccagctgctcctttgagctagctgtgtgtgcccttgagcaagttaacttagcatctttgaacctccaactttatgtccgtaaaatggat

SEQ ID NO: 132770 - DNA, 1051 bp, Homo sapiens
tcattcggcaggataatgcgtttactataccatgctgatgtggatggtgccacattacttttgtgtcctaatgaatcattgtctaggtaaaatctttttagcaaaatcttcctcaaagtatccgtgaattttaaatttggaggattacaatagctaatcacttcaacttttggatgaggtgatttgggaagaaatgcttatgtgtgatatgaatgtggcaatcgtaggagctgcaccattttgtacttctctttaggagccatctgttaattggtgggcaagttgccctgtggtctcagagtggtttgctgtagcataagctgtccctgagcaaaaacaaaattgatacttatttctgtcagggtacctctttgacttaattcgtagccatggttcccatctgacccatagcctttacaactttaaccatgtacagctcaatttcctctggggactgtgttccattaggattccttttctttattgcttcagagagagtgttcttgaggtttgtgaagctgtgtctgtagtatttaaataggtttcctttatactcagcatttatacccccaccagcccaaacaccatcagtctgttttggaatttttcctaagcatgtaaaaatcagtgctgtgtgtgactattttaagtttagaggaaagaaagaaaaatgttcctcctaccctcttgattaactacctcttcattaactataaactaagcaacatgtcctgtacaaagagaagaaaaatcacgttatttatacttaatccttgtgtcgactggggacgatggatgtcctttggaaatttacttcctttgtctttgctaaaaatacctctaatttaattctgctctttctttttgatataaaaggaattacagtggacattttccccccggtggaagggttgtacatatcggtctatagcagatactttatgatcagtacacataaggtgaaatatgtttttattgaaacacctgatcatgtgatgctacccaatattcccttcttaatgactcagcttccctccctctttcactcctt

SEQ ID NO: 132771 - DNA, 1045 bp, Homo sapiens
gggagacagatgctgatgtatgttgaagctagagaggcaggtggtttgtggcctatttctgcctttgcattatttcagattctgttactgagtagaacagtcctttttttaaaaaaaaaaatttaggtcttatatcttggcctcctgccttctctgttggcatcagccaaatgcatgttggctgcaagtacatcattccacacttagtgactggatttattttcagacgttggctattgacaactgaaaagcaatttcctgtgttggggcttaacagaaagcctcccctgggttgtaagagtttaaaataatgaaaaaggtgaatacttcatgggtaagtcttaatgcaagctttgtgtagacttatccccactgcctactttgcactcatgtttgtagggagtttccaaaagcctctgattgagatgaggaaggtcttctacctctggagctgtaaggtcttgtcttgattaaagatgactcaagcttaaccagttgttcagtagtctttgtctgagctttgggtgtgctggagaatatcagccagtgttaagttcttgatttcaagtggtgactatctgttgaagagagcctgtgccatgaaataccgtagtcctcccattatcaacagtttcgctttctgcagtttagttaactggtggtcaaccatagtgttaaaatattaaatggaaaatcccagaaataaacaatccataagttttgagttgctcaccattcagagtatcgtgattaaattttgcaccttcctgcccaggatgtgaatcatccctttgtccacattatccatggctggtacatgttccctgtcctttaatcacttagaatccatcttaacagatcggaaaaaaaaaagtagtgtatattatgttggattcagtactatctgtggtttcagttatccactgagggtcttgtaacccccaaggataaggtagggggtggaggactactgtactcggctagtggaacttcttgtggtatacctcatggttcaagggaggtagagaaggagggaattgtcata

SEQ ID NO: 132772 - DNA, 1037 bp, Homo sapiens
agttttatttcctcacattttaatgctttaaatccagtcttaaggagttgcctccaagggtactgtcgtacgaatcctttttcctaaccctggtactaagtaagccatgggagcttttttcattccatttaaatgaattgtagtttgctcttattctactttaaatgtatctaaacattttgaatataaatgagagactgatggtgtatcaaatcaattgacatcttctcatgtagacaagggctctcctaaatgacttcccaaatcctgcctctaaaattgtcttttttttcttttgtgaacctgagtattaggttagctctttttaaacatggtgccaagtgattttgccattatatggtgcagacagtgtactaccttctcaagtagaatgatttgggatctaatatcttaaaatctaacaatgttataccaggtttgtttttagacctttatattctttattatttgttgtcctttttttatgggggtaagcccttttatacatattggaataggattaaaatacagaattgttaataccgatttgttactgtgttttatatcaatatgtgtatttttttaagtgctggaaattgggagcctttgcaaaaaggcgtgataacattccattatatccccagctctagaacatacaaagctagtcctgatgtgctacttaaaagtagaatatggaatcttctggggttagtttcttactctatttgatattttagttctctgaatgcttatagaaaacaatatatttggatatagccatcaaagtaaggaggatgtctaatattctttcctagcctttatagttggacaaccgacttttaaagagtcttttttttttttttccttttttaagacagtacccttggaggccactgtgttcatgaccagtgactccttgagactgggtttattaaatggacctgttagtatagtgaataacagctcttaggtaattttgcgtagttgttagtaggcaccaaaggaggaagggtgagcgttagttgctctatagatta

SEQ ID NO: 132773 - DNA, 1029 bp, Homo sapiens
cagcctagccactcaatttgtgttgtgtcctgtgtgtgctttttgactctgaacgtcagtttctttcataaagtacctagcacacaggggtactgtctctctttcctgtcctcttcttaccagttaatacccattcagttacgtgacagttgcagacttttgtttttccccccataggtaaaaagtagtttttgaaaaacatcttgaagtagatctgttgtcctagatttcttggagtttgtcatgatgtgggaagaatgcaaagctcatcctccatcctttgctttctaggtgatttgaccaacataattgattttccaggggtggaacaaagtaagaatagaaagtgcgaggcaggacttgggagcccagaatgatgattaatgatattacaccagcctttatgaactagagcaccggagtgtggaattattgctctatgtggtattgtgtgaatgtttcagaatgaattagcttgacttaaaatatgaaggtgctctcaagtgagctttccagtgagctattactgggctttcgaaggtcagcaagttgttaaattgagccatgaagtgttggttagataaaaaccaactgcggcttatttttacttttattgacatcatcttccttaagatgagtatccgtttaatataaaacgtaaatactatactaaatagtctcattttatcaaagatgatgttcaagtctagatatacagagacctgtgttttgggatgttcaaaaacctaatattcctgcagtgttagcagatcagaaggctgaggaaaaaaattactatccctttgttttcttttccattgaaatattcattgaaaacatctaaagcatttcttcattcagtcatcacagactttacagatttcagtttgtgtgtatgggggagggggcagtttccatgagggtatggttaacttagcagatgcaattttacatcttgttttccttttttgttaaatccttatgcatattgtgaattagagtttatttttagctcttaatgagttcttt

SEQ ID NO: 132774 - DNA, 1043 bp, Homo sapiens
cttctcttaatgtctttctgatattttggggaaagagtgcttttatgcaaaccaatcacttaggaattgcatgatgactttttcccactataaaatttcattcacatttcctcccttctcccacatccttaagagataagacagcctgcagtattttgctttattttactttattttttaaatttttgaggtgtggtttacattagttcttcagaatagatgccaagataactagttaatactgttttaaaatcaggctcttaattaaaaatgcttatatttgtgcaagaaaactacatgttgaaatgaatttggaaagattagattggaattgcctcaatttcaattaagccacactgcatggacgtgctgggaatatcaatacaatcactgtaaattttgtacaaactgatttgttgcattatcttgctcatctaacatacggtactttttgtgtccatattgcagacggcaactccaaactaacatggcagtcagactgtgtgatgtggcttctctgcttagaagtggttcgtgggcagcagagccttggaccggggtctgtgggatttttcttaaattctgtaggctacttttttttagcatgttggaggagtgctgaggccataccaaacacttgaatctttcatttggcatactaattattcttacatttaacctattgtggtatggccatcattaggacttaaagcacattgcaattttaactgtagtggtgtatgtagcatcagaaccatgctctcgtatgtaatttttttacaatctaaattaggatttagcgcagactcaaaagagtgacaagcttttttaaaaaaacaaaaaaagttttggtatggtctgaatactaagttaccgtaattctatacattctgtttactatgtatttttttggttactaaattttgaagttatttacaattctttatgctccaaaaaaaaagttgaaattgtaaatctggctgaaaattatttgcccagtaactgttgaaagagtttgcattctgtgaacagttgtgttgagc

SEQ ID NO: 132775 - DNA, 1030 bp, Homo sapiens
agtggttttcttggtatgggatggaacgtacgctaattgtcttcaggctaaatcttagttcatggttgcagctctttaaaatggcttaagctcttgcatggttttttgttttggtttggtttcttttcgtttgtttgtttgttttttggagacagtcttgctctgtcacccagtctggagtgtggtggcaggatcttggctcattgcaacctctgcctcccagattcaagtgattctcctgcctcagcctcctgagtagctgggattacaggtgtgcactaccacacgcctgtaatttttttttttgtatttttaattttttgtatttttaatttttgtatttttagtagagctggggtttcaccatgttggccaggctggtcttgcatgtttttgagaatgctaagactctgcgttaagcactatgctagcctctgagcaaatgcttacgatgtactttgattttgaatttttcaggaatagctatagcgtgtgattcttaaattgccaactaaaacatcaccgtctgctgttcagtaataaaagtgttttgacttggttatctgcttggacatttttatgttaaagaaacttcttggtcgggcatggtggctcacgcctgtaattctagcactttgagaggctgaggtgggaggatcctttgaacctaggagtttgagaccagcctgagcaacatggcaaaacctcgtctccacaaaagattttaaaaaattagccaggcgcggtggctcacgcctgtaatcccagcactttgggaggccgaggcgggcggctcacgaggtcaggagatcgagaccatcctgactaacacgctgaaaccccgtctctactaaaaatacaaaaaattagccgggcgtggtggcggttgccggctactcaggaggctgaggcaggagaatggtgtgaacccgggaggcagagtttgcggtgagcagagaatcccgccactgcactccagcctgggttgcagagcaagactccatctcaaaaaacaaacaaaaaaagattt

SEQ ID NO: 132776 - DNA, 1021 bp, Homo sapiens
ttatttgaacctatgacaacagagagcctagtgcacatggcttttctctgttctgagcctgatttttttttttcatctgtcatccagatacaatctctccttctcacacttaccagattgcgtcctgtgttgtggttctgcatgtgttcccttctttgcttagacagtaagtgggaactccttatctgagtcatcttggttatccagcacagtgccctgcacataggatttgcatgttagaatgaatgcagatgtctgtccttcaaatgtgttgatatttgaggcatatctgttttcttctgtgtccttttagtggtgactaaagccttatttgaaagctccatctccaagaattcctgatgcctttattcaataatgaacctcgttgttttcaggttagtgcatggccactttgtagttgtgcagaattgtaccagtttttcatgctctctgaagttacatgtttttcttcagtttaactttcggttttccttggagttactccatttaagtggcttcagactgtgagctgagtgagatcttgctgtcttccagtcttggcaccttgaatatttacttttgtttacaagctagtttctctttggctgtttttaatttggaggactaaagtgtaacaaatgaggtaaggataattctgcttattaatgtcttatctggaagtatgatgacttcacgcctccggagagtagagtttggctacctttcacaggtattggagtaaattccaggtatgcttattgcccttttgagataagagtttgttggatgcatagaaaatgaagtgggctctcactctagccaaatagttaccagttagtatcttgggatatctgcagactcagctgagctctcaaatgggagaggggatgaaggcacaatgagcaactgagatgggaagctgggattggaaagagaagaggctatcaaagaaatttgtcttccttcctggtttcacttcagctcacttcttgtgccccggggtctccatccttagctatgc

SEQ ID NO: 132777 - DNA, 1729 bp, Homo sapiens
acatgttaattttgggagatacacttcagttctctaacaggggtaagggtatttaatttctcgaggcatgaacagaaatgattcttttcccctgaatttctgatctacagttttagtttttcattccagaagggaaatgctttctcatctttacgattggtcaagactccttgctcccacccctgcgattagcatttgccgttttcaacctggagatttcttttccatttaccctgtctgtacagtagtttgtgaccacctctgccttttaaagttgagttttgacaattgatatacaattgatttcttctctaacctcttcagttttatagtttgacctcttgttacaaactgcttttaaaggcaccatgcttatgctttaaaagccacttaaacagaacatatatttagaagacaggatgtttttgccacagatgtcaagagggtcttggcagtgttttcacagaatgtctgctggtgtctgtgcagctctgagactctaggcactctgtacttagagaacatgtagaggttaagtgttcatcaggagacctgcgatgtttgtgttggaaatactaagagatgtgaggtttaggatgttttgtgttgtgttgctctgtgtgctcgtccagagcagacatcctcaagtcagaacttaatgaggtatgcggaaaatcaccaggggaaccgtaatatataaaacataaaattaaagctctgggatgaatggctaatgcctagttacattagatagtcagtttatagttatttgctccagcctaatttggctgtctattcaaggtaatcagcagagagtcaaacctttaactttttcttgagggactgcagtgagccttttagctttctttacgttgagctttatggtgacagatgagatgaaggatactatttcacttccttcaagtttttagtgtggcctcattatatttgaaagtgaattcccagagcagccgatatgcctgtaactaatcctaagtagaaaatctattccaaagcagaaaatatattttggctttacctgtgcagtcacagactgggaaagcgggtattggggtgtctaataatgtggatttaaatggtttggttagaatatctactctcctttcatccaaccaggcatttccatatatttttgtattccctctctttttttctaccacagaagtttaatttcaagattttctgtctcatctctctctggtattcattacacctgttacatctgttttgtttccagtacaaaacagcactcggacctgcctcttttacattggtcctctaaccaaagaatgatttaggagaaaatttgtcatttgttgaaaggttgttttttttttttccccttttttaccatcaacctgtcattttgtgtatcttaatggattattcaagcatttatagccctttgaaaactttggtttcaggcattagaaattaatgtaatttaggaacatggttaccccttaccttacctctgagtgtcctacctgtatacattcaggaaagggtttaaaaagcatagaacacttaaaaacttcaaatatgttttctcatttataagtgacatttagtaaagtcttgaaagatataagaagctaactgttttgcaaccatactgttttcctctgggctgtctttaagaatgtttatttacttttctggggaagggagatatgtgatagcttgtataatacgatacattatttag

SEQ ID NO: 132778 - DNA, 1130 bp, Homo sapiens
cagtcctattttttgagacattttatatatcaatgactatggacgtagtattttccagtacttacaatgttgttttccccatttattttttatttttatttttttgagatggagtcttgctctgtctcgctcaggctggacagcagtggcgtgatctcggctcactgcagcctccgcctcccaggttcaagcgattctcctgtcacagcctcgcgagtagctgggactacagccatgtaccaccacacgaagctaattttgtatttttagtagagatgggattttaccatgttggccacgctgttctcgaactcctgacctcaggtgacccacccacctcagcctcccaaagtgctgggattacaggcatgagccaccacgcccaacattttctccatttcttaaatagacactggcaggatcttaggttcttagggaatcttatataaaatataaacaaactacccacttaattataatgagcctgtggtctataaagataaggacttaatttttcaaagttgttgactttgaaaatattgcttagaaatgtgttttttaatgtctgaagagcagtaatattattttactcctttagtttgttttgatagcagttgatcaaaagctattataaggcatgtatacagatgttttgtaggtgtgcataagataaaataaggtgggaaatttggttaaagaagtgttcatcttctttagctttagttaaattttatttttctaggagctgtatatacctaatttgtatggtcctggctctctacttattattaaaacaagagaagatggaaggattaatgcatactctgccatattttatctgtattccattggtcaggaaatcttcccagattgtagggagcattgccaagtggttggtgtactggatctgaaaagattagactggtttccccacacaaattttttcatgattttcctaaacattaaggattgatttgtacaagctttgtgtaattttaataattagtctggtttgactaatgtagttatttgatgtaaaaatggttgatactttggaattctcaaattctaggaatgtttaaaactgaatgtatcttattcagccttgaatttgaaaaatgggggctgtc

SEQ ID NO: 132779 - DNA, 1198 bp, Homo sapiens
aagcagttttttaagataatgaatttaattacacgtgtgcctgggaaccattttaaaccatcgagaagggaaaaatggacaaggcctattggaaatggaaagtgttcacctaggtgtatagcttttagcttgtggttttgaaggataggaacagaaaaatctgactcctccctcgtctcccttcccacacacaccccctacaaaggcagaatccatattctgatactttatatgaaatgttacagtaacatttatcagatgtcaaagggtatggcatagaagtggttgtgtcagcataatttgaaggctgcttctctgtgccaggcactgttctcagcagtctacatggattcactcacttgagttcttacaaaactctgagatgtaggtggtataattatctccccacccccgccattttataggtaaggaaatggcacgtagagtgatttaagttacaggcccaaagatgcagtaaatgacagagctggaattagaactcacgcagtctggcttcagagtgcacagtaacatctatactggaattctctctgcccaggtgttagaactaaattatttaatcaaataaagggtcctgttttgctgttgcgacctttttgcactaatattatgaactgtctcctcagataaataaccttgcagaatttaggcacatttgagttagaatcttgtaagagacagttaaaggacagctttggctctgtcatcctgcctgaaggtttcagtggctccctattgcttacagaacagatttcaaacactttcaggcattcagagttctcccttctttgccggatgcaatgtttacttcatgaactagccaaataactttttctcttgatcatgacccatgaattcttatcccatactttttttttcttttcttttctttttttttcttttgagacagagtttcactcttgttgcgcaagctggagtgcaatggcgtgatttcagcttaccgcaacctccgcttcccaggttcaagagattctcctgcctcagccacccgagtagctcggattacaggcatgcgccaccacgcccacctaattttgtatttttagcagaggcggggttttctccatgttggtcagattggtctcaaactccagacctcagatgatccacctgcctcagcctcccaaagtactgggattacaggcgtaagccacca

SEQ ID NO: 132780 - DNA, 1974 bp, Homo sapiens
aatttctttgagtttaaaagaaataaagcagcagttaagttttaaatgttattttaaaacatattgagcctatttccagtaatgtttttgtattttgttctaggctcttaatatttatttcatacttcagtattcctgggtgcgtgtacctacttccaaacagaaagttttgagaaatagtctggagggcttctgtgtctgttaggtagctccaaattgaaataaaatataaaaatggaagacgaaggacagttgctgtacagttcacaattagccttaatttgtagatctctgctgggcccagctgtaaagtttattggtataaaatgtgttcttgatctggaaagccctcaaataaggtgccttgctttccaacaagcaggaaggaaatgttaatgccagttttcctgtggcttctgtttaatgtgaataggatcctctgaggagatttaaaaagcggctcattgcccttgaaggcacccgtatcagatgaagatagatctaaattcgtatttgaataaaaaatttcatacgtcatctgttttcccaaactaaatttaaagtttagttttaaacttttactgtaagttattttaagtaagtcaaattttctaattttgtagattcatttgcttgagaagcattctatactgattctctactccccaaaaccaagtaatctgaagtagttttccaaagttggggataatgacctatgttctttgaaagaattcttaaaatttccatctgatatcttaagcatatagggctgtagtgcatttcacttcatccttgaataagagggaagggggctaggctggacatgttctgcagcttgtgaggtccttctcctcatgtaagcatggtgccatttgctcattctggcttagtagagctgctcttgggcactaccatcccgggttgtgaagggtgcacttaggcccctgcatgagcagataccctgggttacacatttggtgttaaaataagctgagaagaggaataggaactctactgttttaggacttgattgttacacctccagttcagaatttggggtccctattcaaagtcactccacctatccaagccttcgatgtctgacctacagaatgggaataatgaaaggttgattgtgatgctttatggtgaagccctcattattagctactttcttttctcatttttgaattgggattctttggaagaccaaagaaaacttgccttaatgaggttattttaggagaaatattggactttaaggcttttgtttctttaatgctttgtttctctaatactcttcaaatcttgcatagggaaagattaggtctgtcccctgcacccacccacagagtccttggacagctgtgtttaaaagtgagggcttggtttaggtttgctgggagacctcttaaagcttttgggaaaggaaagagaatgggaaactacaaagggcttaagatttttcttttcagtggtaaatagagccctttcagggttttctaattcttaatagatttcttgcccaactgtggtctcttatttggtgtgttaggtctgtaaagaagcttagtctagcaggaagcaccttgggtgtggtaaggcaattaggggctctcaatagaagatgcactggtgacctgcatgtctttcaaactagggtgttggctgctgggagtagcaagagttactattgagcatcagtgacaaagaattaatcttattaagttggaaatggggctggatattgtaattagatgtgagagacccagtgatcagacttgaggattgtaggccctcaaaactctgcttttccccactcacgtggtggggtggagtaagagtacaaaatcttgttttttatggagggacatctaggttctagtccaggtttcaccctgagtgccttaggaaaatactcacttttcaggtcctgggtttcttatctcttaaaatgcgggatgggaaacaagg

SEQ ID NO: 132781 - DNA, 1025 bp, Homo sapiens
tgttaacctctcaggtgtagatttgaagaaattaaatatttctgtcttttattgcttgaacccaggaggtggaggttgctgtgagccgagatcatgccattgcactcctgcctgggcgacagagcgagacgccgtctcaaaaaaaaaataaataaataaataaataataaatccatcttttaaacagttctgtggttatctttttgcatcaaatatatattttttaatttgcacaaattattataatagaattactaattacttcaaaagctgatcccccttgggcttttcagagcattttaatagatttgcacttttcctacatatgagctgtttgttagcattcagtgcctgccttgagctgagcgttgtgcatggtcgttgggtgctcagaaacactaggatgtggatgccactctcaagttctccaagtctggttgacagtccagaggaagaaaacgtgagtttatgggagtttggtgaggtctgctgcaaacattgggaaaaggttcctgaaaccaggtagatgtagtagcacttgtgaagctcttttatacagatagggggacttgtccccccaccccacccgcaaccccccaggagaagaggattaagtgtggtgtactcctagcatgtaaggaaaaagttttgattattggaacatgggtgggtttctagaggacactgaaatccatacaggaacatttctcttattttgtttgagagagccagccttgggacaattttacaggatggcttagtgtgaggaaaactgaagcaaaagacatgggctgatgtggctaaaggggccttgaggaggaacgcaccagggctttgagaggaagatggagcatgcatggcttcctgactagggtgtaaacccccaaatgaaagtgaaaaactgcttctggcatgctttgtattgtgtaggagagactcataagatactcaagcatttttctaaaccagtgtaagtatgcaacatgaaacatgtaatagcttgttatgctttataaagcatcttt

SEQ ID NO: 132782 - DNA, 1227 bp, Homo sapiens
ataacttacatatttaaccaattggagttaataaaaattgttaatatttaaactatagcaaacatttctatgttttttagatatcactactatatgatggtaattaagtgctggatactgaataatattttaagatgactttattaaagtgctatttcttttcatccatacctgtgaataattaagaatttatggtatctgtttgcagtctagttggtgagtttaatttacttggaccacccagaaaaaaatatacaatgatgcttctgtaaccactttgactaagctgaaactatgctttttacatgtatttatgacctgttaataccgcttcaaagtgtgctgtattgaaaagatattggctgcttcaaggttggactgaaatgactgtgtttgccaggaataaggaggggtctccatggatgaccactgggccagtcatttaatagccatgtggaaccctcttcggctatcagaagaatgttttctgctctacactgagtatctttggaagcagatagagaagttgaggtctaaggtagatgctctaatcatggatggctaactttaagaagcgttattgggccaggttctcctgtggtatatgccaagctcatgctcgtgcatgggtacacacacaagcccaaggtacagtagcagctccatctgttttgtatgttgtaggcctgccttgacatagaactgttcgttctaaagcaactcattttaaagctgcagtatgttaaatgggcaacccttcattgaagaccttgggtatgttggcagtttatcagcagcagggttgtgatcctgtcacttcttgttaatgaaggcttttatttagcttagcaaatcatatctcttgttagtatccactctctcaaatggtagacttgaaagggatgtttgtaccgttttatttattagtagccatgagggtgctttggcccttacttgttatagccatttagccatatttcttttacggagatgtggtttgttttaaactaggaaaatccccaaatgattaacgtctttcttttgtttatcatttttgaaatggctttttatatttcctattaggtggtctttttcttcagtctcaatttcacttccattttgaaattcctagcaggggtttgtcagagcatttatgttcccagtgttgcagctgactttcccagcatttatttgttgtccttgggtagtccaagaggataagcattc

SEQ ID NO: 132783 - DNA, 1119 bp, Homo sapiens
ggaaaagacacggaaaaaaggttaaggaaaatgaggaagtgaattttccatctggctagtttcctcattcacacagatcaccagacctaaacagtacagtgaatgcatggcaaggatatgatattttaaaatagtgtctttctgaccaccttattagattattaagcttacttgactaggctcttagtttcctcagagaggtggactctggcaaacagttttatttttaatataagctggtctttaggaagataataaaaactttgcatgccttttagcttataccatttataattgtttgatttaacatggatatagcatttttttgtaggtggatattatttcatcacagcttttagatttcagccccttttccttaggtgcagaaggaagctactgaaaatatagacagtaacctctactcttgatggaatttggagagaagtaaaccaagttttagttcaggagaggagaattttaattttacttctggcattacagggacagcaggtatgagagttaaggagctgttacggaatgggcacttggggtaacaacttcccattgcctttggtgtctggtctctccttaatagctttttatattggtttaaattttcagggcacaacttaaatgttactttcaactacattggaagctctttgatgtcagtgattcttataactttgttttctgaatatagtgggtcttattgtcttattactgatttttttttttaagagatttagtctcactgcagtggcatgatcatagttaactgtaactttgaattcctgggcttttagggatcctccagcatcagcctcctgagtagttgggtctataggcatgctttactgcaactggctaatttttaaatttttttgtagagatggggtctcaccatcttacccaggcttgtcttgaaatcctgggctcaagggatccttctgctttggacttccaaagtgctgggattacagacctgagccacctcacctggctagtctgatttcttgaatctaataggtcctatgtctttaaaatgaagattaaaattatatatgctgaaggtaaatgttacatgcaagtttttttcttttaattgtgtattcggcc

SEQ ID NO: 132784 - DNA, 1394 bp, Homo sapiens
gcaggtgcctctggtataaaattggccaacaggctatgcacaaagcagtcaggtgggatcctgacaaggctgctccgtactggttagctgtaatttagaatatcacaggatgaagcagaagttaattgttgagggtgaaagctcaatagcattttactcatcatcacattttataggacatagtaaccttaaactttgaccttaatacgtatcatttctctttaatttttgttgtgtttccttaaatttggcgaagactaccagagattttgttgggtaaaatgctttgtagctccccagttccctatggaattcagaagcattaagagatccagggactttgttaagttttgggtgttatagttcagactccttaaggaattttctggaactttacccataaggaatttttcattatggctaacatttctttctctctctcattccctgtgattattctctgttatcgtctcaaagaaatgtggcaatttgatgacagtttattaaatagcctatgaatatttgaaatgtttacatctaaagtttttattagtagccactttaaaactttaaacttatctctcttttcctagcatttaacattttattattttattgtgtctggcctcctgacatgaatggcattttgctctttttgattgtccttctattcagtttttgatttgctgatccagccttttctgccccccagtactttaaaagcaattattttgccagtttacatgtgaacatttcttggtttcctgtgcagattttcatttgtttagtaaatatttgtgatcttgctatatgccacatatactaccttaggtattaagactatagtagtgaatacagtatactccctgctgatatgaaacttagagtttattggaggagatattatgttaaagttctacaaattattacatataattgtgatttgtgctgtgaaggaaaataacctttaaggcttataacacagtgtgggaggtgattagtgaagatcatttgttgatttccttcctagctaccttatttttactgtacataaaaacagactagtttttaattttataggcataaggatagacagaggtcctaaaattaaactctattctccttgataaattgatggtgaactttgagtcctagagctgattcctgccacccagcttctatcccaccatggatctggctttttatattttttacgagaaaccgattttaatgttctttgcaggacaacgtaatttggcaacttttactctgaaagctatgtggtgaatgcaaagcccagcagtgagatctgcattgtctaaatcctttattctctttacccatggctttgaaaatgtgttggattttgaaatattatcagtatttgtttaaat

SEQ ID NO: 132785 - DNA, 1773 bp, Homo sapiens
tagaaaatgtcagtgtggagccttccttttggtgactttaagcacttacatttctagttaacttttgttcagcctggtaaatagatatgaagatctgttgtatcaacccagcattaatgtagcttcttaggatggaacaatgcccataaaaccctgctctcctggcagccacttcagctaggccagttataacgatgaatcagaatgtgcccctgtattgaacatcttagcaaaacccttcagaataatagcttaatgttggcagttttaagcattggcttactctacaacccagccaattttttttttttttttgatatttggagtgttagtataagtgtatgctcacttaaaaacttaattttgaattaactgtgtatgattttaaaaaatcattgtaggtacatttggaacttatttttcagaggcacttaaaaattcttggtaccaagcatcttctattctatgattatatgattcttttaggtgaacgtgttgcttgtttttgatgctccctgcagcatctcattgcggcacctcagggtggcttagttactgggttggggtggggaattgaatatcagtaaaaacaagcatgttttatccccctaaagattgggagtcattcccgtggagcttctactgtgcaataagaatgactttgatatatgtgggctgctagttaacttgaagcttagggcttttccaaattaatctaattttgtttttgagtttgttgaaggatcaataaaaatattcttctaggttttgtgttgagattatgttcagaagccaggaagattgtgtaatacttattgtttcatcacaaattactgagtgctggatactgagaacgttgagacttgtataaagtgccctttacctcatattccttggtctctacctaaggagatgaggcagaaaatgataacttaaaaaaaaatcacacactccccactcttgcatttaatagtagaaactgagtgcttgaggaattaagcaaagagatatatccctgttgtctgggaatcaagggatcaggccaggttgttgcttattgctttagggacaggactgtgtcttttcttggtccattttgtctattttttgctttttatgtcttatttccctcccccgttcctcccatattgtttttgttacctttgattttcttttatggtatgagtaactatttcctagtttgccaggagctcagtcacaggtgaaaagtatttctgcaaaacctactcaagtttgagggtgtggctagagagagacaagctgtgactgtcttaattccactgttgtcccagaagagtagatctgaggcacgttgtgtttcaaactacatgaagctgggtgtttcccccagagttttattctgttgacaacattatgtgccagcagcctcctctgggtataacatttatttttcaaaacacctaggaaaaagtcaaaataattacaacttttttgacttcctcccttttgggaatatagttgcaggagcaagaagcaagtaacaggacagaagctggggtgcttttcagagcattgatctatgccttctccttgcgtcatcttcatggctaaggccatgtcttccaggagcatgtgttgtctgggctgctgactatggctttctcatgccagtgcttggtgttctgaggcctggccactgcttttctcccttaatggcatttgcattactgtttcgtgggtttttttttttttccttgaaaggtgatcgaacagcttgtacgctgcgttacc

SEQ ID NO: 132786 - DNA, 1045 bp, Homo sapiens
aattcaaaatatagtttctcctaaacgtgtgttacttttatatcaccatacagttgaaaaatcgtaagtttgaaccatcataaattggggaccatctgtagtgatagatttaatccttgggtttttcctttgacttaaaaagtttatcatgaaagggaaatttatattctaaatgttcttttcttccagcattttgtttttgtgggttgttcattattggagattatttcagcaactttaaagactatgttaataggatatcacaaaaatcttttataaatatcaaagcaataaactattccttcaagatggatttttatcccctttttttttttttttttttttttttttttactgaaagcttttagtacacactttcttgactaatttcatctctttatgggactagggaatgatagttgttttgagattcttagctttcctgcatttctttagagtcattgtaaaattggaagttcttgttaatattgaggggctagaatctctttaagcatttgaagaaagctgtagctgtctcttcctagagaaatatatacaaataagaaatttccatacagtttttagtattttgcactttggaagaaagcgtgttaaaatgaggttccatttgggaaataggactttggcaattagagttgtcttcttatactagtgagaactgggtgaagtcattcagaggttcttgtctgctgttgagttagtgatgtgggcctttagcattctttgaaggatgactgactctaagctttcctgtctcatagtttgttttaaaatccattctgtttttgtaaacaaataatcacacacataaggtcttgtgatcaccgtgcccgtgcggccaatttgctgagttgtctcagtaggttttgtcacttaggttgaaattcttaatttagcacagccaggtggaaaatagtaggctagaagtctgaagttttcagcatctggtttggtttaattacttatatccttggtttcttaacctttgattgtgtataaaatcttaccctccccatctcaagga

SEQ ID NO: 132787 - DNA, 1471 bp, Homo sapiens
gcttgtaaccggtatggttgcacatcctacccaatcttgaaattcttaagaatttttggacaaggttaccctgcattttcatcttgcactgggacccacagattacgtagcttttcctggttagttgccttcccacttgttagtatttagctgtcagtattgctgctttgttgatatattatagaactgtttgaaggctttatgtctagtgatgccacacctgactatcaaattcactatggaggacataaaatgcataaaattttttcttgctttggccattttcattttacaggtgtagaagtcttcaccggttctggttacgcacagagcccacatattgtagttcagtgccaaatccacacttttgtatgttctaatttgggaagaacatttattgtatatttatttggttcgagatactagacggtttatagtgctagttaattatttaaggatttcacataacgtaaatttgccaagtggaaacagaagacacttaagcttgaaaggcagtgcttattttaaggcttttacatattaaaagataagtgttttattatgatttaaatgataacttttggagtctgaattaaaagtcaaagtttgcgtaataaaatcttagatttttgtggggtacttaggacatttttcactagtaaatttaacagatttggctttcagcttgtgtgatgtgtatcatatgtttcattttagtaaggctagaagaattttttatttcaagggaagaattttttttatctctaagcttgtattccattgtgcaaaacaaaacaaaaggtaactcttgtgtgagcaacgctgtgctaaatgcattctcatagacatcttcatctttaatatcaatgttaagtttctagagattggtcttaataaaaataactatttttgcaacgagcattcttttctcagagctttgagttaggctctcaatgcgtgaactgaattgatatgcttaatgacatggtacctttttgaatattgctgaatagttctgtgtgacaacagatacaggttttcgttgtaagaaatctttatgaagagaaggatgggggctttgaggagtaaaataggtaaaataacccagaaagtcataagaataggtggaatggggataaaactaaaccagtttatagaatgccttacagtgtcttttttttaaataaacttgcagtttcttagtatatatttatattactgatatctattacatcagtttctgactgaaaatgaataggagataaggtctgacatgcaaaatcccctttcccacttttaaaaatgtattttaaaaaacttgacaaatttaaaattatacttactgtaagacagtaacagtaaaatgataggtttttttttttaagacacagtgaaggttttgctttagcactggtatattttgaaccaggtatgttatctacagtttgatgtacctgtatatttttccgtt

SEQ ID NO: 132788 - DNA, 1020 bp, Homo sapiens
catgcctctagatgcgagctatgagcatgcagttgtagctgcccagatggtcatttagaattgtgtgcatttttaaagaccatctttatgacaaagattttcaagtcctatcgtctctacattttctgaaaacatgggaaaaggatttgctacgagttgtccactctcctttattccctccctcaaagaacggttcttagaagtgccaaaatgtaataccttcggcaaggacaaaagcgcttttaaaacttaattttctagtggccctattcctaataattcttcataaaaatttagctcagcctcaaaacttacggcgaatcagtccatttaaaaccattcgaatatcaattgctgtgtaatgtccccattccctcaagtaaaatctgtttgtttgaaatattgttttgttgcccttgaagagttttctcaagaatcgtttcgccagagtcgcttgaatttcccatttcttgtggaagctgacctggagtttccattttggtgagcgggtggaaaagctgtcctgcatctaccttgtcttagtaacctttgggtatatataaatggtgactgtattgctgagtggacccgaatgttactgcatttgtggtaggggccttctttataggaggtttgtagggatgctaaggtaacaacacttaaggttgtggggaggatatacttacgggaagttcgcttgcaaactatggggagagaaagaagaggaagaaaacatctggaagataaaggccagaatggggtaggaaaaattagaatatgaagaaacatgttacattaaattttctgtgattcctcctttgtaattttcctttttgagagagtatttttatttttgtgtggttaaaaccagccccttgttgcctgttatttgggtaactttgtgctgccacctttcagggagttagttgtttttttcttcctttgaaagacaactttaggtgttaagcccctccctcttccttatctgtaggtgtttccttcattgtgtagtgtcttctt

SEQ ID NO: 132789 - DNA, 1034 bp, Homo sapiens
agataccaaatacttttcttggaatacatcatcttgattgaaaactactaggatatttttgaaaaaatagctcattagctggctgggtaagtttgtttgtttacaatggacttttcaatgatggtggtaggcatcctggaagatagccactgtactaagttcatttttctctgttcttggctgctcctctaaccttgaactttatttagtcagggaaaatggaaggaatgggaatgctaactaatggaagaaagatattttctttgacctttgaaaaacagacttaagtaattgaaccataaatttagaaaccgggcttttaacaaatgaaaattttaagatgtataaaaacagctcccataagtatatgcaccaaatgtattaaccttgtgatatataagattgcacctaggaaaagttaacaccgttggagattattaagacttaccaactcattcagctttaataagcagaacttgagccaagtgcggaacacacttgtaccaaattggcaagaattatacacttaaatgtaaatacatttttttctgcgaggtaaagctattaagccccccaaaacaccttagatatattttttgaaaactgtcctgcaaaaatgtttgtcctaccaaaagtttctagcctatttcacaataacctatatgacagttagtacgacttggaaaagatgtttaatatctgaacaaggtaatatgttctatttcctatttttgttaatgggattgtagatgtgatgtatttcaggctctgtgttatctatggcaggaaaaaattgagggcaaaagagtttctttggcatacatcaagaactacattgtaatcaatacaagcaaaccaagtctggaaaatatataagcaaggtattaaataagtaattcactgtctataaatctcctaccagtgggtgaatgttgagagtcatataagggcttcagtgactaatggaatacagttgctcatcccaagcaaccttggctatccttttagaaacttctcaacaagttctgctgcat

SEQ ID NO: 132790 - DNA, 1047 bp, Homo sapiens
ataaagagcaaaagggcatcttacatggcagcaggcaagagagagcatgtgcgggggaactctgctgtataaaaccatcagatctcgtgagacttattcactatcacaagcacagcatggaaaagaccgacccgcatgatttaattacctcccactgggtccctcccatgacacatgggaaatatgggagctaccattcaagatgacatttgggtggggacacagccaaaccatatcatatcacgttgtccgagtgcttgagacagggtactacaaccagactcctcggagaaggttgtgtttggtctaaggctcgtcaagctcacccttttaaaaagaattgttcaggaatataggcctagccaggcagcctgaatcagttcctccgtcaggcagggatatgggatatatatggggttggtgaatgcaatggagcagggttgtttggaactttaaggaattagttttctgacccagaagagatctgggtcttcttttagatttcaagttgtgtgaaataaagctgaaaaatgtcatagccatttttttctgtcaccaaggaagctattttgaaccaactcagaggagggaatagtgaaggggagtccagagaaataaaactgaaatactgggttcagcctaacctgaggcctaacgtgcctcatggcttgcacttaagagagcctaagccttgttatttcagtcagtttgagtcagggtttgtaatatatgcatctaaaagcttcttaacatgatatacaattttaaaactgaggtttttccctagagataaaaatgtgatctagatcagtactgtccaatactactttctgagatgatataaatgttccgtataagtgtagacactattcaaatgtagctatagaacaattaaaaagtggctagtacaattcaggaactaaatttctaattttatttagttcttcccattttattaattttattttttgttgatacataatagatgtacatatttttggatacatgtgaatatttaatacattcatgtagtttgtaaagatcaaa

SEQ ID NO: 132791 - DNA, 1103 bp, Homo sapiens
aatcagagaaaattactgaagaaagtgctgccttagtctccatttgttaatgtatagatgatggctgtcttctaagaaatgatataatcttgatgatgtgaactttcactccattccagatactttcagattttagtgacagttctgggtgctttcatgtctccaggatggatgaaaaacagtcagttctctagaaggatagcataaaagttttttttttaaaaaaagagagggtttgcctatgtaaatattggatctcactgatctcttccagtaatgttttcattttttccatctcttggaccctaaatgacacctacagccaattcccagttctatgtcaatccaaaatattccttttctattctttacctgggctgctgagctttactggagagaaatcacatggttatgcaacttggcaccactccacatttttattttccagcctcaggaactttggtttggtttgcttcattcacctacctccctgttctctgcatggctgtctccttctgatcctttgagtctcaccttaaatgtatataactgcctcagggaaccctccttggatctccctatgtaagcaggttccccctcattcagtgccctgttcgtttatttcatgacactttgcactctttctaattgtttactcaatgcttgcctgacttattgtttgtctccgtaactaatttcttgtgcatagggatacatctgcttgattagttactatagtactgtgctttctggcacacagtaagcactcaggaaaaattttttatataaacaaataaattgtgagattgcatttgagaaagaaaaacattcccttattttttaaaaaaagtattaaaaacactactgcaagtcaatgttgccataagcccaagatatattcttacagatggcagattgcattaccttcaacttatgtgtggttaaacagttaaacagactcttgtgttctgaattatgaactcgtagcagttggtgatcatttataatagtggtttgcggccgggcgcggtggctcacacttgtaattccagtactttgggaggccgaggtgggtggatcatgaggtcagaagatggagacca

SEQ ID NO: 132792 - DNA, 1029 bp, Homo sapiens
cctcagtctcccaagtagctgggattacaggaacccgccaccaggtccagctaatttttgtatttttagtagagacagggtttcaccatgttggccaagctggtcttgaactcctgacctcaggtgattcgcctgcctcagcctcccaaaatgctgggattacaggcatgagccaccacacccagccagtttatcatatttttaaataagtttttgctactgtaaaacatttagattatttccattttatactgagataaattatgttatagtaatgatatttatgcactttaaaaagattaatggttaatatgttggcttttaaataactttttaattgtggaaatattgaaatattctcaagagactggaaggaaactatatgtacctgtaactcagtttcaacaatgatcaacattttcccatcttgtttcattgaatcccctacttttttttgaaaacattaaagaaaatttcaaatttcttgaaatttcacttttaaatacttcagaatagacttgtaatggataaggactttctcctaaagtcatctcatactctgtgatctccctgtactctctaggttcaaatttcctgatcatcactagacctttttcacatttggtttgtgtaaattaggatctaaatatggtccacacattgcagtcagctgttatgtcattaaagtttcattcattctaaagagcacacacacacccacacacactttttttaatgccatgactggtggaagaaaccatatcataagtcttgcagaatgttccacattctgaggttgatttttcctcaaggtattgtttaacttgtttctctagctactgtattttattaataattggtagttagatgttgtcttggtccattttgtgttactgcaaaggaatacttgaggctgggtaattgataaagaaaatagattcacttagctcacagttctgctggctggagtcttcaagattaggcatgtggtgagggcctcgggctgctgccactcatggctgaagggaa

SEQ ID NO: 132793 - DNA, 1027 bp, Homo sapiens
ttaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttg

SEQ ID NO: 132794 - DNA, 1123 bp, Homo sapiens
ggtgtaaggattgaatgaattaatacatgcaaaatgctttagagcagtgcttagtagatattaaatgctcaaaagtatcagcccttgtaattatttctgttatcattgttgttttctgtctcatcacctcagtatcaacctggcagtttctaattggtaaaagggtctctatatattgaatcataatatgcctttacgtaacttgtactcattggtttctctgtgccctttggtttgaagaaaaagagtttaatacatcttctaaataatagctcttcaaattttgaagttcaccccttcatccagcaaacctactgttttgttctaggcactagggatagaaagataaatatgtctggatctggaaagaacttgtctaataaaggaaaacagatatgtaaataaattttttcatatctatctgtatctgaacctgtatactccccttatctcctgttaaaatggatgaactctttgtgctgccgagaccagaccctctgtttgagtactgatcctgctaccttttggtacctgcgaatacttcatttctccacctaattaatgttcccctctctagtgaattattgccagcagccatttcactcgtcattgctcagtgctcatcttgacccatcagcggcatttgacagcattggttattttctctttcttgacactggctttcctggctttttatgacttctaaaggatgagtgccccaggactgacttttttctacactgtctaactgatgatcttatgtagttttaagactggcaactactaacttatttctacaattcagacttctaacacttgtgtatccagtttacttattaaatgtccaataagcattttaagttagcatgtgcctgaataaattctagatccctctgtgactccccacccaccctaaaaacaagaaacataaaaacagcaataccttgctgcttctaccatccatctcgtcttaataaatagcagttacattcttctcagtgtccaggccaagaaccttggaatcattccttagtcctttccttcatctccatcctgatcccactgtttctatccatgctcccgggagtctctttcacacagcagtctgattattttgtactgt

SEQ ID NO: 132795 - DNA, 1915 bp, Homo sapiens
atttatatatcatcagctgcaagacattggagatatgttaactgggtagctttgggttgtatgtgggaaaaaaccagtaagttttatagcataacttttttccccctgaggtattttgtccttgtttacttactttcttcatcatttattgctttctttaaatcagtagtttttgacattaccagctagcagaaataaagtggtaattttaatttattcaagccaagtacatttgtagggctaatcttttaaatgccttttttacttctttttatctttagtaggaagaattgaaagtaaaataagtttttattagttactcaaatgccagctcacatttgtttctgataaaattaattcagaacagtaaaaatttgttgcatccaagaagattaagttatctatcatgtaatcacctaatctttgatggcttagaatagtttctcttaaatatgagtcatatgaacttatttggtagagagaaacaagtcattatttaggcagaatttgtttaaaaactggtcttttattactgcttaatttaaaaagtggaaaaaaaggttagacagcgaatttagtgatttgttcaatttatatgtagagagagcaaaatctagattttctgtaattctgatttatttactgtaggatttatgaatatttctgattgtttcaaaaattcccattgcttttcaaaagtcctgttgtgataacctcatataaagccagacaaaattacgtctttgtactctgacttcttctgagcaccgccataaactcagattcatagtttaattgacatttatttgtcacatataaatacatgctaaacacatattatttttatataatataatcataatcatattaccttacacctcatgtataattagattacacctcatgtataattagactacactgctactgtttcttctttgtttctgctctttgtatcaaatgaacaggcagtatggaggatatgctattacatcatctgaggagaagagaatgttctataaaggataagaaaagctagaatgggcaggttgatttccagttcctaggaaaaaggaatggagaccacaaattagccaatgttaccttgtaagagaagatgtttttctgttcccatgttcacacactcagaattgtttagaactcccttcctagtgtcaacaggctgttgtactgtgatttctttatgagaacttcagtcatgtgaaaaaccagtcatgaaggtgcagagagggagagaagaagacctccaatgagccagatgtcaaaagtccaggccttttatgcttaggagcctgtaaccacactcaggttctcaaggaggtatgagacattaggaacacactgatggcatcaagcagagttgagaagacataagatcaaagtgtagcagtaccattgtacaatacagttcatgctcatgttgtgactaaatgattagcaaatagttaaattaagttttaaccttttttttttttttttttttgagacagtctctcgctctattgcccaggctggagtgcatggcgcaatatcggctcactgccagctccgcctcccaggttcacaccattctcctgcctcagcctcctgagtagctgggactacaggcacctgccaccattcctagctaatttctttttcttttttttttttttttgagatggagcctccctctgtcgcccaggctggagtgcagtggtgcaatatcagctcactgcaagctccacctcccaggttcacaccattcccctgcctcagcctcccaagtagctgggactacaggcgctccccaccacgcccggctaattttttgtattttttagtagagacggggtttcaccgtgttaaccaggatggtcttgatctcctgacctcgtgatctgcctgccttagc

SEQ ID NO: 132796 - DNA, 2026 bp, Homo sapiens
taacattgataaaatacttttatccagttccccatcagtatttcagtttgtcttttgactcagtaatgtccttcataacgttttccctaccagttcagcagtctcaggtcagttataacatttaattgtcttggctctttagcaaccctttaacctggagtagatccacagcctttgtattttataacaatgacattcaactttccttaacagaacattactcatttccattttgagtttgtctggtgattcttcataatacaggttatatattctcagctagaatattatataaatgatgttgtgtcttccttagagtattacatatatccatcctcctcttattggtgatgttacattatattttgaagtctttttttttttgtaaatttagatgtgtatgtttagaagaataattaaatgcaattctaggatgtgtgaaagcaaacgttttctctaaaggaagatacttaagactaatgctcccagtaggtaaaatctaatttgactggaaggtttgaggtagcacattttaactttaaaccttgcaaagctcttaatgtagtatactggcatttaatctttccctggattgccaaggagaattgttgatatcctccttgggacctgccagtcattctggtgaacgaataaaatctgagtaggtgactttggacagaagtataaaacactgagatctcaattataaatttctgatgtcataattaacagcaaagccaaataattttgtattctctgagtttgggcttgtattagtgcagttttaatacaaaacacatttaagtgccagaggtgctgactggaaagaatattgtaaacttctcaaagaaatgatcacaagtcttttttaatccttcggttatttgacagatttgttactgttaatgaacagacacaactttctgagtaggaagatttcctaaatatttctagtatgttagctttaggatatgtataagaattctcagaaggcaacagagatacctattttgaagaaaattgtcacatagctcatttgaacatttataatttcttgacctttttgctgaaaagtatattaatattaagatggtataatgctaagaaagcacattattttgcagctgtattccagaacatagtgaattgaaagttttttgcatgatcttacatttaatccttttactttgattacatatgtatattacatataaaatatgtattttccacatactgtagacattaaagcatttgaggtatgaaattaaatgaatataaagtaatttgagtgccaaaatgctcattaaatttaacagttgaacttgaaaaattattggatactgctgtgagttgtgatttctcctatcagctaccctgcagagtattgtaagggagaaaaaattacttccatgttcctttcaggtttgccccttgattttacaaagaagtatactgcttaaattgctagtagtttgtagctgctgcttctgacacttgaatacttgtttctgagcttccagagtacactgaatgataccctgggagcttagaagaatgtagcctgtcttccctagtgcctaacttaattctgggaacctgggtagtaaatattatgtgattaaatatagttttaaaggttgatcttattttcatttcccaggcaagacatctgtatagattctgcttcatccgtgagagagaataagcaacctgaaggtttggaattaaaacaaggtatgaaccaagtacttgattattgtataaaatttacctgaagaatagaagcattttaccaaaaataaattttcagtgtctaactcaccccattttacagatagaggaagagagcaatttatttggtcaaaaatcagtcacttcatgattcttttagctactgaaatgattatattttatgatgtttagttagttacagaagccaccagaattatcatcttgaatagttttatttcagtaatttattaaattaaatttatttatttatttattttgagacagagtcttgccc

SEQ ID NO: 132797 - DNA, 1046 bp, Homo sapiens
aaattatcaagcatatagaaaagtagaaacaatagtgtatcaactcccatatacctgtcatctagatctaacaattattatagttttccacatttgcttcatctattttcttatagtattttcagtatattagacattttaaatctaattttttaattttaatatttgtctctgcagtcatatctttataacacttaacgtaattagcaataattctctaatatgtgatattcatttcatattcagattttcccggatgttccgtaaaggtcttttacatgtggtttctctgaagcagagtacaagcaagagtacacattgcatttagttgttctctctcttaagtcttttttaatgtaaaactgcgtccaccttcctattgtctcttgtttgcttttttattaataaatgaacgtgttgaagaaagtaggtaagttgtcctgtacacctgttggctttatctgattgtatcttcatggtgttatttgacttgttcctatatcctctgagttttcttgtaagctgggatttattaactttttaaaattataagtgtgttagtttcctattgctgctataacaaattaccacaaacttagtggtttaaagcaacacatatttattttcttatagttctggaggtcagaagtgaaaatcagtttttctgggctgaggtcaaggtgtcagcagggctggttatttctggaagctctgaggggagaattcattttcttgcccttttcagcttccagttactgcttatattctctgtcttgtggccctttccttcatcttcagagcatatcacatcattctctgcttccagggtgatattgccatttcttctaactctgacttctcttacatccttataaaatgattactgtgaccacattgggctcatcagaataatgcaagataatctccccatttcaagatccttaatcacaatcacaaagttttttgccgtatgaggtaacattcactagttctggggaattagaatgtgggcatatttggggggctgttattcagcctagcataat

SEQ ID NO: 132798 - DNA, 1002 bp, Homo sapiens
atgatgatagctcctggtacgtatgttacttttctgtataatatttgtgatttgtaacatctttacttcaatttatttatatgaatttaagtacagtgataatgcatacatagagcttttgggtgaatggccttttaggggaaaatcctaattcttcaaaagtctaaaattttaagaaattattcaatatttactatacttttgtttgtgtatcctaaatatctcttcccttatagctactccttgagttaattgcagtgtggagagaaaaatcaagtaatattaaacagatattctctcctatggttttgataaataattatgcaaagaatttgggaatttttgatgaagaagaatttattaaatgaaaacgtatgatgtcatgtacgtattctttatattttaagtagtattgtttaatggttctttattcttttaactttaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaaggtacttcattacacatcagactagatacatatgtagaaatacagccttctttgtagcaattttttgttttacttaatgcggttttgtttgtttgtttttttgagacggagtcttgctctgtcgcccaggctggagtgtggtggcgtgatcttggctcactgcaacctccgcctcccgggttcaagcaattctcttgcctcagcctcctgagtagctgggactacaggcatgaaccaccatgcccggctaatttttggatttttaagagacggggtttcaccgtgttggccaggctggtctcgaactcctgacctcgtgatctgcccaccttggcctcccaaggtgttggaattaca

SEQ ID NO: 132799 - DNA, 1623 bp, Homo sapiens
cccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggtgcgtgcgcgcccctctggccgcttcctggagctgctgctttttcggaagaagtcgggcttccagagggatggggcgcaggctggagctcactgctagcgcggcaatctcaaggtcgtccgtccttgaggttcatgttcctacctaagtcctggtgagccccacactcccatccgtgtcttgaatcttgaacttcaagtttctggatttcctgatcactttttttttaatttattttttaaactcttggctccttccactcctatggtttcactctgccggaagaatacgagttggaagctagccttcatttcccttgcgagccaaacacttctcccttcgtcttcaccttttcgtagatatggttaactccgcattagagataagaaaattgaggcccaaagaagttaaactttacccacggtcacagagtttgttaatagctcctaggtttgaatccaaatatctgactacaaaagccatgttctttatacgccaccagtctgccaagagaacgccgttttaaaaaagttcataatttgtttgaaaacaaatgaatgaataggtactttaaattcattcaatgaggaaataaagggaaagcgtcaagtcccttttcttgcccctccattagtattttgatacgcggcctcttttaatcactcctcgtgagatacgtgtttttaagttcctacacttaagctgtattgtgttattcccgctgttgaatacctgcattgttgtgataggcttctttatatacgtggtttgttatttttactgactgcctggtattgtattatatttttctgatatttgggtgtgcaggtttttttgtattgttgtgactacaatacaaacacctttatgtatatatctcctacaagagttatgttgggagagagtgtgagaactgaaattcctgggtcaaagtttatgctattaaaaacttatgaatgccaccaaatgctttccaaatgagactttacagatttatagtccaaacagtatatatataagaatacctatttctgagattcttaactagcttttgatgacattttgatggcattttttaaaaaaattgccagactagtgggtcaaattaatagtttgttttaatttttattttccttattagtgagattgaacattttaatatttttatttgccatttgatttcttcttatgtaattttctgtacatatcctctgctcattattctctttggtagagtagaaacagtttatgtagagattttatcaggtggttttctggcattctgttgagatgatcacatactttttctcctttagtcagataatgtaatttgttgataagttagttgatgttgaacagtctttggagtcttgggacaagtgctgtttggtttgttgagtttgttgt

SEQ ID NO: 132800 - DNA, 1309 bp, Homo sapiens
tgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaaggaaatgagcaaaatgtaaatagaggggatatgtactttgctgagtattaaattggaactacctggtgtgtacctggactaaatattctgttcactggctcagttgagtacctatacttttcgttttttgattgggtttaggtggttatgtcaaagttaaatggcaaaattaggaatttaacccaggtctggctggttcctttacaatacactgctttcttaagtacaaataatttaattgcaatatttaggaaaagtaggtacctttgaataatgataagaaacagtcttggttaagaatatgagttccctcttcaaaatgtaaggggtggcaaaatgtaaacactgcttcctattactgtgcaagtttttttatgtcaactttactatttcatgtttgttgtggagattacaaaatatagcttagcaaaaggaaacaatctcacttgaaggatatgttaaataatttaatgatattttaaagattttcttttttagttaaactttcctatgattctcttaatgttttttctgaatacaaaagtaataaata

SEQ ID NO: 132801 - DNA, 1499 bp, Homo sapiens
cagtgagccgagatcatgccattgcaatccagcctgggcaacaggagtgaaactgtctcaaaaaaaaaaaaaaaaaaaaaaagaactttccctgtttaattgttcggtcttacagaattttttaaaagcaaagtctgcaccccattctttccattcatttttgaatactcacagtgtgtaggctgtttgagagagttaccttatttttaaagcgaatatgatcttacagcaataaatctagtttatataaatatgaaaaattaacaaaagtttcagaaatatatgcattttttttaaagcagacacatgatttttcacattttctaaaatggttagttttgcagtgggaaaataaaatccttcaaagtcgatagtcaaaagaaattttctttattttcataagcattaatgactttttttttttaatagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaa

SEQ ID NO: 132802 - DNA, 1065 bp, Homo sapiens
aataaggccaggcgtggtggctcacacctgtaatcacagcacttcgggaggctaaggagggtggaccacgaggtcaggagattgagaccatcctggctaatgtggtgaaaccccgtctctactaaaaacacaaaaaattagccaggcatggtggcaggcgcctatagtcccagctactcaggaggctgaggcaggagaattgcttgaacctggggggcgagcttgcagtgagccaagatggcgccactgcactccagcctgggcgactgagcaggactccatctcaaaaaaaaaaaaaaaaaagacaaagctcataagccttatccttactttatggtgtttgataattgctgagtaaagtcttaactccccatggtgtacactagagtacttttattgaaagtcttggcatttatatattatctggccaattacagttagagaattttgaaagtttggttttgggttctaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaaggtaaataaacactcttcaaaaatgtaaccagaaagcaagaagttttatcttcatttctatcaatattactggtatttgtggattaaatgaaagttaacttcggtagttctaaatcactatggaaaatcttcacgaaaagggttcactacactactggaattgatgatcttgtttccgttacatgccttttgagaatctgaaggtaatatatgatccccatatatgcaccagtttgtttttttgttgttgttgtttgttttctttgtttttttgttttgttttgtttttgtttttgaaatggagtcttgctctgtcgcccaggctggagtgcagtggcgtgatctcggctcactgcaagctcactgcaagctccgcctcccgggttcacgccgttctcctgcctcagcctccttagtagctgggactat

SEQ ID NO: 132803 - DNA, 1536 bp, Homo sapiens
ccaaagtgctgggtttacaggcgtgagccaccatgcccagcgatcttattttttaaagttccccaagtgtttctaaagtggagccagtttggagtaaccctgggttatgggtggactctgggaatctgtgtattgaatctgtgattcattcaggtggtcagaaaaccatatttagaaaagtgtgagagtgtactttaccttttaacagcttaatgccttgggcaagttattcaaccttctgcttctaaaatattgtgaattataatggtatctatataatactttaatgaatatatgcatagaagatgattaactggcatatggttaaatttcaacaaatccatttattctgtgtttctcattattttaattaatcttacttttttttttttggttttgcttttttaattttctttggcatttctgtatgttttgcgccggttgtaacaactcctagagtataaattgagagaggctagaacagtagctcatttttcttcttcccataaaggctgatccattattctgaatatctccaaatcctgctgattctctctctatacttactctttaagtttccttctttctattttcaataggacagccacaagtattatctataataaaatgtgactgggctgttgtcatagtatctctaactcttacctgagtcttttccaattgtcttatgtgctagttagtcccacccctttacttcaatagaatagtgttcacattttattctggaaacttttatttctctccaatccacttacatttttgtagtttactaaacttctacaattataatatataaggcatgtaatgtttactttgtagctaacacttatgatatgctcaggcactgttctaagcacttttctgtattaaatttgtggcatatttattatgtatataatgacgccattgtgaagtgtgcttaatactggaaataagcgaaggagcagtttgaactttataatttacagtcacctttgcttactaggagtattattgtattgtaggtgctggtcgttatgtaccaggttctgcaagtatgggaactaccatggccggagttgatccatttacaggtacatactttttatttctttttcttttttttagattttaaaaattcgttggaactttaataaaaagagtaagaaaatttgtgtcattttcttgcttgagaactttttatatagtaaatcgagaccaaacttgtctggctttttgagttttctcagaattgtctgattactacattttagaatcatctggggagctttgcaaacgtacttcagccttatccccagagatgcttacttggtctaattctgctctgagatgggggcttggcaaagggtagttttataatcttccaatgtgattctaatatgcatctaggatcggaaactactgttttactgtcgtaaatctgctttcctcactactcttacaaagtctgtgtttattctcatctcttcattcttaatgtgttgagaatgttattcactggattatacattgttc

SEQ ID NO: 132804 - DNA, 1050 bp, Homo sapiens
tggatggagcagtacaatcaagaagtctccccaggcatattttgacttaacatggaaggagacattccacccaactacccaggagtagtcttcctaatctaagttattaatgtccttcttgaagcccttgaagtgttggtgtatctcttcaaaatgaatttatttaccaaggtatgcatgcctcagcatcaacactactggaaaaagtgccagagttggactttaaggcagctgaagaagtctctattttcagaatggcttttgatatcttgtataatgctgttgttggatcttcagacagagttcctcgacagtatactcagtttgggaagagatcatagcgtttaggtatccactggccttgcagactggtactgtgagctataaaaatgacaacctacagtcctctctaagtcatagagattggacaaacatacaacgttaggtcagcatcatgaagttgtggattgctgtccgtgagcttcctttttcctgtgaatttattgatggcccagatggaaatggttgtaccatgtgcattgataacaagtaaatgaaaataattaactatcacactaaatgctgttatggcacagtggctgttaaggaagtctttgataacataatgtgatttcaaatggtagtaaggatctgaagagtagataagatggctttctctctatcagcagttcagaaacagtgatgccctgaaacttaataccaagtgagaatccaaatcactttggcggctttttttctggaacagaaagaacatatcaagcttcaactaataccagcaaaatcaagaaaactcctggggccattataaccagagcatatctcactgttccataatgtcagtaactcagaagatgcagtaattatgtagatatgcaagatagcatacacaatgtccaagagaattagggtatcaggataattgaatacacttttgtataaatatataacagcatctaccatattgaggtatgaaaataaaatagcataatatgtgtaagtgttaagcaaaatgcctggagtatatttaag

SEQ ID NO: 132805 - DNA, 1007 bp, Homo sapiens
gagaaaagaggttaaggacggccatctaatccaaacattaggccattttttttccttgattgaagttacattgctagttactggcatagtaaaggatgaccatatttgtctactgaacatctgctaattttaagccctacattgggtctttgagccctttataaactaaactagcccactacccttctctatatggtaataactaaaaaatattgactttaaaagtacatactatagctctagattcttatgatggtaaatatttaacttggaaattgtataaaatacatgtttctctgttctttgtcaataacttctctattaaatagttgacataatagagtagcatgtgctgaagtcagcacagtgctgtaatcagcaattaataacatgctaatatttctcatattcacaaacacagattatttttactatggatcattcaggtgtgataatgttaatgtattatggcaatgacttctaaaatcagtttatttttccttacagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtaagtattttattgtacctagtagaaaaaattcaccatatttggcttttggaacaattagaagaaaaataaatgttgttttgcttgtgtttttcattgctagatgctgatttttgaggatttttactattacatataatcactatgagaaaccatgttcttgcctctgtctcacagaagactttgaattaagcttctcataaacaggaattaaaaaataaatctcccaacacttagatcatttacagtagacactcaaaaggcactcatttaatactttttggttgattggattctctgagaggggttacaaactgaatattaaaatga

SEQ ID NO: 132806 - DNA, 1619 bp, Homo sapiens
agtcattattaatctgtgatagctactcttaagtcaacagatactgaacataggaaatctgacttcacaagcttcagagaatgttttgttcttaaatttatgggctactctttgttatatatttcttttatatttgaatattatatattttataaattactcttgttggggaagaaaaattaaaaatgaattttcaggtgaaaacaaattattggggtcaaaatactatttctggaggtttttggagaaggtaggatgaatgtaaaataacttctgaagactggtgataaaaaaatattgctaaaccttaaatacaaattttggttatcaggctttcaacaaaaaaaaagatttctctaacttgaaaattaatttttactactcactgatatgttttataatgttagtaaaatgtatagagccatcagccaaattatcagttttattgatttgcattattgttttttaatgcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagaggtaagattattttatgctatttatttaatgttttgtattgagcattattccatcccatttgtgagatggagggaggagagctgattacttaatttactatctatgacttgaataatttagtaaatttatttcattaagtatctttctcctgtttacaaagaagaaaattgtatggccatctttatattaattcagatttatgttgtgctgtaaaaagttcttgggtatctgaagaaacactttgtaagatgtgacatgaataaaaaatgtgattttgaagttgtatatgttgtaagtgacaaacatatgaaatttaaaactgtaattttgaaagtctctgggtttcaaaaagtcagtgtatctagaaagatggtatgtataaatgtacttaattttattcaaactaatacttcctatattcattaattttagactttgtgacaacagcagaggacagatctctgagaatctggaaacatggggaatgtgctcaaactatccgacttccagctcagtctatatggtgctgctgtgtgctcgacaatggtgacattgtggttggtgcgaggtatttatattctagtcaatcattaaatgttatatgtctaggccttcagtaggaactagagtgtacagagataagccataaggaatttcacgtgacttgaggagactatatggacacttcaattactaaacaaaacagtagtagatattatagctttcatactaagggatgcatgatataccagtattgtactgcaattgtgcagtcaatgatgcatgatataccagtattgtactgcaattgtgcagtcaagatattgactacaaaagaagttagagaaggtagagattggtgtgggaaaactttctgtagaagaagaaatttgaactggattttgaaagattatgagtgagaaaagatacgcaaatttttgtcaaagctaagagtataagtttccttcatgagaatg

SEQ ID NO: 132807 - DNA, 1312 bp, Homo sapiens
tttcatatttgtaatttttagcctgcataatttcacatcaagaaagtaagacatttaattaaccacttcattacttttggacattgagcttggctgcaggttttatggtcactgtcatgaaagcagccttaaatatttatataaacagtgtttcaaaatcatttacattatctccctattatgatttgttaaagctggaaggattgtgtagctcacttaagttccgctccctcgtttcacagacaaggaatctgattttgagtaatatttctgcagttacgtggcttgtaagtggcacagctaggccttgcgcccaggcagtctggcaccagagtctgctcttgaccactgtactcttatgcgtctctgctgaattgagccttagttagctaagatactgccacttcaaagagtgtttttaaaattggaatgctttagtaactttcaatgttgagcatttttctgtatgaaaatgtgttatccaatgatgttttttccttagtttgtagtctatcatctggaaaatttgggacattacttagtggttcatgggacaccactgctaaagtctggctgaatgacaagtgcatgatgaccttgcaggtacagtagttctgtgtaaatattctaaagaataattaagttgaatgattctgtggcaacttaaattgatactcattttactcacagggtcatacagctgcagtgtgggcggtaaagatcttacctgaacagggcttaatgttgactggatcagcagacaagactgttaaactgtggaaggctggaagatgtgagaggactttttcaggtaagatcagggtagacaagttttataatatcattgctttttatttgctcagattttttttctcagaagtttacaagcatgaaaatatttgaaaaacattagtatatttaagctattaatttgagttaatgtaatttttctgatgagttaatatctaatacatttaaaaagataatgaaacctctcataaaacagccaaatgtagactgataaatagctgtctgataagctatatataatatgcatatgtgcttctgcatatatgtatgtaatttttggtatatagttatatttttggttgtcattttaatacttttagcctgaaacttctaaacataagccttactgatggtcagtcagcagtgttatcttcatatatggaagaaatcattattagtgtctttatattgaagcacattgtttataacgaatttcaagctttgtttatgttgtggtttatggtgagtattctttttaaaccccagctattaaataatgcca

SEQ ID NO: 132808 - DNA, 1018 bp, Homo sapiens
gggaaggaagtgaaaatagatgagtttgtttagtctttatctgggagtcttacctctttatgtacacttatcttcttcaactagactgcaaactctttgatttagctgagtcagggatataattctttttatccctctcagcaggtaatttattgctttccacatagtaaatcataatctgctggttgaacttgttaagtaaggcagtgatgctaagtgattgatacatgtcacaaactggtaatcattttaatcccagtgcaattattaatgtactgtgttcattgatatatataattatatataacattatatattatataatattactctagccatttatatatttctgtattaggtggggtttttttgtttatttgttttagcttatcagttatcattagtgttagtatattttatgcgtggctcaagacaattcttcttcttcagtgtggcccagggaaggcaaaagatttgacacccctgttctagctatgtagaaacacatgctgtactatactactgggctctaagtcaatgcttcataatgtgaaaaagtcctcagtatatttaggtcttcttaataataaatttcattatcttaattgcatgtatgtttcgtttaaccagggatttcttagggtaacagtcactaatgtgtagaagtgaagatggagattgagaaaaaacccagtcatgattatttattgccctttcttttttccttgttctctatgttaacgtattcttatcaaagaaacactaaacaaacttctctttatctcatgtaattctctatagtagttcatatgaattatgtaaggttcaattttaaaacaatagattcttaagatagtatatactctaaagtttgtctagacactaaatgaaaatgagtgctttgacagtttatgtcctaggctaagtcagggtacgaatatgtatctattaattatcttgtctttccagtccaaacaggagctttacagaaatgcactgtatgagtggccattccaat

SEQ ID NO: 132809 - DNA, 1498 bp, Homo sapiens
tgcacaactaatcctaggatttcccttcattgttgtttccaaaacaacttttttgaacctcatatgttggatttttattgtcagtatcctttagctttctcttggttggttttcttccttgttgccttattggaacataacctctaagagcttcctgaaatgtagtgcatcagtaataaatgttttaagaccttgcaagtctgaaagttattttattttgccttgttactggcatgataatttgaatggttgtagcattctaattttaaaataattttctttcagaattgtgatggaatccattgtatttcatcttctagtgttactgttgagaagtctgaagccattctgatttttgaactattttttttttctttctggaaggcagtctacttctatccattgttccaggccattggcgggcccttttaatatgaaaactcatgtccataaattctgggaaatgttcttcaattaattctttggctgctttctctttattttttctgtcttcttttttctggaactgtttttattcagatattgaacttgctttctaaatttctctcttttttttttttcttggctgtaatctctagcaggttgccttgactttgtgaaattatgtccttgtttcatggttgcaatatcttatacctctaaggatgataatgacaatttaaaaaaatgttttaaggtatttcctccttaatggtctgttttcctccatattggtttttttctcatctctatttgttttgatcactgtatttcatgctggaggctttccccagatgtctggtaatctttattgtgtgctcagtgttatgggtagagaattaagaagctcctgggagatctgtgctcctggatggggcttgctggttgtgagttttactgttgagttatctggtagggccattatattgggctgatctgctgcctagaggatgagggtatggtttccagggttttcttttggtggtcttgggctccagtaggaatatacacattcttcacactcccaagactcaactatccttatgtccccccattcaaagattttctttttaaagaaaaagcttcagacttttgctgagtactagcaggacagttgtctggctgggttgtctagctgcacatccctcccccaccccccgtgttttgtttttgtttttttttttgtcttaataccttaagtattttttaaaatcagtttaagaaatacttaatgctaaccatttaaaacattgtgctagggacttgggaagacacaaagaacctaatctggattctgccattaagaacttcacagaccactaccgaagatgcacacaaacatctatgctttgaagtgttaagggttacacatagtgggtagatttagtggtttacataatacagattttaaaacatgttctatcttttgacttcctctgggcttattgataaaatggtttcaaaagcattaaaaaacaaaaacaacaccccctaaaat

SEQ ID NO: 132810 - DNA, 1061 bp, Homo sapiens
gtccacgccagctggcgcggcattatgggaattgtagtcccggcccgcttcccgatttaccacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacaggtgagcgctgggagtcgggttgccccggctgtgttgcacgcttcccggagagtggaaggagagtgacccttccctgtcagtcctgccgtctctctctccccccagccttccctctgctctccgctcccttccaattctcagactattagaactctgtaagaaaccatcgggatttaagtggaaagagcacagggttgggggaccaaagacctgccttgttgtgctaacttgaccacagacgagtctcctaccttttgggccttcagtttttggacgatgatctcccaagtttcttttagacttgaaaatttactgattgcagttgcaccctccgaagtgaggtagtttgaaggcatctgaaatgtcctctttttttttttttttcgaagaagatgctctgtagtcttctgtaaaatttaatttttgaagacttt

SEQ ID NO: 132811 - DNA, 1025 bp, Homo sapiens
ctaacctagattagttgcccttgctgtgtgctcctatagcatcttttatttttcctatgatagcagttagtaccttttaattttaattaattgttcaatctttagagtataaactctgtgagtgaagttactctgctgtcttgctggtgatctttcaaagatggaatggactttcttgggaacttatgtttctcagcacccatagtgttcatgtataggttgaatagccccaggttgggaatggaaagcctttaagtcctttccaatcatattgtttgttccacatattcaagttacatgcatatgtctacttgaaaagtctctataagtcattgtaaaagaatttcacctaatcgaacacgtcgaatagtcaatgactaatggcatagagagaaccaaagagagatttttaatttagagccctgtatgtgcaatttttgaaattcatgttgtattttatatctctcataggtgaaatgaaccagaaatacaaggagctaaagaaaagggaggaacatatggacagtaagtgatattcttgtagatataaaaatataatattttcagattgctgttcatttataccaaatcagagacctcattttgggcagatataatggctaataaatgcagaagtgtggacattcaaagcattttgccttgaagaatagtttctagcataatttagagatgggtagaaaattctaaaaagatatgtgatgagtgtctatacgttggggctagattctaaagctagtacttacattcgtagtctgtacagaggaaacctatagaccaggggtccccaatccccaggctgcagaccggtaggaaccaggccgcacaccaggaggtgagccactggcaagcgagcattaccgtctgagctctgcctcctgttagatcagcagcagcattagattctcatatgagtgtgaaccctatcgcgtatgagggatctaggttgtactcttgttatgagaatctaacccctgatgatctcaggtagaacagtttcatcccaa

SEQ ID NO: 132812 - DNA, 1014 bp, Homo sapiens
acttatatcaaggtcacaggatttaggcagtttgaaagtatataaagttcttattgaataataattacctttgggttaataacaaattaaacagtggcagcttaaaatttctaaaaattgggccaggtgccgtggctcaagcttataatcccagcactttgggaggccgaggcgggtggatcacgtggttaagagatcgagaccatcctggccaacatggtgaaaccctgtctctggtaaaaatacaaaaattagctgggcgtgatggtgcatgcctgtagtcccagctactcaggaggctgaggcaggagaatcccttgaacccagaggtggaggttgcagtgagccgagatcgtgccactgcactccagcctggcaacagagtgagactctgtctcaaaaaaagaaaattctaaaaagcactcttaagaactgcaaatcagagtttatatagtgttaactctatcagcagtaatctctcttatgttttccaattgtcagcttttattgagacttttgaggaaacaaagaatcaggaactgaaacgaaaggcacagatagaagccaacattgttgcactcttggagcactgcagtcgagtgagtaccatgtgcctgtcttggtgtcctctttatttttgccgtgattaactttccaaatacaactcaaaaaatagaacggctcactattgtatcttctcatttaactgcttcctttcaattcccttacttgttactatttatttcagctattaacttttttatcactctagcaaaatgtcaggtaattagggcaatagagaaaaaggatgacatgtataatatcaatattcagcagtaaatgaagcactaattcagagtaattattatgatcttcttccattgttaatctatctgaacttttgaaagtaacatttgcacagataatttcaaaatctagacatgttagaaaatgttaatgtatttttatactgtaaatttattgtaaataaaaagattcttgtatgtatatgta

SEQ ID NO: 132813 - DNA, 1029 bp, Homo sapiens
ctgtctctcttttatttatttatttatttttattacactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacacttttttttacgtttaatttttatgtgtgaataatagtcaaattgttcaaaagccagtacacacaagcatatagggaaaagtcttccttttaccattgtgccccaactacccagttcccccgaataggtcatcgttgttcttctttttatgtgtcaccttctagaaattctttaggcagatactagcaaatacaactatagattctcattttaagaaaactaagcaggtgattttcaagactcatcctaggaagctggtaggtatgtcttcttatacccaaagctcacatagaagatccttctggtactgtaaatggggttacaaaggacagagtactggctggtggaagaggtcttccttaaccggcatgctgaacaagggtagcgaagtatagtcaagtccagactcccagaggccacaatttccttttccgtcactgaaagtaaagggagatctctgaaaggagcaagaggaaaaagaaactagatacatacctagaaataatttatacatagcttggttgtcttttcaaatcaactgcattttgtattatttcctaaagctattaaataaaccacggccactgccaccgctgggagctcagagcagatcctgtggttttggcaagactcttgactggccctagaaatggggctggattgaactggagttgaaagaattacagtgtttccttcctcttgatgactctttctggaacatgcctggaatgtgtgagtgtgagagatgaagtggtg

SEQ ID NO: 132814 - DNA, 1100 bp, Homo sapiens
tgcgcccagccaccacaattattcttgagcctctatttttgccacatgttttcctgaatacttgtatgcctgacattcccctagcaacttcatatgtattactaacttagtctttatcaaatatatatcagatgaggacttttaagaccccactaataatagatgaggcttggctattgtaacttaacgtgcatttactagctagtgagtgttggatctgggaaggtgaagtcaggcccgattctagaagcctggctttaaccatcaccctgtgctacctttcaaaacagatgtgatcttgccctcctggaacacccaatctagtaggggatatataccatgagtggggctataatgaaaaaatgcagggtatttagggagtagctatgagggcatctaacctgtgttccaggtgttgtgtgaggtctctgaaaattcctaaatggaaactgatgaatgagcaggagctggtgaggctgaggagaaaaggaggagaaaagaagaaagaaaactcatgacttggacatgagtgatgagatctggctgaggaactgaatacagttcaaagtggctggaattgagagctaaggatgtggacctggagaatgataagtctggagaactaggggtggaggtcttgagtttgtgtctcaacttccacatttattcactgttgataggccttgggtaagggacttagtcttccttaactccatctcccatatggataaactgtagctatactgtcttcacaggactgtggtgaaattgcacaaaataatcacagatatgaaactacattatttcctgtagtacttacacaacaattaaattgaaaggagatgactgaaattgagctcacttgtttttcatctgtgttttcacttgtgtataacttttactaccacctactttcttctccagaccttatggaataaggaattatatttttagttaagttctgcccatgaattagcccatccaaatgatcttaagcaagttatcttccaacctaggcctcagcagtatcaaatttaaaatgaggtggttggaccttaaagccttctgagtgctaacattacataatctatgaaagcatc

SEQ ID NO: 132815 - DNA, 1020 bp, Homo sapiens
tagtttccaaaccagaactgaacgcttgctcatttcacaacactgtagggaactcacgtacaactaacgcaaggatggcaaacacatggaatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttttttcatctggtgtggatgccaaccagaagacattatgccccttagaattatgaaaaatcctgacacaaaatgatgaaataattatttttccagagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaaggtcagtggttgaccagatagagtcagcattgcgtgagggtgtggagaaaacttgatttcctgctcattctttcctctatggtcttacaaaaaattggcatggtatcagacatagctgttatttgcaactgaaggttatgcttcctttgaagttgagcctgtgatagtcaggatatcaatacaaaggcaggagccatttaaacatcactgtcttgattcattgggatgagatactatagattcttggtcatatatggctaacttttgcggagcatcattgtttctcttaaagcagtgcttctccaaattgagtgtgcatcagaatcacctggaaggcttgtttaaaaacaggctgttgggccctaccccacaatttctgactcagtctagggcagggccagagaatctgcatttttcattagttttccagtgatgctatcttgtgggt

SEQ ID NO: 132816 - DNA, 1052 bp, Homo sapiens
attttaaaatcagattttcaattctcattgtacttcaaagcatctgcattttttaaagatccccagatgattgagtcctatcctgtggatattctgattcaattggtctagggtgagaaccctgcattagggtttttttttttttttttaagttacccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagctgataaatgcaaagagcaaggaaagcatagatgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagtcctgaagggccttgaattccagctaaggatttgggatcttggaaccatagggacattaaagaattttaaggaatagaactacatggtcaaatttgccatttagcatgatcatcctgactacagggtagagaacagacaattagggagggagatcagttaggcagagagaccaggagagattgttgtcatcaggtgtggtatgatggtggactgaactgaggtgatacagtagacagaagtgacgagatccaaaagaagtcaaataaaaaaataaatgaaaaagtgcacaaggaacttaacaattaggaggtgtgaggttggaagccagcaggctgggagtgaatgagggcaaaaagaaaacagataa

SEQ ID NO: 132817 - DNA, 1026 bp, Homo sapiens
acttccctttggctgactaaagctttgatgctaagctttgcttgcctgaccatcttttccctgaggataaatcttcccaatttccttcctcctcctatgcaattagactcctggtgaatctatctccagttcaccaggtgtgttcagtagggagtcacaagttggacttaatttgtgagcattcattaccctaaaaagattatcaagtctttttaaagtcatgcttttttttcttgaagtaatatgtcatcttgactatggatattctctaatgttgagaagctgtcatcaacaataattacatttgagagtggggaagttaggtgatcctatcaggaagagaaatgctgcctatttgatttgtctttatttcttattacttgagttattgtataactaataatggataatattgcctatacttaagtcctcttctaactaattaaatattagattattttctccacttgtatgtaaagtaaaagatgagtttcatgataaaaatattttaaacaaaaaaagttttatattttatgaaaaaaataggttttatggccaaaaaccatgaaaaaatgctcaacatcactaatcatcagggaactgcaaattaaagccacatgagataccaccttatcccagccagaatggccattactaaaaatttaaaaaaaaaatagatgttgccatggatattggtgaaaagggaatgcttatacactgttggtgggaataaaaattagtacaacacctatagaaagcagtatggagatttcttaaagaattaaaagtagatctaccctttgcaatcccactactgggtatctacccaaaggaaaaaaagtaattatatcaaaaagacacctacacacatatgtttatcccagcacaattcacaattgcaaagatatggaaccaacttaagtgcccattaactgatgggtggagaaagaaaatatggtatatatacaccatggaatactattcagccataaaaaagaaaaaaataatgtcttttgcagcaaattg

SEQ ID NO: 132818 - DNA, 2084 bp, Homo sapiens
tctgattttgttttatcaatcataatgtgttaaagccctctgtggctgccacaaaagactagaatcatgaaatctttgtccaagctaagaaagggctgtctctgtgggtacagtggcattctctgttgacctaaccaagcagcctgaaccttgctttgtgtctcgtaaaggtcatctcacggaatccaattgctgctacctcaccatgttgctgtgccctggtcaacaataaacatacttttgtcccccttcctaagtaactttgagaggacaagataggcaaagttttttccctacatctcttttggccaaaagaatatctgaccatcacagagatccagagaacagaaacaagagcccctaagtcccagcctctgcaatacacagttaccagatgggaatgcagcacagtggcacagagaggtaactacggagcccatgccctggaggaactctgtagctgtgcatcatggaacgccacaggatttttacattaaaaagttgaatatgttcctgcatttcagcagtgcataatcgagcaggaggctggaatctggagacctttgttattcattctttttaaggttattttttattaactgtgcatatgaaatttccactcaatttaaaaatccaaatctttttaagcttcttggaagaatttcctcctgcttatattgttaattgcactaatgaactcttctagggtaaattctggcaaactaccctttttttttttttaatcacagaatattcctgttcccacagaactttggcacattctgaagaaaatctctgcagtcaatttttatctcctctgcttgactgcatctaactgttcatctctgttataaatggagcttcagccctctgggtcagagactgacaaccctccttcttcttcctaacctgtcctactctccttctttttctgctttcattttaattttgggaaattttaaagtaaaagtttcaaagttgaaagattatagtgagtacccttatgtcctttagtgcatcagttgttaatgttttgccttgttttcttttcttccttttttttttttaagagaaggggtctctccctattttacccaagctggccttgaaccccttgcctcaagtgagcttcaaccttagcctcctgagtagccaggactatggcatgtaccaccgcacctgcctcacattttctttctcactgtaaatacacattcttattcttgaaccttctgaaaataagttgcagacatcatgaaaatgtaaaatacttcatcatattctttcttttaataagagcattgtcctataaatctgcaatattttcacgcccatgaaactgaacactgatactgcataaatctaatatatgatccatattcaaaattctccagttgtccccaaaatatcctttatagctgtttatttttaaatccaggatccaatcaagaattatacgttatatgtagttgtcattctcttttgtttcctttaattgattagagttgcccttttgtgtgtgtctgagtggtgggtggtggggtggtgtttgtgtatgatgtgcagtgtgtgtgtgtgtggtgtgtctttcatgacactgacattattaaagagttcaggcaagtttgtggaatgtcccacaatctagacttttttactgattgtttcctcattacgagatacaggttacattttttttcccaagactgctacatgtgtgatgttgtttccttactactgcctcacctcaggaagcacataatgtctacttgtctcttttctgatattaggactgatcaggtgttgtctgcctgatccaatcattatcaagttccataattcattattaagctctgaaattcaggacacatacatttatagagtgtgaggctgtgcatacgtacattcatcccttaatgttctcaaggaggcccaggatccccaaaatattataagcattgcagtcagatgatatagcactagcaaagcattcatccctttccatataacaggagggaggggaagaaggaagtttccatgtgcaggcaatacgtgagagcatgggcaagtgaggatttgtatgc

SEQ ID NO: 132819 - DNA, 1049 bp, Homo sapiens
tccctccacaaagagctgccagatgtgttcacattgtctccatgctgccacatgaggcatttccgttcattgtttaagccccctagtatggttgcttctctttgctaagccacttctctcctactttattgataggaataaataaaactcagtaccttctgctcaacatttctccctagatttcccatcagaacctccacctcaggaagctgctcagtatcttaggggagctgttggtcagagacaccaaatagtaattgtacttttttatttttttaatgttctctgcagtgttggaaattgctgcaggatgtcagtcacagcagggattaattcgtcttcatgagcatttacatgaaaatgtaaatagtcagtatggcttgatgcccatatataagcctgccaaattttggctgctatgtgtggtctagactagtttaaatttcccggccagataagattagattctttggctccaaaaatgtcaagcgagtattaacttggggtttgaatgaaggaaggttttatttattgaaacataacattatattttctcccaccacccacctgtcccaccacaataaaggcatgaagataaggcaggttacaggcagtacctagcctagggacttgtgtggtcacttgtgtggtctcaggagcacttcctcctatgaaacaattttatacataaaggtcagatatacaaaccaccagcaaagccagttaagctataatgtggtactggaacataatactaattagtattaattccaagatgttggtgctaatagagtcctattacattgtgcatctaagtgtaaatggaccaatagacaagaataatgcctggaggcagatctggaagaagaaagagatatgcagatagctccatagggaacttcccagagttctttgaatgggccatgtcctctcacccccaggccattgtatgtacaactcctttggcttccatgtcctcagcttaagtcctgctcatcctgcaagtctaggcctaattgtccgcttctcagagacaaacacctttcatt

SEQ ID NO: 132820 - DNA, 1034 bp, Homo sapiens
aacaattgataaagttaatttcagaaaatgtcaaggacagagaggaaagatggacaagggccacgtaaatgaagacccagaagaaaccactgcaatctcctggatggtttcagttcagttctcttctatagtcatgttcaggtcaatggaaaataacttctccaaaggcccacaagaaggaagaggctgtggaagcactcacacttttggtttcacagagctaagggatcagaaacaccacgacagagctgaaagtcaatttctcctttatgcctgaaagcataaagacaacattgtaggaaaaagctgagtgtaagttatcaagtagagaaaggctttctttgctatcagaaaactcagttattttctataattgaagaaagggctccaaggcagtgccaggaactaacttgaagtctcagagtcacagaatggcctcaaacatgtcaatatcctagacaagggcctctttgggggcctgggagaaaattaggttaaccagacatttttaacagtttaattgagcaagaaaggtaccaggtttttttccccagaagtttatatttctttaaatcttgcttgcaatagtatacttcctacatttatgtgttaattataattatagggaaattcattttaatgcttgtaaatattcatactttttaaatgcttaattgtctgaacatatatatttgttttacactaaccaaaccctataaaggaacagaaatagatattaagaatgtttctgaggcgaatcatataatatcaggctctggatacttagcacatgcagtgtccattaagagtagattgtttatggcttgtggattgctattgccgaaatgaccatttcaacagttgacagtgctaggatgcctaactgctaatactgttgcaatgcacctattcaaatcaggcataacatgtcaagtcaacacatttttatttgatttgcatatattgatactctatatatacaactcaagttgctcagatattctatgtgcataaaaaatctatgctctcgaggc

SEQ ID NO: 132821 - DNA, 1082 bp, Homo sapiens
gagaagatcccccaacagttttattcctatctcaggttcatttcagaagggtcactgttccctttggctctgcaaagccccgctcaagttgggttccaattgttctttctgggttcccccaactgtacaaagaggatcaatgacattgctatcttctcccttgcccccacctcctcccattatgtgtctcagcatgatttgccaaccaaatctggcttattgcaaactttaataactctggaaaactacctgtttgactttatttagatgaaaataaccacatcaatgcaaatgtacaatacaattcgaagagggagatacttcttcctcggtatcagtaaaaatctgatagatgcgtttctctccgagatctgcaaggtgtgaagagataactgtgtattaatgttcacggtagcgttactccttagacgtgacttggttaaacgtgggcctatagcaattccatggagatctttctaccaagcagtggttttcagattgtgactcaagggccagtgcttggagttgggaaaagtaaggggaacccaagcaggggaagctcttcaccactcccgcacaactcaggtttctatggttatttgtttattcactggcctagtccattcaagctgctacaacaaaaataccacaaacagagtggcttataaacaacaaatgtttatttctcacagttcaggaggctgggaagtccaagatcaaggcactgacagattcagtgtctggtgggttcagtgtctggtgaggccttgcttcctgtttcacagatggcagtttttgctataacttcacatggagaaagaaaaaggaccctctttttttcttttttttttttctgagatggagtttcactcttgttgcccagtctggagtgcaatggtacaatattggctcaccgcaacctctgccttccaagttcaagtgattctcctgcctcagcctccctagtagctgggattacaagcatgcaccaccatgcccggctaattttgtatttttagtacagacggggtttctccatgttggtcaggccggtcttgaattcccgacctcaggtgatctgc

SEQ ID NO: 132822 - DNA, 1058 bp, Homo sapiens
tgggggtggggaggggccagaagctggaccacctccactcctcccaccatttggcccagagtcatcgttaatgagagttagttgaataaggcatttattcaacctggaaaatgcccagtggcttcagcccttatagtatggaattcctatctcttggcggggcgtggtggctcacacctgtgatcccagcactttgggaggccgaggcgggtggatcacgaggtcaagagatcgagaccatcctggccaacatggtgaaaacctgtctctactaaaaatacaaaaattagctgggtgtcatggcgggcgtctgtagtcccagctactcgggaggctgaggcggaggttgcagtgagccaagatcatgccactgcactccagcctggcgacagagtgagattctgtctaaaaaaaaaaaaaaaaaaaaaatcctatctctttttctgcacttggcccctccccagaactttgtgattggtcccaagagggaaaataaaacatatttggtggagaatgggtatgcactaaagttgcactgctagtgggggcccatagacctcgtggtgggtgaggatttagacacaacttgcaagatacaggggttgatccagcttttcccagaaaggcgtgggtgggttctgctgaactggcacatcaggagtttcactggggttaatgttttaaccgttgtgtcaatatacttaatgacactttgtttgaatattctataactgaatggaagcacttttaacgaacaagttttgttttatttttaggtgagcgaatagcagtaagatttacctaggtacactttgtactatattgaaaagtttacattttgaaaaaccaaatatgatatatttagaccaaagaaatagttagactttatgccttgagagctttgcaactctttcagtgcttataatcttttcaagatctgagggtctgtttcactctcctggtgcttcctggactgtgtagtttttatttgggagattaaccactgggggcttttgttcagaacctgccttggactgaatggctttggaccaggtctc

SEQ ID NO: 132823 - DNA, 1121 bp, Homo sapiens
gggtttttattatgccttgggagggcaaggtccactgaattcttggtctggtcttttctcagcctaggtaggagccacggacctgtttgtctgaatcatggtgaaggaactcacaacatgcccggattgattaggtgcatttttccaccctcagccatgggggtgaagggggttggagaaggattggccctgatcttctaaacagcacacatctttctagcttctggatgaaagagtgagtcagggcaccaggaataactaggaacagttgatcctactcagtgtgttaaggggaacctggggctttaggcagagaaggctgtgtagaaagagaatcgatctgatatctgaagcagtggttgttccacacagctgggtgtctttgagccccttaacttttttgcttttttcagtactcatcacatattaaagctgtcgaggaattgacctagtacaaagtggtggcaataataacaataacatttacagtgcccgacactatgccaagctgtcaacacatacaaatgtcatttcatcgctcatttgaactatggaaaagctgacacttagacgaaataatgtgctcaaagacacagagcagactgaggggatgtcagaattatgaacccaaggctttctgactccaaggcccgaagctagagaatgcccactcgtatcaggttaatgtccacccctcatcaatttaatgttactttttccagacttagctcacacttgtaatcctaacgctttgagatgccaaggctggaggattgcttgaaccccgtagtttgataccagcctaggcaacatagcgagacgtcatctctacataaaataaaaatttagctggatgtggtggtgcgttcttatagttctagctactcaagaggctgaggcaggaggattgcttaagcccaggaggttgaggatacaatgagctacgatggcgcctctgcacaccagcctggacaacagagtgagaccctgtctcttaaacgaaaaaaaagttctagggctacctgtaaggaaaacatctttaattccatcacaaaatcaggcagtgccacaaagggcccagcctagagtgcgatgactggtgttgccgttacacccagttc

SEQ ID NO: 132824 - DNA, 1005 bp, Homo sapiens
cttctgtgcctggacctctcatcagcagtgaatggaaatctcaatgattaatacaatattttcaatctaatagagctgctggctcacagccacttgtcttgagacatctcactgtcaaagcatgactctcaatacatgaaatatacagtgggcatcaaactatattcccagcttttaagataacatgattttctccttttctatgttttactaatttttattaaaaagtatgtttacttttacaatagaaaaaaaaaagtcagttaagaagaatgcctgctatgctgtggttaatctaaagttaattacttctctgccacctactcctttgtttataaaggactctattgtaggtgctggaagcataagtaggtgtgaccgtcaggttcctatacactaaatctaaatttgctgcctactcactggcattttgtggcttttgtaccttttcttcaagcctccttctggacacagtttatccaatggctggtatcatgtgggtttgtcagtctttatagctcatttgggattgcttcttttggtagttctgtgttttggaactctaggcctctgcttttgttttcttttccttcaaatagtcattgaagtccagagtgttggcagtgacctttgaaaatgtttttacagcttacagagacttcctgacatgttttattagctcttggtggtagctaataaagtgagtcttagcaaagccgtgtaacatgacagattagagccacttccaaaataaccactcaccagagttatcttgaaggaggcttgacgacaggatatttggctaccgctttctgtccagttcagcagggcatgtgtgattacctcttgaagaagggaggtcattcctttaggaaatacagtgaccaacttatgatgaaagaaccacaaacactgagagccccctgcaccagtaaaacagagatgtgattgctgtagggattgattaatgagttattccacaaaacttttgcctcctaccttcac

SEQ ID NO: 132825 - DNA, 1032 bp, Homo sapiens
tttgtgggagtcagaaatgaatcaaagaccatgagaggctgccggagagcaccatccctgcagcacaggaaagaaaagcctggggctcggttgccaatcccttgtggcctcagcagttcctctaagcttccctaattgtactaaaaaggtgtgcctggcagaggatgtggagaatgaaagtaccaggtcaaggagtagtgatgtcaccttaaatccagagagattgatcagacagggtgaaatgtttaagcaacagctctgggaagcccttagaaggcaagtggcaccctcagcagaccatcagggaactctgttggagcaaagggcctccatagaacttcgttgcattcgctcctgagctgcaggcactgatctgtctgcctcagacactaacttagatcttctaaccctcagcacatccttgctcctcctctctgatacctagtttcagagtaaccattagagacaccatctgtgcttttacctggtgatagtgcttatcctttgaggggcaaccttgaaactcagtattatggaacttccaagttcgtgaccttgaatggtaactttgaaactaggcaatcttccaccagcaccactggtgggctggcccaagctctccgtctatgcaacagccacagcatccatctgagtactccttttcccagattctcagtctccagtgcccagcccagcttcctcctcctgccactaactgacacagtgaactaagacacagtaagacaatgagccattgtcttagttctagtttctctgtttgtttcctctgtttaattgttttagaatctatttttctcttagctatttatcattttgaattgctctgagtgtgattagaatatttttaggatggttttgtcccctttcttttcctttctatgacttctgagatcagatttcagctgttgtctgtgtgagacactattattgctcattctgcatatactacctccctgatggagatatttccaaatatcacacttttccatgtggggctatgcagctggctgg

SEQ ID NO: 132826 - DNA, 1048 bp, Homo sapiens
agtgaaaagagactactaaaaataaaagctttactactatgacaatactgaatagaacttttacatttgcagattattccagtatctcaaatggcaataaccctgtgattgaattattactgcctctacaacacagggaaagaaattcagcacatagagaaaaaaaaaagaaatcttacagaattgtaaaagaagagggagcttctatctggttgaatgatcaaaataggttttatggaaatgactggaagtgaaaccttggatctactactcttttctgtgaccattttaataatagatagccttcttccctttaattaaacttttatttagcagtgcaagtttctggtttatttttctgaacatggtagttgatcgtctgatgtcttttgcttctgtgaagcacactgcctaatggatgttggactgtttctaaagttacttttcttcccaggccaatattcatttattccagcatatgctagaggtgttgggggagtttgtaacatgccttgggtctcttgctacacagagttgtgtttatccgtcatgttgatcagttgtatacaatttttaatgggaaaagcatgactttactgaccttttctgaacaaataaatttacttaagtctgcttgtgtcatttggaaaagaatgttctttctcttcttctctgggactgcctccagtgttttgcatttcagaatcccagaagttcccagcttcacacatccccagtcacctgactccacaactttaaaagcagactggaaggggacctgaaagaagatagagtggagacacagagttctgtggctgtcagtcatcagtgttgtaccttggtctcaaggaatatttacatcactggtcctcatgttatctccatagtagttgattcttgctgccacttaaggtcaagctctccctcccaagaaaggctttgtctttctagaagatgcctaaggctgtcctttttgtgggattggactccctctgaatcttgtgaagaaatatccaagaagattcatctgtctccttccctgtctcca

SEQ ID NO: 132827 - DNA, 2172 bp, Homo sapiens
acatttatcagctgttccctttttggatttttttaatgtccatcagctagattatattcgtcatattcatcaatgaccagtaataaatggattgcttataaataaataaatgtgctaacagagctatggccccttgattagcacaatgtccaataaagataggaaagttgtcattagtaggacttgaaaattaccaaaaaggacgaaattcaatgaatacctttataattatataatagtcccaaataggtcagagtttagaacattagaactattttactttttcctctagtggtctctgagattctaagaggtcttaatgccaagaagggcacaactgtagcccatttcccacagagcaaataatttattttcttaaaaaacatagatcatattaactatctactttctaaagtgcagtatcttcccactacaaccagaataaaatcttaaatccttaccttggcctactggaccctttgtgaggaggcccctggctacttttgccatctcctctttcaggatttccccttgcctgctggacttcagccaccctaggcttttttatgcttctcaaaacacactccccccacccccaggtcttccccccactcccagctcttccccctactccctttccccgagcctttgcgcgttctgttccttgtgtctggaaagcttggccctggatttttgcatagctggctgctctttcttcatattcagatccccgctcaaatttctccttcctttgggaggactcctctaaccatccaatataatgtgacctagatcccttctgtttctattagataacccgcctaatttccttaatattattttcactctgaagttgtttgtcatgtatatttattcatttatattaatcataacagagataagaagatcaataattccttactaaaaagtcaaataaaatgcaaatcatcataacaagtctgaagcattgccattttctgtggacacaattgcctgcaagcagttgtctaattcaacttgtatttacttactatgtacccaacagtacagtagtaacttcgggaggccaatcagacagtcagcaaatatttgttgactgtttcacacatgccagacagtgagctaatgtgcgaaacactggaacacagtgggaaacaaaacgtgcatgaccttgtcctcatgaacttaaaagcaaatagtagagtaagacctacagaggatggaagctccatgagtgtaggaatctcttccactcagtgttgcaacccagtgcctagatagtgccaggcacatgaaagtgctttgtataagttgatgaatgaacaagtgaaagaaataattacaagtgtgaaaagtttaacagaggaaaatgcagtgtgccaatatacaaagtacaagctcacatacaaatattaccaaacatacacaaagtctctaataggagccccttagaaatgatactttaggtgagaccagaagggtaaatgggactcagcaaggtagaaaggataggatggtggtacggggtctgggtagcggggtagaacaacagctacaaaggtcctgacgtgagaaaactgaggcatccctgaaggactaaaagaaggaaagtgtgagtactgtgcaatgagtgaggctggagtgacatgtgaggaagtcacagagggagcagggccttggaagtcttagaaagaactctggtcttggctgggtatggtggctcacacctttaatcccagcactttgggaggccaagtcaggtggatcacttgaggtcaggagttcaagaccagcctggccaacatggtgaaaccctgtctctactaaaaaatacaaaaattagctgggcacggtagtgggtgcctgtaatttcagctactggggaggctgaggcagaagaatcacttgaactcaggaggtggaggtggcagtgagtagagatagcgccactgcactccagcctgggagataagagtgaaactccttctcaaaaataaataaataaacaaacaaataaataaaagaactctgttctttattctagggttataggaagcctctgaaggcagatgagtgacatgttaagacttgaatgttaaaagaattgctctggccacagactggggaggggcaaggatggatgcccagtgtcatggagaaaaaataattttt

SEQ ID NO: 132828 - DNA, 1074 bp, Homo sapiens
tatcaaaaccctgatggtgagtcttgaaatcagagtgcccagcccttggggcaactcaaggtgggtgtatgagaatagaagacggtccagggtatggtctctaagatgattaagaaattgaaaagtaggggttcctgattggactaacttgaattcttcaggaagagggaaaaagtgaaaagctgtaaaatcataaagggaagatggcaaatatggttgggtattttccccaactaaatcctgatatttaagaatacctttcgcagtttgagaaggttcagtgatagaccagtaaaagaaaggaagaaatcgtttatgtatgtttggaaacttaaaaacttgttactttcagtgtggtatagactacaaataatagagtacaggatgaataatgtaatagagatctggactacagtcccagagtgagctattgggagagttgatgtatatttggtggcacgttcctgactgttgagcttggtgtcaaatacccttaagcttcaagatgcagtgggaagactagacataaggactggccctgctgcttttcagttgtgtcacgcagggcagtagttctcaaagtgggtcctagaccagcagcatcaggatcccttgggaacttattagaaatgcagttataggcttcaccctatatttagtgaatcaaaaattctggaagtggcccagaaatctgtgttttaaagctctgtaggtaattctgattcaagctagagtttgagacccacttgtctggggcgagcaaattctgcctgagccttatttttcagatatataaaataatgatactaacacttatcccacagggctgttactttgaaaaaattatttacttgagacattgtggttatggtagcagatgagacaggcccagacctcatggaacttacatttcagtcaggaaaacaggccccatgccagatggtgcaatgaaaggagctaacgtggagaactagcacaaaagtgctgagagagctcaaagtcaaactgggctggcaaagcaacaatataatattataacaagagccggaagccactgccaccttaggcttgcat

SEQ ID NO: 132829 - DNA, 1028 bp, Homo sapiens
tatggaccacttacatttattttgtggactccagtggtacacataccacatgctggggaacactgacttggtgaaatattaggtgtgattgtgttggctttcttaggactagatgtcagactcactcacttatcttgataagattattattttttggttaactgactaaagttacatggactctgatgcagttactggtatttatatctgaggattaagaaattccagtgtgagaattcatagatttgtttggggatcaaacaaactgggggttcaaattctgaggagaaagagatcctgaaattctcctccctcttctaatcataggttgttaattccaggctgtgctgtttactttaacccttgcgtatcttctggatacactgggacacttgaaatgcaaattagtttgtttgctttgtgctacaggctaaaacacttcaaaaggaaggaccagtcagtcttctctgcctcttacatttcttcatgatgctggtcattagatttttccatgcactttcagactgaatttagaatttagtgttttatgccgtaggctgaataggaatccgcaatctcctatgtccactgttgtagctccagtgcctaacataatgccctgccaccttgtagacactcaggaaatatttgtggaatgatggaataaatacttgtgctattagaaagtatgatttaaaagccctgagatggttggagtacaaaaaacgtatttgaaacacactgttgaaatcacctctagattggggtaggatgtgtccccacatagcacctggaaagttgagaagggcgtgtatggaagtaattaagtttataccagaaaaaaaatgtatacattgattgacgcagtatgtacatcttgaaatattcggcacacaaaccagtttgtcaggatcttggtgttgctttggcttgtccagttccctcatacttctctctctcctaccccttcttaacaggaaggaggtaggttgtatgtcagggcaaatcccccagttcacagcatagga

SEQ ID NO: 132830 - DNA, 1126 bp, Homo sapiens
ctttatttcagaaaacattttttaaaactctgtcttttgttccatggactgtcagtaggtaatgtttcaaaccataccaaacaaatcccactcttttcttttactctttccattctttctcaccactaagtgtcctcttctgaatgatgatgaatcattataggtttttgctgaaaacacctgtgcattcatctattgtagctgttgctgctgctacagtgtataaggttacaggtaatgctttcattttggcactatttacttacacatttgatgctagaatgtctgcactgatgaccaaaacaataagcctgtgaaacagcaagaatgcaattcaaacgaccattgaagagctagaagatgagcagaatagtcctgtgacagacttctgtacggttacacctatttgtactaacttcatctgtgttcagaaataatgtgagcattctaagctctgaaaccatgcatatctttgaagattaaaatgaggcagcaaggtttctcccaactaatgtaacaaaatgcagtgatatgacagctcaaagttgaggagttgaattcgttggggaaaaaaatagcaaagctgcttctcaggcaggaatctcttccattctggggttgtcctgtgggcaaagatggcacctactaagtaggcataaggtaaacagtgcataagggctgatggaattgcatcttaggcacatcctttattggatcctggaaaggtcagacgatgttcattttatgatacacacatacatacacccctctaaaataaaaacccaatctactttaattcaatatttgggaagtgggaggacgattccaaggactattccagctataaagagaacaatatagtgggaaaatgagaaatcagactggtcattctttgattctgaagaggtggaatttcagataacacagaggaatggagcagctcatttgaaagaaaagttgagctgaagtcttgtcctttcaggaggcagacttgttacttcagggtatcccagcggcctcagtgagttggcagtgagcttacagattgacatagagtccccaaataactgaagacaggagatccactttggttcctcttttgtggtttcactgtgatgtaaaatgt

SEQ ID NO: 132831 - DNA, 1027 bp, Homo sapiens
tcattagggtagagccctcataaccaaactatcttccaaaggtcccaccttttaatgccatcacattggaggttagaatttgaacacatgtagtctattgcactgtggctgctatcaggttagatgccccatttgaaagattagactgtcttggcagcttcccaaatgaatgccaaggtgccttctttccccttctgcttgtgagcaaggtggggtgtgtgtggaactggggagagtgcatgacctctgatgaagctgagggaatgtcttgatggggtccatcaccaacatcccctgtttggggctgacctcttggttggagaaggtgctagattccttcccacactgccccttgctttctattgtcaggtccctgtgttgccccagaggcccatggccctccttgatgtggattagtttagcgactagctctcagggcaacaggtccctctctgcttgtccagcttggacagcttctctttcctgggcaccgtgaaggccaggatcctgcctcctgcctgtgccctcctgtgagcctggtgctctaggagcgtggctctccaaacagggagtgactcctctgtgtcccagcacgaccccaccctccccctttgcctccctcagacactgggcagattgtactcacatttcacaagattactccgctagatgagaaaaacgtgtactttattcaggacagcgagctcagctctctggattgcattccttgcagaaatgagaatccaagtgtagtggcctttcaaagctgaaataaatcagggctccttggccatactacccttgtctgtcagtttttgtctttttctagaagccatgcaaggttagggaaaattaagggagagcaaatgaggaccagttcattgtgtaatcacttaaaatctctgagttggaatagctatctgtgatttaaaacataaatgtttgcaaatggtttgtatcttgatcagttatgtaaagacgtgcatttgagatgcaccaaagtgacttttagatgcttctttttaaa

SEQ ID NO: 132832 - DNA, 1064 bp, Homo sapiens
aataaatttctgttctgtgtaaattagtctgtgttattctgttatagcagcgtaaaacaggttaaaatacccccatttttgagcagcaacttaattaggtatagaatattagtttgacaggtttttttattaccactttgaatgtcatttcattatcatctggcctctgtattattgatgaaaagtccaccaccaatctaattgccattattaagtttgtaatttatctttttctctctggttgcttgtatgactttctctttggtgctagtgttctgccatttaccgctgtgtgtgtgtgtgtgtgtgtgtgtgtgtgtgtgtgtgtgtgtctttttaatcctgcttgggacttgtaattttctaaatcaagaacatatgtattgctttaatgctattaaattctcagcttttatcatttcagtattgccactctcacataacctactccttctccagaacttcaattaaatgtgttttatttccccaatttactctctgtgtttataacctctctttcacattttttgatcccttttttctttctctgctccattcagaacacttctttagacccatctttcatgatggtaattctcttttcagctgtatctaatatgcaatttaacatgtttttctcatctttaagaattcaaattagttctttttttcaaagttgccctttgttcataaaggatggttcttttattatggtttttattccttcttttatgttaaaaaaaacttttaaacgtaattagcttatagatcctgtcagattattctcttactgtaagttcttagaggtgctaattcttctgctcattgtgtacgtggcttctccttctgactggcttcattctttgtgggtttattcagcaggaattgtttattctgagggagtcttgtaggtcctgagttatgaaaatatttctacagaacaatttgagtttgcttcttccctggttctgggaacatttttatagtgatctattagttcaagatacttacacagcctaaacaatgtaaatttgtgcaacacacttgtgcatgacataggcttg

SEQ ID NO: 132833 - DNA, 1039 bp, Homo sapiens
ttatgaaatgcaggtaacaattctcacttggggcatccctgcccctcaaagatgcaggaagaacttggcctgaaccccaatgcttggcatcataagctcgttatgggccctcaccctgccctggcactccttagtggctctgtcacctggactcaaacccttatcccctacaagaaatccagtggaaagcagcattttccagagtctgtagcttttttgaagatttcattcatgaagggcgagcagcagcaaatggaccactcagctgtgacacaccctctgccatttccccctacgtcgcttcacatcctattaataccagctctctttgcaccctcctgctgtacatgggaccaggtcttttaagattttctgaggccttagttcctcttctgcccacgagcataccaaacataacaacgtgcacccacacctcacattaaatataatctgtgcagcaagcgatgaaaagcacctttataattgggcctttgaaatcatttgactgtaagtatgtcattcaatttatgattagctctgttttctcaggagctatgcagtcaagaattcttaaaaagaaagtcagcttaacttactaattgttttcatgcacaagaaaatatttttaaaatattttgaaacaaaatgttattgaaatttgttagatttaacaatgaaagaagtaccatatattggccgggcgcggtggctcacgcctgtaatcccagcactttgggaggccgaggcgggcggatcacaaagtcaggagatcaagatcattctggctaacacggtgaaaccccgtttctattaaaaatacaaaaaattagccaggtgtggcagcgggcgcctgtagtcccagctactcgggaggctgaggcgggagaatggcgtgaacccgggaggcggagcttgcagtgagccaagatggcgccactacactccagcctgggcgacagagcaagactccgtctcaaaaaaaaaaaaaaaaaaaaaaaaagtaccgtatatttgtagacatttacttaaacatttggta

SEQ ID NO: 132834 - DNA, 1023 bp, Homo sapiens
gggctgacaccatgttttagaattgctgatcttaacacttaggctaaaacctggataaaaagagattcctgcctactttcctgtgacattctctttagaaagactgaagatactcccatctgtaagaatttagtttgggcatcctggtggattgagggcttggaggccacatgacaaaagcttttcatctggaggaccaagtctgacccttcagtagtggctgcctggagaggctgtgttaagaaagattctgaagccagaaaagcttctgtctccttagctgatggctgccctggccgtgttcctggggaggaaagggacacctgatgtgtacttggccatctcaggacattagtcttcacacaacagtcctcagttggctgatgggtgtttttgtgcttaaacactatatccaatgcatacctttaatctggtttggggtatactgtagtttgtgagttattcagaggtaaaatgctaagtacaggatgacaagttgaagaggtagctgtccagtccctagacttcacagaaagagtgaaagataaattaaatcctaaaataagtatatgaatagggaagaggtatttggaattagtattaagtattatttggtttgatattgtgtgggagacctagatcaatgactccaggtcctaaagtgctggacctgaggatataaagattgctgtggttttgaaatggagaattcgctcattgtctcttttgatctgaaaacaggcagtgaagtatgtaagtagagcatgcagcactatgcttagcaaatcatgactagaaactggagatctgtcacatttgtagggagaaggatcgtgtatatatggaagaaataagagaggcaaattgatggcaaaaaaagggaaggacaaacagggtcagattctagtctttgccctttttgttgagagtgagtgtttttttcctgaaagagcatcaaggactacacaggtaaaacttgaactgtaatatttaaaattccttttgcctaataacttctctttt

SEQ ID NO: 132835 - DNA, 1041 bp, Homo sapiens
aatgagcattaagaaaactaaaagcatctgtattagtcactcaacaattttgctggcttttctgtagacttagacggtggcatggtacactggagagtggcagatctgtggcatgtggatgatcattctttccataatgccacggcagacatcgccaactgacgacagcactcagtcttgctctgcccataccttgctttctccagttgttccagacagatcaactggaactggagctgtttgctttcccaggagtagtggaaggattagcattttaggagaccttggttctattctaatgaagtgtttgaccttggaaaacagcctcaatgggccctattttcttcaatatttagactgggtgatttactgtattgttttaagcataacattaatgttgtttctctgtctacaaatcgctgtctggggacaaacttaatttaaagtcagcatagtcttttgcctgcctgtctgagactccctttgatttcccacttgcatttattaggggtatctgacaccttatctcactcgtttttttgtgtgtgagttaatattttaatatacttcaatttattttatttagttttagaaaaatagccttcaaaatgaaaaaaattagttttaatttcttgcctttggtgatgtaggccccctgagtttattttttctggaagtgcttcagccatgttcccagggaaactgcctcttcactcttctccaaatcctgccaggacttcttgaatggtccctacacgtggattcctcagcttctggagaagcttctgtcttaatggatgaaaaagactctgaacaacccttgcgtttttttaatgtgatactttataaaaccttttcagtttagatcttgttatggtttattatttgtggagtatcagtatttagtacagagatttcaagaaactcagtcaaaagacagtatgttttagcccaaaggcattattctcatatcagtggaatactttcttcaggaacttgtccataggattttgatatcctgagtacgtatcacagagaaag

SEQ ID NO: 132836 - DNA, 1079 bp, Homo sapiens
ctagcctttcttgtgtcacagaaaaactaaataaatgaaatgaattttctatactttaaggttgaaacatagaaaattcaaccttcagcaatatttttattaaacttttggcatctctgatggtttacttagagtagaacctagtttataatgataccttagttttagattatttagttattttatgagttagtgcctgagtctcggacttggcacacagtaattcgatttattatttttataaataatctcataatgttctgcaaaaatctcaggacttccagatgcttcagacaccagctactgtaaaaaacatccaaaattataggatggcctaaacatgatagaagcattcctcatgtgtacccagctcaaaaccagggtacttgagctgcagttgggtctcttataagcagtggtcagggacatagaccctttccctcttgtggccccgccatcttccatgtggtttcctttatcaggcttgcaggatttatctttgtcaggctggagcaaaggggcaggagcatggaggagtgtgcatgggaaggttatatggttaggcttagagggacacacaacactgtcagtcccattccattggctggaacttagtcacatggccacagctaagtgcgagggatgccaggaaatgtagtcaggtgcccaggaaggagagggaatagtttggtgaacagttagcccatctctgatctatttagaaaaacaatctagcaatcaaaatgcattgagactggtataagttagatcagggggttgggctggcataatggggcacattatagatgcccaatagagattaaaagaaaaaaaatccttctggagaggattggagttgtcagccataggcagctttctagtgatttcttttctgaaagagtagaagtactgttgaaatgaaggatttaaattcttttcaaggctacataaataagaagctaaatgattaatttgctattttttttaaaaaaaacatactttccttggaagaaatctatttggtaggatggtaccgtcatttgctttctttaaaaagcagagcccatggagcttctttc

SEQ ID NO: 132837 - DNA, 1037 bp, Homo sapiens
cctctagaggaatagttccagatataggaatctaaggaagcaacttgtggtctttttttttttttttttttttttgagcttgtggtcttattctgcgttgagttgactttattttctctgaaagagcttcttcataaattggatgtcttaaaattaaaaaccaggatagccttatgcctccaaatattatagctaattaaatactgggctatcctcttggaattatcaattttgcataattgagtatttttcctttaagagtagaactcaccatgtggaaagagccatatgaatggtcccagagttaaagcttctttatattcccaggagagatgtacttcaggagaaactgggattgccctatatacatccctgccagaatcactcattgctaaatgtgataatacggtttctcatggatggttccagttgttgggtcaaataattcagaaagtatctactgcatgtttattccatccatccacccacccaccatccatccatccatccatccatccatccatccatccatccatctgtttatccatcctttcatctccaaggagatgatgcctgacacaggtagtaaaaaagaatagggaaacttcatgtcctcatagtgtgtcccagtcttcaaacaataacaaaattaccaggctttataagtgctatgaaggaaataaacagggcaagaaggtaactcggggaggtgatggatgagctaagacctgaagggtgaagagcagtcaactgtgtacaaagctggaagggagcattttggacagagggaacagcaagttcacaggccctgatgggaagagctcgggatatttaagggatacaaaggagattagttgggctggagtgaagggaatggagaggttggtactaggataggttgggactggcagggcacagcaagccatgatagagttccagttttattctaagaccagttaaaacgtatgaaagagtttcaaacaagagagtggtatgatatgatgtgtgcttgaaggagatccctttgggggccttgt

SEQ ID NO: 132838 - DNA, 1048 bp, Homo sapiens
tatggagaggacaaagtcagatgtcggggaaaattaagggaattaacagagtggtagatggcaacttaggtgtccatttaatgtcctatactacttctggtgcattctccttgggattccccgaggctggtcagatcatgagcactttcgtacctctactctagtgatgtcacacagttttgtatttcttggttgattcatatgtcttcccctccagaagaaaaatgtgtctttcttagttttgtatctgtggcacttcttacacagtaaatgttagtttaatcaaaaactgccgtgtgacttcttatagttctcaaatctgattcagtaataacctgtataggcaaaactgctgagaagttctaagaccattcctctccaccacccccttttgctgcttttttgtacatgatgctccctgtagctgtcatttaattttatcaaccttagaggggctctttggacaaactaatatccagttgtcttttccagcccaactgaagattatgcacgtagtaacttcccacccagaaataatttgagctgttggaaaagaatccctgataaaaagaaatgtagcatgatggaataagtatctcagtaaataaacgtgtaccatcagtaaaacctactctctgttttaggatgaccagaacagcctccatccatatcctcatttcagtgttgatttccctgggtccttttgagcccgaatggggcttttacttctgaggatgttagtaagaatttcagatggcaggcatgaaaaatggatgtcacctaccagaataatccttctctttactcagtgaatagatgtggatttttttcctagatcacatccaagagtggctgtaattgggaagaaatgatgagcgtgcagtgggtgatggacagaaatgtcctcttgtcttgggtaaacattttaaaaggagttggcgttgtggagatgaagacagtgtcttcttttaattaccatcagcttgcatgtggtcataaggtttcttgacatttctgaagaacaaagaaaggtattatgatagaaaaa

SEQ ID NO: 132839 - DNA, 1008 bp, Homo sapiens
ttcattgtttttctgaaattcagatttaactgggtgtctttattttatctgacaaccctatccaccatgcaagctcccactgacctctcacagcagagctcagacgtgacatcccctgcagagagccattcctctgctactcttcctcctcctgcagagttacatttgattgcatttctctatgctggctttacatgtgcacatacccgtaacaagtgtacatggcaaagaggtcacctgtcatactaaaacaaaataatactgacacacacaaacatacacacacttgtacactcacatataatcactctgattagaagcattattgaatgatcagtcactggtcatacctctgttctgtaaagccagaggtattgaatgtatctcaaaaatataatcagaaaattgaaaacaatgacagtgtaaggaaacattttgactcctaaattcgtctggcataactgctgagtttgtcatcagtaggctatgcactgacatgctaacatggtttccatgatatctgttcttatttccctggcatggcttgagatcgtttatacatgttcaggctttcctcagagggagggctggttagcaggggctgctctgttgtttatggaattgtgtggtgtctatgtggattatgagattaactgtaatggacaaggcagaatttggcaaaatggagatgagacatttcagtctagacgatatagctgtgattcagctgaggggcatttggcatctactgataagatttattgctctccatgaaaagacaagtttcgaatcaggacgagagtaacacattgatcatccatattactcaattcttgaaagtacattgttccatttgtagggtcattaggcgattgagcccagtagagagcccaggaaaaggaagccttgtgtccaggcctagcggtacttcccatggggcatgcagaggatggtcatcacaaggttgtgtgcagctattttatcctcagacaaacgcagtcacctctg

SEQ ID NO: 132840 - DNA, 1051 bp, Homo sapiens
tggtgcagtttaggcagtatttttaaacttttgcttgattgcttgattattatatcttcttgcctggtggttctggattctgtaaaggcttttgtttgctcctgtgtttgttgtgcactgaggaggtatgtgagtaggaagtcacccatttagctaagtgaattcctagctggaccaatgttactgtggtaatgatggctatctattgtttatggtttttactttgtttgaccaaataaccttcctctgattatggttaaagcaaatggattcttttctccaggaaaataaaatggattgtcattttaaaaaggtagcttattatatcttctcaagaaaaaaaagatatacattaatttgcaattaagtcattgtaaaatggtaaatagccacagttccacaaacatggcagactttgattgaaaagttggcttaaaaagttcttgtctaaatcagttgactgcaccaaaggctaattgtgggtaagtgggatttcttaaaatcctggcttttaggaaaggtttcttacggaaaaaaatatatatatatatattattctatttgttccatctacataaattcttatttcatgggcagatttcttgggctgaccaaatttggaaaacattaagaaaacaagcccttttatatagcgttataaattgacacaaccttcctagagaggaaagtggtgatatggatcaaaagccttaaaaatgtacataatatttgactcagcgattgatcctctaggaactgattccccagaaataatgatgatgcccttaaagacttagctgtaaggaagtttgtcacagcaaaaaatggaaaacaattttaatgttcagcaataaatacttagttaagtaagccatcagtagaaaacatatatgtaagcactaaaaattatgtgtgggaatatatttggtcacttggatagatacactttgtagtttaaaaaacaagcttatatttgcatatagaggctgataccacttttgttaaatatagacatatgcatatatatatatatatatatatatatgaaaaa

SEQ ID NO: 132841 - DNA, 1053 bp, Homo sapiens
agatgttatcctttttcttttgattagatgtgatctttaaaaaagcatactgttctgacttctacccctgccacacattcagaaaatgtatattaactgaaagctcagctcggctttctcagccattctctttcctccaggatagcaaacacttggcaggactgcaaccataaatgactaaagtaattgacctcattccagtaaagttattagagagaacaggcaaagactttattagagaaagtcatgaaaaatagcaagtatatattttatgctcagtagcttgcatgtcctaactcctttacaagcttgtagtactatttttaatctggaacaactctgctgatagttatttttactaaatggtttgcactaactcattttattgtctgatccttctgctgatagcctgcatataccatgatccacaatttgttcttgttcttttaaacatctcttctaacttcttggctgaaatttgcctcacttttatcataagactttctttggctataacatttgggccctgcgcttggaataatcttgaatctgaacagtttggcagcatgctgttagtggcatgagcaggaaatggcttccaagggcagaaccaggtacatttcagatatatttcacccttttttggtgcatttgcgtagccacaatctctgttaattcttgcttgaaggtagatgattctgaaatggggtagatagaggtgcgagaggaagagaaaatccatgtcagctaggtggtgaattaatatagatgaagggccgtgctagaaaagtaaataatctaggtagtctggctgcaaagtaacttttaaaaagataaaagatattaaagtattatgtattattggaatagctagttaaattaactcacagaatgtagtcttctaactaggaaaatctaatgtaaaattgttccatattatgactctggacattttatttcaggcacatgaaaaacagtaaaagacagattctgtaccatacttttccacagcattttccatgcctttagatgtaggaatcaaacaatatacat

SEQ ID NO: 132842 - DNA, 1119 bp, Homo sapiens
ccgggcgggcggcgaggtttggggcgcacctgggcgcgggtgcaagaaggtgcgggaggcggcggaccggtcttctgcccgccggccacgggcttccggggctggagtcctcttcagacccctgccggcgcctgggtttctggccggctcctcgtgtgcacttcccggcaggaacaagggtcgcccactttccaccccgggatcttgatttgtccttgatttgaaaagatataaatcaataagatcgtccttctttcggggtgcaagactccgagcccatccccagccgcggacgcctgcagggtgcgtgttgggctgtgggtggcgggaagacaaacttttacaaaagtgcgcctgggctgggggacaacgcttgggcgtcctgatcctgagggaggagtctcggcttggggcagcgtaggggaagtccgcaccgtcagccaggtcgcccccggggctgacgatgcctcacggaggtggggagcgtgtaaaggccgtacaaatcgcgcttaactttggggccaacaactgtcaaacatctggaatcccagcccctccctttccctgaactggggaagaaggtgaaaacccttcaagttttctttgattgccccttcccaccttcagacccctgctgggagggtaaagcgccgacccctggtgcctggcaagtaccagagactctaaatctctcgggatcccccccctcgcgctctttcctgaccctctcccctaaccctccccacagagatctctctacgcagccgactgagatcgtggcgaatggccttttgtttctccgcgtttcccctattgtttgcctttccaacatctggcggggcttggggagagaaggaagcccctctggtccccctccccggcccccacgccagctccggcaggggatcccagctgggaaagtggaggagcccgaccccagcgaggccgccccaccccgcccttgtggttagagggcggagggaaagttgttccttccccgcctccgctgctgcctgtggcccagggcgcatttctcagatctcagcccaggcgcgccgcaaaggctcaaatccgagaaggtgctgctttcgagacagtggaagcgcgttccgccccaat

SEQ ID NO: 132843 - DNA, 1068 bp, Homo sapiens
cagctcctgaactctgacctttttatgccttagttccactttcacaaaaagggattgatgtaatgtgcatttcagaggaaacgactatagacatttagtgtcattataaatgttgagaagtatgctggcagaaattatgccttaagatcatatatggattcttgtatggtttgaaattgcttaaaagatatatatgatctctaaaatgtgtgtgtatatatatatgatgtcttcttatatatctatatgtgatatatttatatatatataaatctgtgtatatcacatatataaatttgctgttatttgaattgccattacctcagtgcttaggggaagccatgcacgtttgtttcttttcagtacccagagttaattaacataagttatcacagaagctcccataagcattgagacaatttctctatacctgtgactatttaaggttttgaaaacaaaacagaagcaggtaaggaggaagtacgctttactattgaagatttattaggtacacatttagatttgtgaactcacattgcttaggatgaaagggactcttgaggatgtctgctgtttgttagtgaactgcctgtaacaattacaattagcacacacatgagcacaatgaactgggtagtcagactcagccaaaatgaatagaaatagcctcttaccaaatttactttgagtagcccttggactctgagcactgctgcccagagcaatatgactgtaggtccaagtttgtcaatgactatgcaaatgtgctttcttcgcttttactctattgtcatctgtctattacaatgttgctatggtgacacctttccaatatccctgtgcttctttggtatcctctaaggggaagctgtaatgaagtggcttggcaaaagaatcctcttggaattttttttttttcatatgctactgaaaaccagcatgattttcctcttatgggaaatgtataaagtatgagttggaaatgatggaaattaatctgtactgacttgggcaaggaatgtgaatgttattcattctgttccaaactacctgaaaatattctctttc

SEQ ID NO: 132844 - DNA, 1105 bp, Homo sapiens
ctgcactttagcctggtgacagagctagactccgtctcaaaaaaaaaaaaaaatatcagattgttcctacacctagtgcttctataccacactcctgttagggggcatcagtggaaatggttaaggagatgtttagtgtgtattgtctgccaagcactgtcaacactgtcatagaaacttctgtacgagtagaatgtgagcaaattatgtgttgaaatggttcctctccctgcaggtctttcagctgaaacctggcttatctctcagaagtactttccttgcacagtttctacttgtccttcacagaaaagccttgacactaataaaatatatagaagacgatacgtgagtaaaactcctacacggaagaaaaacctttgtacattgtttttttgttttgtttcctttgtacattttctatatcataatttttgcgcttcttttttttttttttttttttttttttccattatttttaggcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaa

SEQ ID NO: 132845 - DNA, 1136 bp, Homo sapiens
ataaaatacctaggaatccagctaaccagggaggtgaaagatctctatgagaattacaaaacactgctgaaagaaatcagagatgacacaaacaaatggaaatgttcttttttaacaccttgctttatctaattcacttatgatgaagatactcattcagtggaacaggtataataagtccactcgattaaatataagccttattctctttccagagcccaagaaggggcactatcagtgcccagtcaataatgacgaaatgctaatatttttcccctttacggtttctttcttctgtagtgtggtacactcgtttcttaagataaggaaacttgaactaccttcctgtttgcttctacacatacccattctctttttttgccactctggtcaggtataggatgatccctaccactttcagttaaaaactcctcctcttactaaatgttctcttaccctctggcctgagtagaacctagggaaaatggaagagaaaaagatgaaagggaggtggggcctgggaagggaataagtagtcctgtttgtttgtgtgtttgctttagcacctgctatatcctaggtgctgtgttaggcacacattattttaagtggccattatattactactactcactctggtcgttgccaaggtaggtagtactttcttggatagttggttcatgttacttacagatggtgggcttgttgaggcaaacccagtggataatcatcggagtgtgttctctaatctcactcaaatttttcttcacattttttggtttgttttggtttttgatggtagtggcttatttttgttgctggtttgttttttgtttttttttgagatggcaagaattggtagttttatttattaattgcctaagggtctctactttttttaaaagatgagagtagtaaaatagattgatagatacatacatacccttactggggactgcttatattctttagagaaaaaattacatattagcctgacaaacaccagtaaaatgtaaatatatccttgagtaaataaatgaatgtatattttgtgtctccaaatatatatatctatattcttacaaatgtgtttatatgtaatatcaatttataagaacttaaaatgttggctcaag

SEQ ID NO: 132846 - DNA, 1032 bp, Homo sapiens
gaagctataaaagttgcatggtcaaataagtctgagaaagtctgcagatgatataattcacctgaagagtcacagtatgtagccaaatgttaaaggttttgagatgccatacagtaaatttaccaagcattttctaaatttatttgaccacagaatccctattttaagcaacaactgttacatcccatggattccaggtgactaaagaatacttatttcttaggatatgttttattgataataacaattaaaatttcagatatctttcataagcaaatcagtggtctttttacttcatgttttaatgctaaaatattttcttttatagatagtcagaacattatgcctttttctgactccagcagagagaaaatgctccaggttatgtgaagcagaatcatcatttaaatatgagtcagggctctttgtacaaggcctgctaaaggtatagtttctagttatcacaagtgaaaccacttttctaaaatcatttttgagactctttatagacaaatcttaaatattagcatttaatgtatctcatattgacatgcccagagactgacttcctttacacagttctgcacatagactatatgtcttatggatttatagttagtatcatcagtgaaacaccatagaataccctttgtgttccaggtgggtccctgttcctacatgtctagcctcaggacttttttttttttaacacatgcttaaatcaggttgcacatcaaaaataagatcatttctttttaactaaatagatttgaattttattgaaaaaaaattttaaacatctttaagaagcttataggatttaagcaattcctatgtatgtgtactaaaatatatatatttctatatataatatatattagaaaaaaattgtatttttcttttatttgagtctactgtcaaggagcaaaacagagaaatgtaaattagcaattatttataatacttaaagggaagaaagttgttcaccttgttgaatctattattgttatttcaattatagtcccaagacgt

SEQ ID NO: 132847 - DNA, 1010 bp, Homo sapiens
acaattcaacccacaagtgtcagtctctagctgagcctttcccttcctgtttttctcctttttagttgctatgggttaggggccaaatctccagtcatactagaattgcacatggactggatatttgggaatactgcgggtctattctatgagctttagtatgtaacatttaatatcagtgtaaagaagcccttttttaagttatttctttgaatttctaaatgtatgccctgaatataagtaacaagttaccatgtcttgtaaaatgatcatatcaacaaacatttaatgtgcacctactgtgctagttgaatgtctttatcctgataggagataacaggattccacatctttgacttaagaggacaaaccaaatatgtctaaatcatttggggttttgatggatatctttaaattgctgaacctaatcattggtttcatatgtcattgtttagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggtaagtgatttttcagcttattaatcatgttaacctatctgttgaaagcttattttctggtacatat

SEQ ID NO: 132848 - DNA, 1089 bp, Homo sapiens
tggcctcactcgagatatggaaatccagacacatatggtccatgtttcctggctccacatttcccacagaaggtccactcctctcgcctgcattcactctggcttcctgcctacagttgatcttcatcccatctgtgatttttttctatcaggagaacaaatggagagaggttaagaatcgaaaagaagaaaggaaaaagaggagagattgattttccttaaagaagacctggtcctatttctgaaatgtctcctactttgaaaaccagtgtacatcagctagcatcctaaaggaacctcagttctcaggacctcaaatcaagagagagagtctacaggatcatgagccagactgcctgggccaccgtctttctgcaccatgagatagggacatttgtttatcacttccagttccatttgcccagtacctgagctgtcaatatttcagtcttttatgctcccagtagaggccaatgccttggcacactcacccccattcaccacattcccaattctctctcactcgttcttttccctgggccatttcctgtctcttatgcctctattgtccttcatcctcagataatacagatctccacagtctcattctgtccaaaaccctggccgaatcatattccactacattaaacctctgcctatcttccctaagtcagaaaacataactagagatgccagttcctgctggtggctgtcaggctggcagcaagttctggccagaggcaagcaactgctgggccaggaggtagggactggcttgtctaagaaccgttctctgttcacaaagcaacactgtaagagcttctatttcttttttcatcagaatgactttattttctgatttaaataaaaaagacaagaagaaatgaaaaacaaagagggtgtggagaaagaaattctcttaaaaagtgaaggtgttataactagatagtctcaaatttcccttcctctttgttccttgatggccacagtgaagcatataaaggggaaggaatccactaaaataaatgtatccctctatttctgtttctagcactgtaagtgcaggctgtggacaggtaagaatgtctg

SEQ ID NO: 132849 - DNA, 1050 bp, Homo sapiens
tcattcagtctctagtatgcaatgtatttcttccgatttgtatggtattgtcatcattactttgtagaagcacttcagattttaaaattgggctgctcattgtaaaattataagagcactcatttgataaataggaaaatattgagaaaataaattaaaggatcattaaatttgtattcctttgtagggtactatttttgtgtcaataaatggcaagtgtctaagactgaaaggaaatacatattatccaagggaggaaaatgttttatgtaaatatcagataaaataatacgtttctactaatagtgataaatataattgtataatacattgaacttttacaataatttatttttctagctctctccggtccgtgcctcgaagatgacaaagaaaagaaggaacaacggtcgtgccaaaaagggccgcggccacgtgcagcctattcgctgcactaactgtgcccgatgtgtgcccaaggacaaggccattaagaaattggtcattcgaaacatagtggaggccacagcagtcagggacatttctgaagcaagcgtcttcgatgcctacgtgcttcccaagctgtatgtgaagctgcattactgtgtgagttgtgcaatccacagcaaagtagtcaggaatcgatctcatgaagcccgcaaggaccgaacacccccaccccgatttagacctgctggtgctgccccacgtcccccaccaaagcccttgtaaggagctgagttcttaaagactgaaggcagactattctctggagaaaaataaaatggaaattgtacttaatattgcatgttaagtgtatctgtgccagatagggtggggattttgtgtgttagaccaagtataaagtgacacatattattttcatggggaagaaagcttattcatgtaatttcatttttttcttttttgttttctttttttttttttttttttgagacggagtctctgtcgccccggctgaagtgcagtggcgtgatctcagctcactgcaacctccgtctcccggattcaagtgattcttctgcctca

SEQ ID NO: 132850 - DNA, 1173 bp, Homo sapiens
tctctgggtctcagtgtctttgactttaaaatgaggagttaggccattgatagtaagtgtcccaaggagccagtggtttcagagctggtttatactagcatttgtgcatatctcttcctaactccgtgttcagtggcaacacattttttagattgaaataagccatggtgggaataataacaccatggaaattggcaaatgctacatcagagcttttttttcctcttggagttcaagttgttaaacctttgccagctgacactgctattgtctgagccaaggtgcttttggtttgtttttttagtagaaaacagactctttagcctagacaaagatcctagatatagggtgtatgattcaagtcctctaaaatttttgataaggaaaaaaatctgttttcatcatattctaaaatatagatcagcaaactttttgtgtaaagggacaggtagtgaaatattttaggctttttgggttatggttatacagtttctattgcagctactcagctctggtgttgaagcacgaaagcggcaatagacaacatgcaaacaaacaagcatggctgtgttccagtcaaacttgatttacaaaaacaagggccagccatagtttgcagactcctgacctagactatcagaacaagaaccatgtttcaaagagagagttttatggaaaaggagattcttcaggactttatgcgtgaataccagaaacttgagtctccaagatggacgtagcgggcagtagtaactgtagaggatttggaatcaatcatggaagactccatagtaggttgtttaaaggaaggccaagtgtgttgaagttttgaggacagagccacatatgggtcttattcccaactccctccctggagccatctcagatgttatgctagaatggatgtacctgcagtctaacccgttgtgtgaattttgcatattattatgcaaaaactagtagtgtctctaagagctgtcttgattccaggggcagagacaaaggaaatgttaaaaaggatggaaaggcccaggcaccgtggcttacgcctgtaatcccagcactttgagagtccagatcgcttgagcccaggagttcaagaccaacctgggcaacatgacaaaaccccatctctaccaaaaatacagaaaaaaattaaagccaggtgtgatg

SEQ ID NO: 132851 - DNA, 1054 bp, Homo sapiens
aaagcctttcttgaatcccacttgtagctgtctctttcctttgacttttcttataaccctcatcctattgtatttgtgtgcttatcttagtctccttgtcagattgcagtcttcaaataagagaaggaatgtgtgcctatcttcttttcctctatggtatttagcaatgcgtaatacaaagaagatactcaagaaatacatgctaaaataatttgaattgattaagttcactggagaaaaattttgagtataaaagaaatccatcacattaaaagaaaaattttcaaatatgacctaggaccaagaacattttctttcatctgtttggattttaaaagattttaaagaatcatggtgaaaagagtcttaaatttgagccatgaaaagagtcttaaattcgagccaatataaaaacgtagctttctaaaaagaaaatgtttttaatgatcttttgtcattttttcacaaatatatctggagcctgtgggtcttctctaatcatacaatgcatcccctcacctccccccaccaggcgaaagacctgaaaaaatacaactgaataatattgggtcacttgtattggataagagtgattcttgactatattttaaatacttgttttagaatgtatatttaaatcttcagtaaaagaaacaggctacatttagagcttaccataggtaagtcaatagcaatctcatgaattatggtagctcacggggatatagttcccagaatatgcagtgctttcgtgtgttacctcatttaattatcctagcagcccttgtcatctgggcagagcagtgcagacagacattgttacctaaaatctgcaaagaagtaaactaaggtttaagaatatagaagaaatcttgtcctcagcagcaagtggcagagactgactttaagaatcaattggaaaccaagagtctttgggattagatgttgcaaatatgtgaagacgcaaaagcatctaagcatgtctttgggagacggaacaggttcttgtgccccttaatgccatagacctattgaaacaatatcacactctctg

SEQ ID NO: 132852 - DNA, 1071 bp, Homo sapiens
tatgaatgaatccacaccagtcccttcccatagacaacatagaaaggcccaggtcccagaagtatcaaggtctaatgctgctttagtatttgtcactccttcaacccagtgaaatagagcagctgtgccattgtgggagtcactgggatggaaccagctgcttcagagctgggctctggagtctgatggacttgggtttgcgttccagttccctctctcagcacgcctgcatctggcttcagatttgtagcttctaacatccttctatcctgctgcggggaaggaatgtgctgatcagaaataggagcatcaggtcctcctgacagttgcctttcttaggtaaaatcagtaaatatatgggtttgcatattgagctctgagaattttattagcatgagtcataatccccgagttcagtcagccctgatgagaccaggttggtgaggtggctgggtatagttggcctcagacacttggcgaattcacagaggtaaagatggcccagaagacctctgacagccagacacccaatctcttgtggtgatggcctttctttctaattcctaattcctaaagtttgagttagaaaagttcattgccacaatctgcgaaatgagttcaggagcctgaggaaatcatgctgctttcttaaagattggatctcaactggacctgctttgtaatacttttttttgaaagtacagctgtcttcacccactacttctcctcctcttaaaacataaatgcaggctgggtgtggtggctcacacctataaccccagcaatttgggaggccgagatgggcggatcacttgaggtcagaagtttgagaccagcctggccaacatggggaaaccccgtctctactaaaaatacaaaaattagccaggcgtggtggtgggcacctgtaatcccagcgactccagaggctgaggccagagaatcacttgaacctggggggcagaggttgcagtgagccgagattacgccactgcattccagcctgggtgacagagtgagaccctgtctcaaaaaacaaaccaaaaaaccaaaaaacttagatgcagtagg

SEQ ID NO: 132853 - DNA, 1119 bp, Homo sapiens
agaatttacttccttcatatagtgaaactagacagttatctagcttccaaggaaaaagggaggcaaatggtagtgcactttaaaacaagccattttctccaagagccaccatattggtcactatatccatcccaaaaataccaactgactttgtagggtggtgggagtagcaggaatcatgtgaggcttcttgtgttatgccccagacatttgtagctacagggaagtaaattgacacatttggtccccactgcataatggcagataataagtacaagttaacaactggtttaatccaaaaattttgggagacttggggcatctggctcctttaggattcgacacagagataaggatgattcagacacttaaggccattgaaagaggtgaatgacccatcttgctcagtcccgtgagcgtttcccaccacttcccctgcctgcagagactctggcctctgttgagatagtcttctgtttttccaggcaggcaaaacagcagttttattgttgcagttgctactgtttgagggtgaaaaaggtaagtctggggagtatagcatgggtgacaaatgaaagggagagtagcactgttgcctttttaaatatattcagaatttcagccagtggaattattagtttcattttctgagcccacagatttgtaaacttctccttctgcagataagctagcaggtttcttatttatagggctttcccctctcctgattggctgctcattgagttagaattagtcacaaatctcttgaatttgtgtggcactttatcctatatgcactctcacctcaaaaactaaagccaccatcttccctccaaaagcagtcctaatagccttcaattctccatgcctggagttaaaccttatttcttctccccatagatttccccccattcacccagcagccattttctctaaattttgcctcttcagcttttaatccctccgccccttttttccatttcagtttctgccatgcacttgcccgcctggttacctgccacctctggtcgaatagggcccacaggtgtgtttggttttgccatcatgccacagatccacacagtttagaaaaaattagttgccaacttttataagcca

SEQ ID NO: 132854 - DNA, 1493 bp, Homo sapiens
gtcagagatgctttccttttttaaaaaaattaaatccatttagcagatctattatgtgccagtatttattccagaaacagattatagtttagaaggggagagaaattagtgaacacacagctttcatgcagttgataagtgtagtcaccacagagaaggggcaaatcatcctgacctggggagtctgtgggtttttcaaggagcgtcacctgatctggatcctgagcctgtttaccaaggagagaagagctgaaaaagaccttccactcagagcaaatagagcatgcaaaggcacgaggaaagtgggggtgggaagagcatgctggctacagtgtagctgaagctgagagcttggactggaggctaggagagggcttataaaggatggctgaggtcaggttgaaggacttaggtttttaagacaaggaatttttactttataagaaaatgggaagccattggtagattcagactggtgcatgatgatttatattttagaaatgattgaggtgaccataccaaaggtagattgaatggcctcacagggcagctggttgggaggctatttctggaataaatatcttgatagctataggtactaagtggtgggaaaagagctcattagatatggacagacagggaagaggaacagatttaggaaagaaagcccagcatcagggtttgacccattgagttgatggtgcctgaagtattcttggtgcgcatgcccgaaacacactggaaacatagatctggacgtagagacaggtgggaactggagtgatggagccctcagcatactattaagaaggtcgagatgagtaccttgaggagcagctgtgtctcgtccagagggtccacagagtctgctgatgccggtgtcggtgcaggtgtcctgccttgttctgctatcccggggtccctcctttctctccctcttttgctcttctcgaacatgtacacacacaaatagacactcattcactcaggcagggatcagcagactttttctagaaagggccaatagcaaatactttaggctttgctggccacatgctgtctctgtcacatattcttccccccaacaccccagcctttaaaaatgtaaaaatcatccttcatttgagggccaagcatatatgggcattgggtcacatttggcccatgggctgggttgtagaccccagcccatgttaggcagtctcaggaattgatcctacctattaaagcaaccaacacttgtcttggagaatattcatatcaagagaaaaaaaatctgtgtggtaaccaaatatgttttctttttttttttttttgagatggcgtcttgctttgtcgcccaagttggagtgcagtggcgcgatcttggctcactgcaacctccacctcccaggttcaagtgattctcctgcctcagcctctcgagtagctgggattacaggcgcctgccaccatgcccggctaatttttatatttttagcagagatggggtt

SEQ ID NO: 132855 - DNA, 1081 bp, Homo sapiens
acttcctaagacagagcacccagtgttccagtagcagtctctgtatctgccaaagtccagcagatcctccacttcaagatatatctgaacactcgatttttacttcttggctgaccgttccttgccagccagcacacagctgatatagtttcagaaagggctccttcaatgatgattttcatccaaataaaacataattagaaagatgattttccctctaaaaaaaaaattaaaaactcattttgtaatatattcctaaatggttttacatttatctctttaaaaaaaaagtaagcaaatctctttcttcatttccttgcctagctttgagtttactgcatatatctaaatgaccgttggccagggagcctttagatttctgtttggcagcagaaacagcagatagcgccaacatgaagggagcgtggtcaggtggtggcaggaaatgcagactgaagaaaatcaggctcttttctgaagtgtgcctggcacctagagcaggcagcctcccacactgcatctgtgtttaccatttcacaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtgagggagagttttcttttgcaccattgcttttgttgaattgtatccctcatgtatcttgctgtgtcaccttgtaacagatgtgagattatctgatgatatctaattgcatagtcgtttatcagttggtagttagacttaaacccttacattccatctaaagagagccctcttgccctctagggcacctaccatgaatggagtttgcaggactggaagttgctttggttgagtcagtgaatgagtggagagtgaatgtgaaggcctaggacattaccacacactactgttgactttataaacactggacacttaggccacactaacttaataaaaaaaagtttctttcttcaataatgtaaaccgtagcttacttttattttacaaacttttaagtttattgaa

SEQ ID NO: 132856 - DNA, 1035 bp, Homo sapiens
acacagccaccctagtaatcacctggacttaaacctagtagagtctgagggactgtcccaggagaccatccccagagcccaccatagtgaaccttatacccataaaaaccagggacattgtccctgaaactgatgatctagaagttggtgctctcctgggtgggtcactgtgggaagggatgcagtagaagtgaggattccagttgtccttagcatctgaggagttctagggatgtgaagagagagaatgtcatttgcagctgcgttactgttgcttttgaggggatattgccagtattttaccttttcttcaagagtaagatatgaatgttttgagtaaattcaccttacttttcttggcctctttgataaaaactagaacactagaattttctgtgcattggtgtggaactgtcctctgattcaggtccatgggccaccatcgtagagactgatctggtaacttgtttgggaaaacctgggccaatgctgactttttgtattctttgctagactttggatcttcagccccctaaatctatagtggatgcctatgtgctgctaaatttgggagattcggtaacaactgaccacatctccccagctggaaatattgcaagaaacagtcctgctgctcgctacttaactaacagagggtaagtatgaatgaggcaggaaggactaaaggcaaaaatggaggaatggagttaatgaggccagcatttctcttttcacctggccctttggaatgagactctttggttgtgcactgaggcttaaccctggggtaaaaaccaattgcattttctgtttgctgcttaacagcttccatgggagaaacgatcaacatgtgaatcctaacaaggggaaggggagagggaccttcatttgagcaagtgtatatattaggcccaactgtcatccctgcccccggcttggctgatctttaaagtacaaggctctgctcttaacctggggcagaggcagaacctgacacgcattgccaggtcctggttgagaaacctaacgtttaca

SEQ ID NO: 132857 - DNA, 1016 bp, Homo sapiens
caagctcgagcatcccaggtcaacctcagactgctgtgctagcagcaagaatttcaagccagtggatcttagctttctgggctccttgtgggtgggacccaccaagccaggcactggagggaatctcctggtctgctggttgtgaaggccatgggaaaagcgcagtatctgggccagagtgcactgttcctcctggtacagtctctcatggcttcccttggctaggagaggaagtttcctgaccctttgtgcttcccaggtgaggtgacgccccaccccacttgagcgcatcctccatgggctgcacccactgtccaaccagtcccaatgagatgaaccgggtacctcagttggaaatgcagaaatcactcgccttctgtgtcagtctcactgggagctgcagactggagctgttcctattcggccatcatgccagctctctcacaaagtcttttgtaaacctgtgtatccaaagaaaagattggaagtatgtctaaactactgtctttattcatcagggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaaggtaagctggagcctctctatgccaggccctgtcgaaaggggccccctcgtttgtaaccagtcttgttagaaggaaattagtgaggtttagaaggcaaaaaatatcactcaggaggactgcattagacttaggaggcctactagcatcttttctacctgccttcatagcataggatgatgcctatggatttaatttctctgtttattcacagagttatcctcagttccattcttacctcccaccccctactgtaccctgttcccggtctctcgtgatgagagctcagggatgtgacatttcacattacctaaa

SEQ ID NO: 132858 - DNA, 1008 bp, Homo sapiens
gaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgtt

SEQ ID NO: 132859 - DNA, 1815 bp, Homo sapiens
ggtggctacagttttgttcactaacataaactctactttgattcttacaatgatgctgctcacttgcctggcattgactgatatatttatggaagaataattccaacttggattgaagctttgccagtcaacatgtaaacctttcatggtggtgctggtgggctgaagggccccctgtattcaagaagggatactccagagttgttctgccccacctggacttgactagtctcctaactattctttcctcctttttccttttcttcttaaaattccataagtacagctatcatattacttttcctgaaaaacagctcgatcgtgtcacttccttgtattgaaacaccagtggttccccaatttacttgatgctaaagagtttccaaaatccaacacctatttcattccaactttatttcccattcttcccttttgtgcattatccacttccgccaacctgacttcctcacttattgcttgttgacggaactgctcagatactgctactcttcattttacctcttcccctgcctccatatcacctgaccctaatcctcccagctggcaaaaatctctcttttgaacatataaagcctataaccttttatatctgtctttgtaatagcacttaaaattttccacctatgttttgctggttatgaagagatcttatttcctcattgtctagaaggttcttgaaggagggcctgtttactgctcatcttagagccatcacagtgtcatactgggggttcatgtaggtatctttaaagcagtgtttctgacagtacggctgtctaatcaccctgcattgttgagaccctgagaaagccagcctaaggtgggctcctagtttttccacatatttaacatgcaggtgcacacctgcatttgagtctttttttttttttttttttttttttttgagataggtcttgctctgtcacccaggctagagtgcagtggtgtaatcctagctcactgcagcttcaaactcctgggttcaagcaatcctgcctcatgagttcactctttaacagctcaactttcctgggaagtgggattcagtgaaccaaagttgaattttaggagtacctctatttgtttacctatttgcagattatatcagagctttaagtcaaaaacaccaactaaaatatttattttctaataggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaaggtaagtctacgttattcttccagcatctgaccataaataactatcagggaatgtgaggaggatggttggtatcttttatcatattgcttagagtgttatattacaacaaaaagtttatacttagtgaatattaaattcattctgtttttaaatgtcaatgaggttaaattatatttaatagtgctaataactgaagttatgttttcagatctaaaaggcaaattgagctaggatttctctagttgacagttcatctcgaggactatatcctaatactggaaaaaacagctgttcttagtctcttccttaaatctctctccaaagagtcctcagagaaaagctcctaggtcactgtgcaggtattggaatgtctttttatagctgtggacaatgatatacaccttggaatgggatgcctattcagatcaacctcttagtgtaatgaccttcatttcattgtaatttccgtaacacagaaacatgaaatca

SEQ ID NO: 132860 - DNA, 1039 bp, Homo sapiens
actagatgacttaagactatttcaggaggaatatcctgtttgcagagagtaagaaagaaaattaggccaggtgcagtggctcacgcctgtaatcccagcactttgggagaccgaggcaggcggatcacctgaggtcaggagtttgaaaccagcttgacaacatggtgaaaccctgtctctactaaaaatacaaaaattagccaggcgtgatggcacacgcctgtagtctcagctacttagcaggctgaggcaggagaatcgcttgaatccgggaggtggaggttgcggtgagccaagatcgtgccattgtactacagcctgggcatcagagcgagactctgcctcgaggaaaaaaaaaaagaaaaagaaaattagagggtgaggcctgtttataaccctaaatgactgaccatatgagacagtgaaaaacttttttttttttttttaacagaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcgggtacgttcctctttttaagagtcgtattctggtcacagcacctactgggagtggcaccgtggaagccaagataacatcaacttctcatcctgtcctcaagagctcacttaggaacctttccagaaagttcttatgaagcaaactccaaaagttgtcccattcaacatcatctcgatttcctttctgaaatttcatactgcaggcaacaggactgaaataaaggctcagattctatgccatgcctctagcattaactgacatggttggaaaaaattgggtgattgtgagagaacattattccagatacaagaccagtccagtgacagcatcttgaaagctcagcaagtggaaagttctgttgctatgtcctgaagcacacatttcttcacctttggtgacgccccatgctcagaaatccaggttctctggc

SEQ ID NO: 132861 - DNA, 1033 bp, Homo sapiens
aataaatttgatgtttacgtggcacatttaacttctttagtgattttataatttatttgatattattcttttacgtactcttttctctcttagtgacttaaaataatatatagtactataaattacaactagcttggatttattgatctcttactatgtgtcaggctctgtgctaaggacttgcctacagctattcttcttttggactcagggagaatttaatcagttgatgttctgatctagcatttcatctttgtggttccttatccacatcgtggttagtaatatggaatttctgtcatttcccaggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtatctccaaagtcagacgaatgcttcagaagagctataatcttcctaactcctattttcttactcttatggccacactgaagatgtccttctcaggtcccaagtccatattgtacaactcattatgaattttgtttcctttattcatttgttcacttagtaaatatgcattatgtgcctccatgtgccatacactgtgtgttagtaaaaacaaaaaaacgccctaccccagcaggaaagagttatatgaggggttgtggaaacattgtaccatttctcagacatctaatgattttgaatgctccttacaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagc

SEQ ID NO: 132862 - DNA, 4405 bp, Homo sapiens
tatttgagagctttactatgtagcaggtgccttttctaagggctttttacatcttcacaaaccctgtaaggcagattctgttatcactgacctgcagatgaaattaaagcacagagatactaactggcacatagtcacgctggtagtgtggaaccaggattcagtcttaggaaatctgacttcagagcttatgctttaagcactatattactatgctacagtgcccctttataaaataaaacaaaagtaatgggtcacttaagtattttcaccaaaataagtttcaaggtctttatttgcatttttgttgagactatttagtcattcctctattatcaggttactgatatatttctttcccttttacagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaagaatcagacattttcctatgcagtatttttttttaaagtttattttagtaaagttaaaatcttgaaagtagctaagggcataattatgtcataaatactgaacttcaggtgaacaaatactttatagttttaattattttctttgattttgaggagtatcttatttgctttctatcatcagtaaaaacagcatttaacttgctaaataaacatgaaaaacccttgtcatacttcttttacattggtagttctttcatataaagtggttatgttttatcttgttttagggatgataaaattacatctatgctgatgtaggattgccactgaacagtggagcttgagttaaatcttaattcagccttcagtttgcctttgccttgctactgtattcattctttattcagtagaaattgcagtgcctactatgtggcaggttctgcactaagttttggggtttttttttttgttgttgttgttgtt

SEQ ID NO: 132863 - DNA, 1387 bp, Homo sapiens
tgacttgttcatccatccatttactgcagctttcctcatgggttgctgattgtaggctggaagggggcagtgctgagatgagccacatagtgatttaagaggaaaacggagtagaccttttgataggtaattttcaagattatttaagataaattaagaaacagctgcccaagatttaagttaatagtggtgagagctttctgggttttgtccatgaaatgcaaagaaagctatacaatcagctaaaatcaatcatacttgtctggaatgagtggttttagaggcgaacggttcccagccaattctttttgctggaattggattaaatttgataggatctggataaatttgataggatctactgagatcctgtgacttttgtatcttcttttggagttgattaaatgcagttcagagaggtacagtgatttctttaaggtggcaagaggtaggaaccagtttatttttaatacttgggtgatctttctatttcatctattcgtgaaccctttttagtcactttgcctagaaatattaagtataataattatattaagtatgatgattattttgttgttataaactatcctctgtctggacccatataatcagttatgggtgatgagctaccgaaattcacttcgtgttcacgtaacatagagaacattgttgagttcttactgtgcatcaagcactgtgctaagggtttttatgaaatatgtcccgtcacacaaccaccttttcaattccattttagaattgagaaaacgtgagattttgagaaaaaacttcctccaggttacacacctactaagtggtggcgattctcagccttggctctgcagcaaaattaacatcactcccgcaaatgtaatcagcagatgattaaattttatatacagtgtatgccatagatgacttttgatttttattgatttattttttttgagacggagtcttgctctttcgcccaggctggagtgcagtggcgcagtctcggctcactgcaagctccgcctgccaggttcacgccattcccctgcctcagtctcccgactagctgggactacaggcgcccgtcgctacgcccagctaattttttgtatttttagtagagacggtttcaccgtgttagccaggatggtctcgatctcctgaccttgtgatccgctcacctcggcctcccaaagtgctgggattacaggcatgagccaccacgcccggccatagatgacttttgtagtaagtctaactttaattctacagagcagttatacttcgtttatatcattgtgcagtttttcaaatatccagtctcctgaaatgtagattcgagcttcctgattctttatctcccccatccattttccctagacgtgtgtccata

SEQ ID NO: 132864 - DNA, 1050 bp, Homo sapiens
ggagataggcgtacctccactggttttctttctagttgcaatgcaatattaatgcaggataaggtgctgtcgtgtccatttaaaagttaatttgaaaaacaatccacgttttaaatattacgtctggctctaaagctggaagaattaacgctttctcccccgctccctcccccacgcctccccgcatctgataccacacgatttagatggacgttcgcctgttcatctttgacgtaaaaataccacccactcttttatatgtgacaaatcgttgtgggaacccctgtaaatcgagccattcttcagaaacgtatagcgtaatgtatatctctaagaagaaatacgtgggacgcgttacccgccataatgtatcagtcaagcaacaagtgtttgttgagcgtgtctgatgttcttgaactgccgcgcgtgagatactaagccccgagcacggcagtttggtgggcgagcgtaccaggttcagctctagaatgtttggggcgctcacatttgaggcctgaggagtagaatctggcaacgggccgcttaggctctagacgttctttatacctcgcagttatcttaaaagagttttagtctagatttcagggagtgggaaggggaagagcggagaaaaacgtggtctgtttagggaggagtccaggccctgttttgttaggttgtcctgtttctccccagcctggaggggatccctctctgaagactttataggatactggttgggctctggtttgggatcccgttggactcctggtgttgcttccgggaggcgtacaacaggaggtgagagacttcaagtccatctaacaattcccctatctagacactaaagataatttcctaagtttccgcagagtttggtaaggttgaaacgacatcgaactagttctcgtgttttccgggtaagttaggggcgaacattcagtcagtgtccccagtggctgagtaccagtaacaagatggggagggtcgcgctgccctcctccggggtctggagcggcgggggaggggccgcatttgggccggtgcgct

SEQ ID NO: 132865 - DNA, 1042 bp, Homo sapiens
caaagcatatctttgtcatcacccaatttctgttcccttcattttatctgattcttcacaatttttatttatttagaactcaggatgtccagatgcctgcactttttcactgatacagatcttgcatgggctgatggaactgagccagttgtggtattttaaaggcttggtctggtgcagggtgttggatcccaggcagaatgagaagggcatgcattttgggaagtggcgtggcagagggagcagtggtgactgcgtagcctgaagtgttggagcacaaaagagtgaggagggcattcgtataccaagagaggggtgttagatcctcagtgggttgcaggggaggagggtgagcacatctgtttggggagcaacagtggcaacagcctagtataggatattggtacctgagcagagggaggaggacatctggaagaaggatggtatgaggcagtgaggcaagtggtaactcagagcaagatgtcagaacctgaatgaggtgaggcaggtattaatgctgggatgtggttgtggtgacaggagatgggttatatatagggagattggccaaatacaggcatacctcagagatatttcagaattggttgtagaacaatgcagttccaaaagtattctttggttctagaccaccaaaacgagttacacaaattttttggcttcctagtgcatataaaagttatgtttacactgtgctgtggtataagtgtgtaatagcagtgtaaaagaacgatgtatatgctttaatttaaaaatactttattgctgggccatgtgtggtggctcccacctgtagccctagcactttgagaggccaaggtaggaagattgcttgaggccagaagttcgaccggcttgggcaacatagtgagactccatgtttccaaaaaaaaagaaaaaaaaatagctggatgtagtggtccacacctataatcccagctactcaagaggctgagatgggaggattgcttgagcccaggatttcgaggctgcaataaactgtgattgtgccactgcactctgg

SEQ ID NO: 132866 - DNA, 1343 bp, Homo sapiens
gtcattccaaggtgggagaggcaagcaaataattttgaatctggccagcatattcactgaaacatttatgcttatccttcctcctcccagcatacaagttcttccttagcaaaacctccagtcctctaatttagcatactttcgtctaatctgtcactttcctcaggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtgagtgacagacctctccggtcccccccaacacatcccactgctgccggcagcctgaacactgaacgtccgctccctgcagccacaccaaggactgataacgctcagtgctctgggacactggccagtcccgagagtcctcctggagtctcgggaggcaggagtccaggaatatgtatggctttgagagaatcatgccttttactgtcaagtacagtggacgggggcgaattttaatacttaggttttccaggacgctgcacgtttggttctcttttgactgtagaaatcttccctcagaataataaccaaggactcgctagaattaaaattctgtgatttaagtatttgaggacacttgtctgacttttaagtgtgaggttctagagaccaagtaacacagtatccaaccaccagagggcacagccagcccctagctgatagtacagccccatgtgatccccgtaaaagacagggtcctgttggtatgccttgtgagtcacattcaagagctacctttctaaactaccgttctgtacttttaacacagtgtttcattaaaaaaatcgcattttgggctttgaagaaaatcactcattcaagaactttattttcaaggcctctgggtattttcttgaggactgttatggatgataaacatctcagaattgctttcagttacctgcaacacttactgatgacaggat

SEQ ID NO: 132867 - DNA, 1083 bp, Homo sapiens
ctgtattgatggagggcagaaagggtagttcttattatcctgcatctgccagccatgctctctgctgctcactggattcctctcttgccctgctctcaaaatctgttctcttctggcttctcttattgtcagtatgagtagtcagtcaccacatatttcccaatgcctagtgaagacatatttcacttctcagtctgttacctgctcattcatctgtttccagcaagtgcaaacagatgccccttggaacgcatagcatttaaaagtgggacctgcccataacaccatcatcatttgaggctccaggtttaggattttagatttatagctgactcttcgtgcacctgcatcagctccttcacagagacttgctgaactgcctttttgacctctctggctcacgttatattaacagcctcctcactaatctctgactctggatttctccatgctagactgcctacacacagctgttaagtgttctttggatgctgttgttttatcttactgtgaagctcaaaacctggcagttgtctcctcttgattatggtaaatgtaaacttttcagcctagtattctttcaacacctctgtctttttttgtgactctccgaggcagctcctctggttcagccaactaagtctgcttttaccccgacctatggcttgccattgccgaaatctgtgttgtcacttgtgctttttaaaatggaatggcccctcccactccatttcttctttatcagtccccttggctcctagccatctctaaccaggaggtttctggaagcctgtactggctaatacaggactttttacctccttagtactcatatactcgcactaatcttattcatttgaatttgcatctcctcagctgtcatttgctcactttgccttgcattgtcttgtctttgcagatggtaatgaaactgatttttaaaaatcgggtttcttttttctttgcttatggacatgaaacttgtgcagagggcatatgtgctgccttgactataggcaggtttccgggagaggcatgttagaggcttgagcactgataagagtctggagtctagagaggcaa

SEQ ID NO: 132868 - DNA, 1988 bp, Homo sapiens
aacccaaatgaaggagagaaggtgaatagtatctactcttaaacgtatctgaatagttctttgccagacgtatagtatttctattatggcctgaaatcgagtatctaatatagtaactatgatcacttctcggcctttttagctaagatcaagtgtaatgtagctaggtaacacttgttttttaaaaaatgaaattcactcctcttttctcaaacagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaagaagaatctagtctttgtgcagctaactaaagttagctgttggtcagagcagatctttgagaaatcacccattttaaatgcttgtttacatgttggtataatgttgcaaactgaccacaaattgcctctgatttatggtgtcgtgtttttttgttgtggttttttttttttttttcttgagacggagtttccctcttattgcccaggctggagagccatggcgtggtctcagctcacagcaacctccacctcccgggttcaagcgattctcctgcctcagcctcccaagtagctgggattacaggcatgtgccaccaaacccggctaattttgtatttttagtagagatggggtttcaccatgttggtcacgctggtcttgaactgcaaacctcaggtggtgatccacctgccttggcctcccagagtgctgggattacaggtgtgagccaccatgcccagccagtggtgtcgctttttttaaaatgagatttaaggggcctaaaaaatagccaacagagtggtagcaaatgactgcttccaaaaatcttagatattatcaaacaaattatgagaacaggccgcgtgctgtggctcattctgtaatcccagcactttgggaggccgaggtgggtggatcactgaggtcagggttcgagaccagcctggccaagatggtgaaaccccatctctacaaaactacagaattagctgggcgtggtggtgggcatctgcaatcccagctcctctggaggctgaggcaggagaatcgcttgaaccctggaggcagaggttgcagcgaacggaggtcacgccactgcactccagcctgggcaacaagagtgaatctctgtcacaaaaaacccaaaaaaatccaaaaattagccaggcatggtggtgcgtgcctgtaatcccagttactcaggagggctgaagcaggagagtcgcttgaacccgggaggtggaggttgcagtgagctgagatcgcccaattacactccagcctgagcaacacagcgagactcttgtctcaaaaaaaaaaaaaaaaaaaaaaaaagacaaagtatatagcaatataattttccaagccctttttacagatcttatttggtgttccctcactccccaaaggaatttgatggtaggtacagtggcctttttcaaatgggagtaagttaaagttcagaaacctaaaacttcttcaagctcatatagcaagccaacagagccagggctgaaaactggttcgttgcctgccatctatctattcttgtttcagctttattgtgtcaaaattatgtatttaatatgtttatcaggaaagtggcctatgggctctagaaatactgcttataggagtaaaatgttcaagagaaatcagtctcactttatttccagtatagtgtatacaaataagggctgatgagcagaaccagttttagaatgaatggccaagccattaaatttcactttgagcttcttaaggttcagaaagatttgggaaattgtttattcagtttttctttaaagatcttcaaggaaaggattatgtttttattaagatacttaaactccttaaaaagaaagtcc

SEQ ID NO: 132869 - DNA, 1035 bp, Homo sapiens
tcaagcaatccacctgtcttggcctcccaaagcactgggattataggtgtgtgccagtggcacgtggccagatccatatatttcttgctgtggaaaaatgtaagtttcaggttctgaggcattcagaaattttaatttttttttttttttgtttttttaaagagacagggtttcactatgttgcccaggctgttctcaaaactccagggctcaagggatcctcctgcctcagcctctcaaaatgcggggattacaggcatgagctacttgcacctggctgaaattttacttttttatcagattttagtaagccaattgttctcaagtattcttaaagtacattacagcttaccttaaattcgatgattaggcgacccttttcatatggtctacgataaattggcatgccttcatttagtacacacttgatatctccatgcttgacaatctgacctaaaaacattgaagccaagttcttccttaagtatggtcacatttttatgaggcagggaatataaagaacagagcactgtcctagctcattggcaggagtaaaacttacgtggcaaagcaatcctgttacctttcacttatgggttttccaagggctgacaagagagccaagaccttataacttcatctaagcccagagaaggatatgtaaccgagaaagaaaaacaatgggtttccctcagtgcctatactacactttgttaacaggagacaaggaaaatactagaatagaaaagagaagtttaagcttgcctagttcccatacctggatgagaggtgatgacgatggttcggttgtcaagagtagatattggcttctggaagccacacagtgcttcaacgagctgtatgtccatacacatgaaaaggtcttctcctcgtctgcataaaatatgacacatatttatatttttcaaatcacgaatcagtagatgtaccaaagcaggctgtttttttgtttaataaaagcaaagggtcttttacaaagacacccttttcttcccccattgtaaaaatcaagca

SEQ ID NO: 132870 - DNA, 1043 bp, Homo sapiens
atataaatatgtgtcatattttatgcagacgaggagaagaccttttcatgtgtatggacatacagctcgttgaagcactgtgtggcttccagaagccaatatctactcttgacaaccgaaccatcgtcatcacctctcatccaggtatgggaactaggcaagcttaaacttctcttttctattctagtattttccttgtctcctgttaacaaagtgtagtataggcactgagggaaacccattgtttttctttctcggttacatatccttctctgggcttagatgaagttataaggtcttggctctcttgtcagcccttggaaaacccataagtgaaaggtaacaggattgctttgccacgtaagttttactcctgccaatgagctaggacagtgctctgttctttatattccctgcctcataaaaatgtgaccatacttaaggaagaacttggcttcaatgtttttaggtcagattgtcaagcatggagatatcaagtgtgtactaaatgaaggcatgccaatttatcgtagaccatatgaaaagggtcgcctaatcatcgaatttaaggtaagctgtaatgtactttaagaatacttgagaacaattggcttactaaaatctgataaaaaagtaaaatttcagccaggtgcaagtagctcatgcctgtaatccccgcattttgagaggctgaggcaggaggatcccttgagccctggagttttgagaacagcctgggcaacatagtgaaaccctgtctctttaaaaaaacaaaaaaaaaaaaaaattaaaatttctgaatgcctcagaacctgaaacttacatttttccacagcaagaaatatatggatctggccacgtgccactggcacacacctataatcccagtgctttgggaggccaagacaggtggattgcttgagctcaggagttaaaggccagcctgggcaacatggcaaaaccccatctctacaaaaagtacaaaaattagccaggcatggtggcacacacctgtagtcccagctactcgggaggctgaggtg

SEQ ID NO: 132871 - DNA, 1480 bp, Homo sapiens
ctttgtttaaatatgtcgtaagaagggttaggctgttgcaggatgggttttggtattaaaaagtcagtttgctggatagaacaatggttgttaaagtgcagttttatttaatacaatcatttttaataaagcctgacttctggtcataatccttgaactctagttcagagtgtgctatgcactgtgcctttttagagcctgttctaacctgagattggcagattcacctaaatattacgtgtttacatgtgtttttctggggaaaatgggtccatgatactctaagggagctaatgatgaaatcagattgaacagtgaaagtttcttttgaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgctt

SEQ ID NO: 132872 - DNA, 1050 bp, Homo sapiens
ttcagattggtttctctcagcttggtttatgatgattttaatgtatcaatagagcaagcaaagtcttagagactgagtgtcatcctgtatggggaaagcttctcattctgttagaggaaactggagagcagacatccagaaagctttgagaaatactggtatattgatttagaaaattgttttttgtatggcaatgaaatttgcttaagggtaatatgtctctttagggcatgattggtgacgtgggatgtatgaattctaaatttttgtctgccacttagtttagattacttatctattgaatatttcccaggcaaggggagttagcacatgatgaacaggactggagatctaattacaaatgatagtaaaccaaagtgcaaaataacaacgtaaaaatgtcagtttaaaatgctgcacatggttgagctgctactaatcctgatgtttttttcttggggtgtggtgtgatctagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgagtattacttactaagttcatctaaagaaatatggtaggacttgtgtctttctgaactctgaagtatgtgccttttccagagctatcgatgtgaccctcagtataaaatatgttgttttaaaacatttagctccatgtcaaattcaagaagtaaaattaatgtcagctgctatgatgatccccaaatctcggtggcttaacactatataagtttgtttatttttattttattttattttattttgagagggagtctcactctgtcacccaggctggagtgcagtggtgtgatctcggctcactacaacctctgcctcctggtttcaagtgattctcctgcctcagcctcccaagtaactgggactacaggcacatgccaccactcctggctaattttttgtatctttagtggagacgg

SEQ ID NO: 132873 - DNA, 1165 bp, Homo sapiens
atgccaagtactacattgaatccttacaaaggaagtggtgtgcgggcattgtattagatattataagtaatctagagatgatttaaagcatacaggaggatgtgcataggttatatgcaaatacatcattttatgtgtgggacttgagtatccttggattttggtatctaaaggggatcctggaaccaattcctcacagataccgaaggaaaactgtatatggcagtgctgggtatttgattggacctaaaatcaagtaagaaacttttttcccctgaatcatttctattcttttttagtaaactgttaatattttaaaccctaaaactttagaaatttttatacctaaaaaaggtttataacttaaatttctgtgtggtagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcaggtgagtgttcagaacgtacccttgcacaggaactgtgggccattcccaaatcagcacttcctggtccaggcccaccctcccaataaccaaatttgggttcatttctctgtaaaccgtttaagctgtatttgtttttcagatttatttatagctccataaaacatctgtttggtatttcaaaagtgatctcctttcccctggatgtttgtatattaagcactttcatccttcggataaaggaagctcctatctgtctttaagcctccttcagaacctcactgaagattttaagataacagtgtttgtctgagttagggggatacagtgtagtatggattaccaactcaggacatctcccagctaccacgatctaaagtggaacactaataggagaaaggcagcagcagtgtcctcggtgtatttttaatcagaaaacctgcaaggttctcaaggaatctcacttttgtggactgtgaagtagcactgggggtgtcagaagcatcaagtttgaggacccaagccctaggtatgtatggtagtgctattggattattggcctggacacttggggatcttgctgaccatagagaagacccaggggctggtgtgtagtac

SEQ ID NO: 132874 - DNA, 1037 bp, Homo sapiens
tgtaatcttagcaactctgtctgggtgatccaataacatatttaaggtcacatacttggtaagtgatagatctgggactttagttcatatctgcttatgccctttctattgtaccaccctggcttgctgtataaaaatcaaaataactaactttttttttaaggggatggtctaatagccaatttgttgtggtttgtatttaatgctagaaatacatcctgggctacagaaattgcagaaatggtctctgctaagtgaacttagagtctatatttttgttttaataatttacaaggaaagagttttaagtttcaaaggattcagttaccattgtactatgtgaactagacatcatattcagctattagcgtgcatttttaatgctgtttcagtacattagtgagcattgcatcttgcttggctctgtgggctattaatagtaggacacttaacaaggtttttttaattcttttttttttttcaaataaaggtgtggaagattcagagtggacaatgtttaaggagatttgagagggcacacagtaagggtgtcacctgtctaagcttttctaaggatagcagtcagatccttagtgcttcttttgaccagacaattaggtaagtaaaaatcccaaaactgctctcacttgagtttgatataatgaggccatggagggaggtactagtgattccttacgcttttaccatgatgcttttaccatgatgatgtgatatggagagggaaggtatgtgagaccttatgtccccaaagtacaactgacacttgttgttgtgtcatttgagtttttacccagaagagacatttgaaagggggtagcagtgcttcatgtttctcagagtatggtcttatggacctacctgcatcataatcactttagagggtctgttatactctaaaggacccagctgagacccactgatctcaatctcctgctaacttgttttttagaggtctgtccctgaacagaagcttgtggtattactggcatattttcttccagcctctttctttgcaa

SEQ ID NO: 132875 - DNA, 1097 bp, Homo sapiens
tacacattatcacttcattaaatgaaggttgtgaaacactgatagaaagtttatttacaaaataatatagggaaacatacatttagtttgaaaaaatgagttttttccccctgagatacacaacaggaacatattaggccatactgagtgtgaaagtcacgctaacagtggctgattctagcaaaacattacagtctgagctaacaggattacttgttctaagtcccatgttaaaatagcttttgtcctttcctttggaaatatcaatctcacattcaaaaaactagcttcaacttagtgcctggacttaaaactaagtcagagaaaaatacatccacccagctccctgcgtccaggtacagaaatacccctccaatactctataatatgggccagctatgactttatgctagggcagggtttctcaaaaggttaaaaaaggaattgttttaagtccactagataaaaatgcatctgtttcattgtttcatttgaaacagtttggtcagaaatcacatgtggagtgtgctcgattttctccagatggtcagtatttggtcactgggtctgttgatggattcattgaagtatggaactttactactggaaaaatcagaaaggtaaagtattttaaatgtgttaaccttcctagtggaaaaattacctgctttgaattacttacctatggcctctaaatcagattagttgaaaaaggatctgtatgtaatgaacatgtattacttttgtaattaaaaaactcatttaaagctagggacagtggtgcacacctgtggtcctagctactgaggaggctgaggcaggaggatcacttagttgaacccaggagttcaacccagccggggcagcatagtgagaccgcgtctctaccaaaaaaaatttttttttaaattaaccatgcatgcttgtgtgcacctatagttttagctgcctgggaggctgaagtgggaggatccctcaagccaggagtttgaggttgcagtgagccatgattatgctactgcattctagcctgggcagcaacactgtctcaaaaacaaaaagcaaaaaacggtatgtttaattaaattccaatttta

SEQ ID NO: 132876 - DNA, 1156 bp, Homo sapiens
ggtgtgtttgagtgttagaactatgggagatctttgttttccaagttttgtttataacaaaagagccactcctgtaagaaaataggtggatgatagacttgttggctctcaggtccccttcacccttagatcagcctgtgttcttggacacacaggggagcacagattactttatgtttggatggccaaaaatagttggggtttagatggctcacagctttctctgaacctcatcctttcgggcttggtttctgagcacttatgaccagatcttaaaagcacctgaacagattgctatatttttttttttcctcataggcactgaagtggcagcagcatcagggattgcttcctcctggtatgaccatagatttgtttcgaggcaaggcagctgtcaaagatgtggaagaagaaaagtttcctacacaactgagcaggcatattaaggtaggatcctaagacattcagccagtcagtaatcatttgttgaggacttgtcatgggctcagccaggccctgtgccaggggcttggataattgagggggagaactcattctccagctctgacaatattcaaggttgctgcaggtgtccactgggatactgctgtggcctgggagtggtacacctcagatgtgtcatctaatggatggacatctagcttgacatctagcccaccatctgcccttgcacttcttcccaagaagcctgcatttggaagaatggttagttcttttttggttacacctgggactgtgaactttgtatgtacttcttctgtttaccatttttattttgcctgctatgtgtcaggcagagtgccagtgagggattacaaagtgggcttatgtgatgtttgaggaaaatgattttatcttcctatggtgtggttttttaaaattttttatttatttttatttttttaaatctgagagttttctaggaaaaagtgttctaggtaattcccagaattacaagtgtatttgctactttagcatctctatattacagtttctctggatttgtgctctaaattcctggattttaaaatatttcatattcctcaaatctttgactttgggttaacattttgggtttgccttttctggattatatattctaacttgcagataaagatatttttaagcagcacct

SEQ ID NO: 132877 - DNA, 1044 bp, Homo sapiens
ggaaatgatgctacaccctctcctttttcaggcatacccagatggaagtagcaaagaaaagagaagagcagcaattgcccaggccttagctggcgaagtcagtgtggtgcctccatctcgtctcatggcattgctgggacaggtaattcaattcctgtagaggccaggtgtggtggctcacacctgtcatccttgcactttgggaggctgaggcaggagaatcacttgagcctagtagttggagaccagcctaagcaacattgtgagactctgtctctacaaaaagtaaaaaaattagcgggttatggtggggtgtgcctgtggtctcagttacttgggaggctgaggtgggacaatcactggagcccagaagattgagatgacagctatgatcatgccattatactccagcttgggcaacagagtgagaccctgtctccaaaaataaaaataaatttaaaaagtgaactcctggtacaatttcctaatttcctatgtataaactatgtcttagctgaagaaattgtacaccctaagaattggggactacctacagagttgcttattccagtaactgtgctgttccactctccctctttcctgggagaggcaatatagattagtggttaagaacaagctctggagtcagttagaattagggttaccatagaatttatcatcctgtctggaatatcgttgagagtacagttgatccctatgccagaacaccaagtgcaaatagtaactgtcctggaaagattggaacaaatgcccatcctagttagaatccaggctttctcatttaccagctatatagtcttggcaaattacttaacttttctggtcccatttactcgtcacagtattgagagtaaggattaagagaaataatgttcataaacactttatacatttcctggcaccttgtaaatagtaaatggtagctgctggtgatgattttttaaaaaattactaatagtgttgccagcatggtcattattataaagctacttagagtaatagatatattataaataacaaagg

SEQ ID NO: 132878 - DNA, 1158 bp, Homo sapiens
cccatctttagctttctttggcatctacattctgagcaagaagcctgagaggaggggagattggtagataaaaatgaaggatagagtttgaaggattgaaattattatttatttatttattgagacagatctcgctctgtcgcccaggccagagtacagtagcatgagcttggctcactgcactctccgcctctcgggttcaagcaattctcctgcctcagcctcccaagtagctggaattacaggcatataccaccacacccagctaattttttttgtatttttagtagagagtctgtttcaccacgttggccaggctggtttcgaactgctgacctcaagtgatccgcccatcttggcctcccacagtgttaggattataggcatgagccaccaagcccaccaagtccacctgaaattgctagtgaaaatggaaaggggcacttcctggtattggaaatcctttgacaggccatatctgtgttagatattttaccgaaaaatattaataagacggtgtgttgaaacatctggggttttttttgtttttttttaattgtccaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggtatgactgtggtaatgaaaaggaactttttgttaactttggaaatgaaataacatgatcttttttttttttttttaccattttattgtatactctttgtgattttgatttaatttttgagaatgatgcttctctgtttatatatgttggctgaaatttgcgtatgttaaagagaataattttgttcagttttctgattatttgagtcttctatacacctcagtttagaggattgcgtgttggttagtaaaaaaagcagaacattttattctgatgtcatttccacattagccctccccgaagtgctgcctgactgctggtatgttcactgatcatttgtgtgtcttgcccctaacaattgtagtttccttctagcctttttagtccctagaagcttttgtttcttcgcggattatgcttaccagtagagcatgatgatag

SEQ ID NO: 132879 - DNA, 1080 bp, Homo sapiens
gggtctcacagctgcctgatctggtctcaaacctcctggtttccagccaatcctcctgcctcagcctcccaaattactgagattacagtcatgagccagcatgcccaacctcatttagattattttgtataaataactagtctagtcatttaaagtatttcagtgaagtgtgctacaatataattacaagaatgaataggaaactaggctctggattaggaaataagatagtcaccttgacaccaactccctttctagctgactgagacattaggcaaatgatttcctttccttgaaccccagttctgtctctatggttagggggggtccccttataatttagattctgtgattttggaaaattttactcacatgataaagaaatagtagtgaaaggaagatgattgagtaggagcttgataggctttatttttgacctctggtgagtgagaatccctgagctgaacgatttgttttctttcagtgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggtaagagtggtggtgatgctgatccccatgggttggttcgttgtgggccagctccccaactaaaaagcgtcagtgagcattccttcaagcacggtagggctgcatcagcccatacaacaatggcaaggcttgacattgtattttttctcccttcttggaaaatccaggatttcccaaattaaaattctttcctttttttgagactggatcttgttctgttacccactctggagtgcagtggcaagatcacagcttgctgcatcctccatttccaggatcaatccttcctcctgcctcagcctcctgagtagctaggaacacaggcacgcaccaccacgcctgcctaatttttgcatttttctgtagagacaggatctcaccataa

SEQ ID NO: 132880 - DNA, 3648 bp, Homo sapiens
tcggaatgtgagttttaaccagggtcatgctgggctgggttctggcatgatgctgggttgtgggctgagtgagaacagcaagggtgatggtggatggagcaacagtcttgcagccggggctctcaggccaagtgtatggcagctctgtgataatgactttccctttactctttgcagattagtttttagaggcatgtctatatctcgcccaaatgctgtggtcgggaggtgtcgcatgatccgccactcaagagacaagaaaaatgaacccaatcctcagaggtgcattctttgtttattcatactccttccccctttaggatgaggtaggctgcaggtccgaggctctgggcctagagggaaattgaggtggtcaggttacagtggagagggaggaggaagtacgtgtgatgatttcttcttaagatttttgttttaagacaatctccttgtgctcttttccttgtaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgcaggtggtttctgtttgccaggtgtaagggttgtcatggctgtgggatggggtggggacagggtcattccctggtctgtgacccatacaaatacacatgcctccctggaatcagacatttccccatctgaacttcattctcttatctgtaaaatgggaataataacacatagggacttttttgaggcttaaaagtgacgatatatgtaaaacaatgactaatgcctcacaa

SEQ ID NO: 132881 - DNA, 1044 bp, Homo sapiens
gggcacagaaaagcatacagagggtgtttcagcaaacattgccactggctgcagacctgcccccggatctgtcctgttgagagcttagtgctgcgttcttgcatggtggggaggggtgtggctctgtgatgagccagggcatgtgtataggagcaacagtgtctctcttatcacgtagaagttctgactcattgcgagtcttggctttgggttaatggttccagccatgttgctgctgtgtcttttggtgcaggagaggctgggcacagttggtccctaagccattatggataagggatgtgtctgctgatatacacacatggacctgacatccagggaaggcagggtgattggacagaacagttcttccagaagctgttggaacttggacaagagtggcccttggctttctgtagttggtcatctgtcccctgttgcaatcaggggaaggccacacttgccttccttaaccacagttaggattttcttggggattagaccagattctagcacctgtcctgaacctctcgccccgcccctacaaaggctgcttgcaagtgtagtgcacatacacagggagcaggtggggcatggaagtggaagtggagcccctgcctttggcccttgggggaggcactgtctgcttacccacggttgttgcctcataggaatcatacaacagcttcctaactggtctccttgccttcagttggattggggcacaaatccctccttgacatataaaccatggtttaaggctccctgtggcctaaataaagataaagcttaagtatcttaacaagcacctaacccttctccccagcctcggtgatttggctcatcgctgccttcatgtttcattctggcttcactcattcggaatttcttgtagttccttggctgttctcttttccttaccgcctttacaaatgctctcaccatgcatgcttttctctgctcctacagatgccttctctcccagcaccgcctccagagtctatgtctggtcgattctgtctgctgtctccagtccccatcttgtgg

SEQ ID NO: 132882 - DNA, 1122 bp, Homo sapiens
tcagggcatcagtgacactcctcatggccagggtgcccccagtgttgctcacagtctggtatccagggctgagagtgtgctgtgtgctcagactgcctgggttcagtcctggcactgccactttacagtcagtgacctcaggcaggttacttaagctctgcaggcctcagtttcctccttggtggggagggttatgaggcatccttctcatggtaaaccttcagtaaataccagccgttactaggagggtccactcctgcctctccactctccattcatcctgcctgtttcctctgcctgcttcctctgcctgcttctgtggtggtgaattcttcatggctcccaccgcctcctgctgcacccccactcagggcccgcatcaggacccttcctcctattggtttgaactccttggagtcagagggtaatggatagtggagtgagccaggtggcagaatctcagaggccatcccgggcctataagcctcttcaaaatagggccacgtatcaagctttacacacaggagtgaactttcacaagttgttatgactcatactctgtctatagtaagctgttaaccactcccatttggcttatgcctctgtaattattgtactaacttatatcttaaaataaggatattgaaggaatgagccgggagaggctttcctggttgagatatagaagaacaagagttgctctttttccttaaggtctctcctcccacccctgaccttagctcaccagcatgggagaatactatttgactccttgtactctgagacgtggatttcaagatatagcattccaacttcaacggcagcaagaaaagaagcaacagaaggagaagacatcatagcaaacagggatgcatgctgcatttcctaatactcaaacccggaaacgagacttcactcaaggtgaagggagggcaggtcaccacctggtagcactagccctaaattaaggaatgcagaatgtttgtgggattgcccatcataaaaattacaaaatgagtaaggaatgcaggcacagctggccaggtgggtttgtcacaaccatggcagccctttgccccacagccagtacacagaactggtctctccaattccgattgcata

SEQ ID NO: 132883 - DNA, 1038 bp, Homo sapiens
tggatgtggtgcctgatgctgggcaggagggccctctccgtggccacgttgcctcccaggaggagacatttcctctgcagctgcagctgcagcctggccatctgatgcagcctgtggagcggtggcgagtcctgtggcctgctaacttctccctccctccacctctctagtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggtgaggcctgggaaggtggaatgagagagggtgtgtgtgcatgcagatgtgtatcagatgtgtgtgtaatgagggcaggggaaggggagtgatttcacagacacctggcacttacagcgaggaaccagccccccagccaccaccagtgcagatgaggtaaacgccaaacagtgtgcttgcctattgctgtcaactctatagccaagggaaatgctggagtgttttcgttgttctgtttttgttttctggaagtagccttccagcaagattgggaaaaaagacaaccctaattattccaaagtacacactgattattccctggctttgtgtagctgtgtattttccttttaaaaataaaaccaccatttagatgtcagacttttaggtaacttcaaagtttatccagtcagtcagagcgtgtctcctggggcacctggagacagtgcccttagttcaggtcacatgcctacatgccagcccctggtgaaatatctggagaagtctgattcgtgggccatctgagagttatgtggactgggccgagtctgagaaaaagtttctcactgctcgtctgatccatatgtgttgggctttagccctgcttaggaaagtaatgctaaggataggtcaac

SEQ ID NO: 132884 - DNA, 1167 bp, Homo sapiens
atatttttttttctttttctttttgagacagggtttttgctctgtcacccaggctggagtgcagtgatcacggctcactgcagcctcgacctctcgggctaagcgattctcccacttcagtctcccgagttgctgggaccacaggtgcacaccgccatgcctgactaatttttgtattttttgtagagatggggttttgccatgttgcctaggctggtctcgaactccagagctcaagtgattcacctgccttggcctcccaaagcgctgggattataggtgtcagtcaccacacccagtgttatagctgttgtctttatagatgaacagatagattgacatagattcatgtagatagcctggtgttcagcatttttcatttaagattctgtcacagacttgaccctatacctttaaaaatcacaaaggcagtatcatagtctgtcagctgaatatgccataacttaaaaaaatcattcaactgttgctgaacacacacatatacatatatagtttttgttttttcttagtgatgtagtgatgcttgtgcagaaagctttatgtactttttggatggtttctgtaggagagctttctaaaaaaggaaaaaaagtgttgaatgttttttgagaagggctagattttcaagccagtcttacaaaaggatagactcattggaaattccagatttgcttagtgctggcagatgagtatcacttattgctgaacaatgtgtctagaattctgattaaaaaagaaactaggtccaggaagtgcctgggggcaggggcaaagggccaggctgcaggataggctcttaggatctggctgagcagaaatctgctgtgaacagaatcggtgggggtgatgctttctcagtaacttctccatttgtttctttagcagctaagtccctgtgctggacttctgtggactactgtggctctggggctgtggttgtgggtgaacaacagctagctaaaccagtgctgttgacatcattgagatgtgacgcacaggaaggtgggagcaagcttgcaaatcagattctgaaacatatagcacagctctcccacctccaggtggtcctgagatctagggaggagccatagtgagaaactttaggtttctaggaattctcttagggagaagctctcttagggagag

SEQ ID NO: 132885 - DNA, 1083 bp, Homo sapiens
tatgggttgggaattatggggcagttaatagcaaggcagtccaagctttccacagattccaccctagggaccatccagacttaaggaacagggccggcaggctcatcccctttgcactcagctgggctatgggtgtgtgtttgtgaaagaggtttattcagtagtcatacctgctgatttccctgctatctgtttacccagtgcctcctgtaccttgtttcttactctttgttctctgctcttactatgaagaagcagagactggaattctgcttgaacccacatctacctggaaattccagtttttcttgtccagtggagcagcaatccagttgttttaggacaaatggtctgcccttgaagcttaaatcctttgagggcctggcatggtgacagttttacatttggctttggtatagactggtgtggtccctgggcagtgaggtcactgtaaggccagccagccagaccctggctcctaggggaattaacaaggcatgggattagactcacagggtccctcctgtccctaaacttggtaggggttcctgggagccagactgcgattaagattgtagagacctgagacctgagttgtaggggcctctgtgttgatctgggccattgccgggtgagctgaggcggtcactagctcaaggagtgatctcaggatattgttctgtaagtcagagacctccaggttggagagtggggcttgggggtgggggacagggtttagtggggagctggttctgggtgaatgtggcctaaagggatttgtccttagaagacagaggggtgagtcacacactcagtgcttcaggttccactttgcggcttggcctcagcccgccccttccctgcacaaatgaaggccaggggctatataattggctgttgctgaattctttggcagtgattttaaagtctggtctgggtgtgttatgtagctgcttctctatccactccccacacccgctgcttctccagagcccctcacaaagcccaggcagagagagagagagagagagagagaatgacttgcctcacagagatgttggggatagggataggggtatgggt

SEQ ID NO: 132886 - DNA, 1142 bp, Homo sapiens
ctggtagggacctcgagtaatccactcccttttggggactgacgtgaggctcccggtggggaaggagactgacctctcggttcacgtgtcttgccatagagccactctcctgagtgggtttttctcctgatcgtttgggccaagtgacttctctctgaacctcatatttctcttctgggataataaatggtcaccctttcaaggggttgttttggaagatattgtgaacaatggtaaataagggcttaattaatgagggtaagccctcagtaaattgtcactgtgtgttcatttcttcctctgtgtggatcgtgaccgagagcccttccccctagcctcctcctggtatgggtacccaaaacctaggtgagcagggatctctcccaggggcagagagcttgtgtactctgggtgttagagggctaaaatataaccagtcaacaccacgttgcccatttctggtacttccggtagcagcctgagtctcaattatcttgcccagatgatctgaactctgacctctagcctgtttcagcataggcagagagcttgagtaggtgagtttgcattcctcatagcagctggctgagcctagtctggacttctctttgacctgtaacctacaggcccacaggcccaaggcaaccacaggttgcttccagggttaccacacaggtggtttctcatttctaatgctaggttttagataattgttgtaagtgaggggccctggcaggcaggatgacatcctgccaataggagttttctgtcactttcccacagagccctggctactacatactcttgctcaatttcgccagtaattgcgtcaatgtgttcatatcaagtttgggaagaacatcttggaattggtcagacgtgaactgtggtaataatgggggcttgtttttttaagcagataattaaattcctttgcatttgatgattattctgggaagcagactagtcccataaaatgaaatggactctgccttgctgctaagtgtctgacttgagacatgctatcgagtttctcaaaatctcttccttgtgtaaaatgtggttgtcgatgattaccttacaggggtttttttaagactaaatgagatcgtgtacattaaatacaggcactcaggctgggc

SEQ ID NO: 132887 - DNA, 1747 bp, Homo sapiens
cttctgttggccagggtgggtgtaaagaagcagcagcaggcacttttcctgtcacaatgagcccatggtgtggccagggcagagtatccatacataggaaacaataaaagaacaaagtctgtgttaaagatcagttcctatggcccagacattgagaacacagggagcttttatagggacaagagccatggaaaggccatacaggatacagacccagggaaagggttcctgaaaatggatatcacatttacattggtgacctgtgacctgttttgtgtactgtgggtgtttcttatgtgctctcatgtcattttcactgaggattatttgttacatgtttactatttactaacttgtattatcaacttactcttccatagatcctgccagaaaatttcaaagacagtagattgaaaaggaaaggcttggtaaaaaaggttcaggtgagttgtgtaatagtgcacgacaaggtgtaatatgttaatgtgtaggtatgtgtgtttatctgttcaaaatcaggtagtgtaggagcgtggtgtgtggtatgggcttgttttggttatatttatcagcaggaaccccaaacgtcagagaagagccacctgtgtccctgtaattatatttgaatttaaactatttagggagggaactcactggagagcaggtagggctgacacattacacaattccaggaggcagtattcatgcacacagtgcttcctgcgattgtgcagttgctgtgcagtggccctgaggcaaagctccctgcctttaccaccttttaggggattgctggcctagagcatggtcagaatgctggtcctatgctccctccctccccttaccttggaacccaggccagtggcccatctccattcatgcacaatctgttttgagtctcagccatgggttccccagaatgggtaagcaaggagccttgtgtgggcagtggtcggctacccctggatgggcccttactgccccgtgtgtattttctaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaag

SEQ ID NO: 132888 - DNA, 1041 bp, Homo sapiens
atagagatggggtttcaccatgttggccagactggtctcaaactcctgacctcaagtgatctgcccgcctcggcctcccaaagtgctgggattacaggcatgagccactgcgcccggcctatatgtttgtgttttaattacagaatacatgctgactgtacaaaagttttaagtacatgtataggcactaatatggaaaataaaaattacccatggggcaccaactcagagatgacgattaccaaagcctgaaatatatttttcatcttaaaaaaatttgatataatgttatttacactttataaactattcttttattggataaaaaattaaacattttcctgtgatggtatttttcaaagctcgcatgcatttcatcttgtataaatgtattatttacctagccaactctgtattgttcatttaatattatttttaccattatgtgtaatgcttctttgactgtccttggacgtaaatcttttttgaccattcctggtttttttggtagaataaattctttgagttggaattgctgggtgatgtttaaagctcttgctacgtgttgtgaaatctgtgtctgtagctcgtggctgtgataaacatcctcagagatccctgctatccaactcttgtcaccagctaactggtcattaggccaagctgtgtgagtgaaccattagacaatttgataaaaataagcactgctgccattctttagcatgcgtctgtgccacaagttagtgacacatgtacatatattccctttacctcacagtaaccatctagggtgtgggcatcataatcttcatttttaaaatgagggtactgaggcatgaataggctaaataatttgctcaagatcacaagttagtaaatggcagtcagttttcaggcgtaggctttgaagactctaaacctgtgcttttaacatctgcctcttcttgtgactgggggcttcactggagccaagcctcaggaggcatttgcagccacagtgggtcatgcgaggtagagcagactgcaacctgatagaattct

SEQ ID NO: 132889 - DNA, 1047 bp, Homo sapiens
ggatctcagtaacacaaaactcagaaccctagcccctcagattaagccaccatccccgatttagggaatggcattagatctacaatcagctggtttcacttggcactggcccatttcatgtgcctcttggaggaactctcagcctggctagtctctgattctagggaaattccaactcaactcagtgattctcaaattattttctgccccaacccacttgaaggctacctggtatatcagaatcggggcagtgtggcggggggtaagagaataatttataaagcccagggtttctggttgggaatacccttctttgtgaaccactgtttttcacccttccccttaagctcctcttttcttcctctgtattccttcctctctacctgccccttctggaataagtgtattgcagtaactaccagtgcatttgatattttcccctaaggtggacagtagagcagaatccattgacaagaagatttctcgattggatgctgagctagtgaagtataaggatcagatcaagaagatgagagagggtcctgcaaaggtaaggtgggcagcaactgctgcacaaggtgctggcagagcctagttttagcacctatagaaatagggcctagttcggctgggcgcagtggctcatgcatgtaatcccagcactttgggaggctgaggcgggtggatcacgaggtcaggcatttgagactagcctggccaacatagcgaaaccctgtctctactgaaaatacaaaaacttagctgggcatggtggcaggcgcctgtaatcccagctactcaggaggctgaggcaggagaatcgcttgaacctgggaggcggaggttgcagtgagcagagaccacaccatagcactctagcccaagtgacagtgtgagactccgtctcaaaaaataagtgaaataggacctagtgcaggggctgtgagcatccctacagaagagatgcttacagtctggtaaggagaaaacatgtgagggtgtatcctttagggaggagagtttgcaatcaaatatggaagggaggct

SEQ ID NO: 132890 - DNA, 1169 bp, Homo sapiens
gaactaccttgttttttccagatccataacttattaaccatgtgagcctgggtatcactgaacctctctttccccatctgtaaaacagagataatacccaccttacagtatgaggattaaatgaggtaattgatgtgacctgtgtaccactatgtctaggataaagtagtactcagtaaatatgagttatgatcatctgtgaagtaataatacctgtttttccttcctcactggagaagacaaataaaatgatctacagaattctatagaaaaggaaggcttttcccagccatcttagtggatggtgtggaatgaagagcaaccagaggtaggaaagcccatttagatttgagacaatgaaagcccaaaccatggtggtaggaaaccaaagaatcagtttgaaagtgagttctgaaatcagctaacaggatgactgtgcatgaagaaacaacagaaagaggaaagataaggttgataaaaaggttttcaacctagagaggtgagagattggtgggccattgttacttatttcaaaggtgagataaggttcaggagtttggaattgttgaggttaagttgatgggctgtacaagtgaagaatctccctaaggcaactggatatacagactcagcacttttggggctagaggcagagataatatgcattaggaaaagagaaagtagttgaggactctgggatgtgggatgcaaagacagataggagcaaaggcttaaagactggaccttagagatacctgtttttgggaggggaagtacagaatccaggagccattatgcctactactttgaagaagagaggaagtaggcatgtgagtttgaggctatgggaaatttcttttaccgtatatgtgttttccaccttatttttattaaatctgtttttctctccagaatatggtcaagcagaaagccttgcgagttttaaagcaaaagaggatgtaagttacacacacaatttctacctctagcaggtttaactaaaagagaaatggtcttccattccttcaggttttcatactattttctaagcactcttgatttaattacaaattttcattgacgtgtaattaaatacagttagctgggttgttatctgttgtaacaacttccatctaaatagaactttttgccatgatggagatgctcta

SEQ ID NO: 132891 - DNA, 1024 bp, Homo sapiens
gagagatcatcaattctattctttaagttcacattttgccaccaaaaataggcaagggattatgtgggtcagtaacattcataattattgttagaggaggtctttgggcttatggtttttaattctttaagcattctctcatacttttaattagaagggatgttttaagagttacttgaacctgtcctttagaggagtgtctgctcagttgttaacattaaaaaattgctagccaaagactgggataggggaggtgaactaacagttgttgagaactgtttatgtgcttggcattttatatacattatctttttaaaaattgctcatgtctagattcaaaggagaatgtaggggaaaagggtagttaaaagaaaatggtaaatgagagaaaatcctctcatatatatttccgtaggatttacaagaccagctagaggatatgatggaagatgcaaatgaaatccaagaagcactgagtcgcagttatggcaccccagaactggatgaagatgatttagaagcaggtaagttatgagaaaagtaatgtatatttagttttggagtccaaaagcaacagctgcctgggaccttttctcaaatgctagtgaaaatttctatcaggatttcctgaaggttagtttatggtactgtccctgggcaaagagcttgtgaggcagccacatcagattgcatactccaccaacaacagtgggatggatcaactctgaaggaagtccaggtacaggctgacctggtgcttggtatctgtaagtgtcctccacgtggcctttccttgctgtattccttttgattttgttctcactattttcctagttggagtcctctccctcagaacagcaaaaccaattaagaaacaataattagggccaggtgccctaatcccagcactttggaaggccaaggtaggcggatccactcaagcccaggagttcgagacctggctgagcaatatggcgtcaccccgtctctataaaaaatacaaaaattacccaggcatggtggt

SEQ ID NO: 132892 - DNA, 1050 bp, Homo sapiens
gtggacagattgaagacatcttagaaaattgagtggacaagacttaatgattgacaggatgtggaagaagtgggaggtgtcaagggtggctgtcagtttctagcatgagtaactgggtagatgacagaaccattccacactggatttctattgtgtgattcccctgttacattactactgctgctttcccgctctctccatggtctatttttgcctagaacctttcattttttttccacttatttctttattttttaatttcccatcttcaattgcccctgataagtctctacctgctattgtcattcctcttggccacttccaactcattttaccacagacttatttttggagtctgatttcacgtaatggtcacacagcatacaacaatctcatgccctcttcactgccttctttcaagtccatcgataaatgagagaaattattagctgccagttttcttggttacattttttttaaatgttgactgtttcaatctcagagttggatgcactaggtgatgagcttctggctgatgaagacagttcttatttggatgaggcagcatctgcacctgcaattccagaaggtgttcccactgatacaaaaaacaaggtgaaagctttttctgtttatatttcaatgcaaaatagcaaaggctttatgcttgaccataagtctgggaatctaaaaggtagtcttaacattagaacaaagaaagacagtcctggtcattattttgtgaacccttgaaggtccggtttttctgcattggatgatgaactgactgcataaacactgtcactgaggctcaggaatatttttatagaatgacaatttgtgtaacatacatgatcacccttgttgtgagctggcactgggtaccattgatgggtcttagacatttcctgtaaaagcgtaagcaacacatgcatgagacttgctaggcagcagtgaaaaagtctcactcttcatacacaccagttaattactggctggatttttaattttattttcctttctttttcttttttttttttcctgtacaca

SEQ ID NO: 132893 - DNA, 1627 bp, Homo sapiens
atagtgatgtcgctgcctatgattatagtaaagcatgatatggaagtgactgcctatccacgggcactgctccttcaaggatttgggaggctaagaaaggtattggtccagagtgaaaatgcaaatctggaggcaaggacccactcctcaacctttcctttttgactctcccagcctccttttcccctttccaggtttactcttagatttctctttctccctctttcactctctttcccctgtggaggagcccccttttggccctttctagttctcttcttgattcatcacttcctcctttacctttcatgaaaaagcttgttctcatcttatgactgcgattttggttttgattgattaaatacttggaaatgagttttaactattaaatgtttgtaatcctttttttttttatcaaatagaaaaatagtggcactaaacattgcttcctttttacaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagcttaaaacctctactgcggaaaccaaatttaatagaattttaatgtcatttcagcctataactccactacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcccttcctcattcaacttgttgccaacagca

SEQ ID NO: 132894 - DNA, 2568 bp, Homo sapiens
caagcaccttgaacccatcaccttcactggaaacatagttcttacttaacagcatgttttatacaaagttctaaggaaagtaatttttagatttggcttggagtctatgagtttcatggatgaagtttaatctctttactggcatgtctattttttatgtcctaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggtaaacctacctagataggaaatattttgttgtctttttaatttaaatttttaaataagtcatatattcacataatttagaaagcagaaagtatggaaagttacactgtaaaaagtctcaatctttattcactgtctgcctaagttctaccaccactcgctgctccctgccccaataggtaaccacttagttttatgcatatcacaagcaaatacaaataagaattctttttcttttccaaatgaggaattttgtaagggttttcaaaaatgcaaatacgggtggtgtagatgtctggttacaagattttttttgagttgtgaaaacaagtggtgggtggtaacatctctgctgcctcttttggtttcatcctgcatcatctaatctgcctcatctggtctgcttagttgcagcagttcctaactggtcttatcatctcttaatttctctctttcagttcacctcttaaaccagcatcagagagcaatctttataaaacacatattttatttatttgtttttttgagaggagtctcactgttgcccaggctagagtgcagtggtgcgatcccagctcactgcaactcctcctgggttcagatgattctcctgcatcagcctcccgagtagctgggattacaggcgcccgccaccatgcttggctgatttttgtatttttagtagaaatggggtttcaccatgttggccaggctagtctcaaacttctgacctcgggtgatccgcctcggcttcccaaagtgctgagattacaggcgtgagccactgcgccctgcctaaaacacacattaaactgtgtcactcctctgcttaattccgtttactgcttctgccttactcaacagtcccatcttctgctgcctcaatatctaccacattttattccctggattctacacttttttgtctttgcatggtgttgcatgtggctccctctctttagaatttctgtcactcagttcgctgacgaagtcttactcatttttcaaaagctactttaggccaggcatggtggctcacacctgtaattcctgcacttggggaggctgaggtgagaggatcacttgaacacaggtgttcaagaccagcctgggcaacataaggagaccctgtcactacaaaagaattaaaataaaaaaattagccaggcatgttagcacatgcctgtagtcccagacactcaggaagctgaagtgagaggatcacttgagcccaggagatcgaggctgcagtgagctattgtactccagcctggataacagagcaagaccctgttttgcggggggaaaaaagttactttagtcacatgtccagggaaccttttctcacctttatagatagcgttaatctcttacagccctcacgcttatgtctttc

SEQ ID NO: 132895 - DNA, 1424 bp, Homo sapiens
tttttcctttcctgccttttaatgactaacttccctctagttgttgatttttcagattttgtttctttactgtctgtctccctccctgaagcattgcatttttgcttctgtcttgttgcctcactgaaaccgtattcagaaattaccaatgggccgggcttagtggctcacgcctgtaatcccagcactttgggaggccaaggtaggtggatcacctgagatcaggagttcgacaccagcctggccaacatggtgaaaccccgtctctactaaaataagttagctgggcatagtgttgcatgtctgtaatcccagctacttgggaggctgaggcaggagaatcgcttgaacctgggaggcagaggttgcaatgatccaagatcatgccattgcactccagcctgggcgacagagtgagactccatctcaaaaaaataaataaataaaataaaaacaaagaaatcaccaatgactcctttccagccatatctagggctgattttataagctcataatctttttggtagagtgatagcccttgacacctttgaccattcccttcttgaaataagtagctcttcctgtttgtttctgcatgctctccttatttttctaaccaatttgctcatatttctcctttcccattacttagctagcagctttcacaaagagtcaagtcatttaccatcaactctgaatcttctagatgcaataccttggtgaactctttgacttccccttcttttctttcaattcttaaccacagtatcatttaagatctgaccccaaacaccctcttacaaaggaagctttcctttgttattctctgtctcactttggcctctgttttatttggaattttccggtcttacatgttttattgacagaatctcagccttaatagatactaaattggtattagatgagggaataaatattcttgaatatactaccagaaaggcagcatgaaactggaagtaagagatcagtggaaatttgggcaaataggacaataccaatacttaataccttattttgaaggattacataaagtaccacaatggaattaaaaatcttgttaaagcctctactggcaaattagatgagagactctaaggcagtataagaatgtggagtgaaggtcaagatgatctgaaagtggtaaaatgatgtgagaatgcacataaaggccttatttgcagatgactttgccccacactgttcttccaggggaccattaatttaacatgtttttattgagaacttattaatgttcaaggcactgtgaagaaacagaggcgaataaaacggttaacttaccagagcttacagtctaagagttaaaacacaattagcctgatactctgctagaagtacaaagtactatgggagatctttggggtagttacgacttacagctggat

SEQ ID NO: 132896 - DNA, 1511 bp, Homo sapiens
aagattcagggcaagagagaaaatgtggatttggggatcaatggcctttaggtggattgcacctctcaacatgaataaaatttctgaaagagatagtatagagagaaaagcagaggccatggactggggatggctgcaatttagtgtgcaaattgcccaagtgaggatgaattcctcaagggcaaggaggaatcctgtgccttcgttttactcttccctgtctctgctgagtccatggaagatgtgccatgaagatttgcagtgacattgattataaaagtataaggtcttttatgccgactttatagttctggaataggtgagttcctgctactcgggatttatgtcctttccatttcttactgcctcccccctttccccacggtgctcttctcttattccctctctctgatccttccagcagcaattcgcatatcagttcagaagtccagttatagacgacttgtcttataggtatttatcttaaattaaacgtttccattagtcaagatagtattttcgtaagtaaaagtgactttttatttatctttcccaggtaatccaagatttaagatttatcatactcagtgaaactttttatgaatagcattatatttatctttttattttaagatatgggataatacatttgttgaaataataaaaaccacactaaagttgcatgctgcctagctatactttactgtttcattaaagttgagaatgtggttgaagtttgtaccattgactctctgatctgatatgttctaggcaaggtaaagaatcctgagtggagcagaaatgaaattccacatagctgtggtgaggtttgtagaaagaaacagcctggccaggactgcccacattcctgtaacctgtaagttggaatgctaattccgttgggattgctggtggacatgctttgctggtggctctaagtaaacatacctggttagcatgtaatggtttgggatgaagggtgatatgggacctcagtaaatggtctcaaatcaccctgtgccaggcactctacatcagttaacttgttgaatccttaccacagcccagtaatagatatttaccatctctgctttacagatgaggctcagaaaggccaagcctcttgcccagcatcacagtggcagggcgtggatggtggagctagggtttccaaagccagtgctgcttccattacattacactgcttgcttctaagaagaaatgtgactcatatgttttatcccgcattgatatccaggtccaagagaatgtatgggagaaccttctgtctggggaaagacaattgtttagggtcccggtcggacagtatttccaagatgtcaagatgtcaatctttttctttctttctttctttttttttttttttttttttgagacagggtctcgctttgtcacccaggctggagtgtgagtgtggtggtgtgatcacagctcactgcaaccgccgcctcttgtgctcaagccatcctcccacctcatcctcctgagta

SEQ ID NO: 132897 - DNA, 1327 bp, Homo sapiens
cctagaatatacccctcctactccaaaaacagttgtcgtagaagttcccaaaatgttttaagtagtggtatttctgtaccactgtgtaatttgccaaagtgtctgctttgaagagggcagtatatatttgaatatacaaattccgtattgtaacttttttctattggtctctataatatagctcctaaaatagcatttttcagagggctaattctgacctatagcatatcactcagcccagttctttccatgacccccttccctttcattctctccatgttactcactagcatgcctcccctcatgtcagccttcttttcactgttccattgtttgcccagtgcctgattattacttcactagctgatagtatgtctgtacttcttacggaccaggtagatttgagttctattactttgcttagactctgatcttctacaggaccctattagccattctgccttttacctgagtagcaaactatttttatccccacacactgctgtaagtgggccaagactgtatttgaaaatgtcatctttgactctcagacccaaatataaccagtattttgacttgggatttacttctgtggttaaatagtctgtggtgataatgatgtcgattttttgcacataaaagtacagttgatatctttgttcaaatagtttaatcaactttaaacaaatacaaagacatgtcatagtagatgtatttgttgccatattcacaataagacccagctgggacagctttgttcgggtttggatacatggctgtggtttattcagtgaaacctttctctttcagtctctgccatccaggaccctgcccaccctgccctgcctttatgacaaaaacatgtgaatgtggacgaaccaggtaaagttaaaattacaccctaaagaagacctcagttttcacatgcatgattgacttgtgaatttctgaaataaaagaatagtaggtagatacaaataaatggtaggcatgaatagtactttttttttttcaggagtgaaagtttattaaaaagctttagaacaggaaggaaaggacagaaggaaagtacaacttggaagagagccaagtgggcaacttgagagaccaaatgtgccatggatagtacttttctgtaactagtagttccctgtgctgcccatgaccctattttgtaatcttataagtgattaagaagttatatgcacaatgagattgtgagactacccattatttcgggtaaaataccaaagtgacaaggatttttttttttttgagacggagtctcggtctgtcacccatgctggagtgcagtggtgcgatctcg

SEQ ID NO: 132898 - DNA, 1049 bp, Homo sapiens
ggtacatgatagctgtcctcccgtctgtaaagtactgtggaagctccaggcagagctaggaccagaacccagatcttctaactcctcaccccagcattctttctccttacgcatgctgcttcatggaactcagagatgaaatcacataaagcaaatactcaggaatagccttcagttcctcaccactcagaaaataggaaagaaagacaggatggaaaagaaaaagaaaaaggaggagaaagaagaaagagtgggccgggcgtggtggctcaagcctgtaatcccaacactttgggagcctgaggcaggaggatcgcttaagcctaggagtttaagattagtctgggcaatatagtgagaccctgtctctatttaaaaaaaaaaacaaaaacaaaaacagaagaagaaaaagagtggagaaagggagagtaattgagaaaataagaattggaggagggagacataggaaaaagtgagggaaatgaagttagagaaaggcttagtgggttttgaggggagagttaggggccgcagtgttagtttggttgtccaacaggaacttttacactgatgctgtctttacatctattgtctttacaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccagggtaagtggtgggcacaccagctagcaatgcttgtgttcttttctggaaccttattaatgattgtcttgataaactttgattggtgtcagacttttagtcacaaagaccttgagtagagagaactggagatacgatgcttagacggtttttattattttacctgcataccagtataggtcattgtcctatataattttttttttctttttgagataagtctcactctgccgcccaggctggagtgcagtggcgtgatcctagctcactgcaacctccacctcccaagttcaagcaattctcctgtctcag

SEQ ID NO: 132899 - DNA, 1595 bp, Homo sapiens
gggaggctgaggcaagagaattgcatgaaccggggaggtggaggttgcagtgagccaagatcatgccattgcactccagcctgggcaagagtgagactctgtctcaaaaaaaaaaaaaaaaaaaaaaaaaaaatcttcattatagtgaaaccttttggttctgtttaatgtacgattttattttatgagtattatttttaataccttattagaaggtttctattttatttttattgtatatgtgattttaaaaatgtgatgtttttataatactgcatttattctgatcattagatcttatactctcatgccaatttttaaatttctttttggcaacggggacctttttacaagtgttttatgtaaaacctgacataaagtatgaaacctgtgcttcttgggttgaagtgaggatgggaaatccagatgtcaactcctccaccactactaccagcttagcttgtctatctcctgtaacatcaccagaggacccgcaggagcctcacagtgaatggtgttcagccacggccttatggaccagatagtgttctcttaatttagaggttgcttcactctgatgctgttcttggaatgtgctgcagaggcactatgagatattaatagtttaacaaggcttttttaatttcttcctatggtaaagctcttaggcgggtcttagagctgctgtatgaactatactcatttctgcataggtctgatcagtactctatttggcctcccagattacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaagtaaggttttacgttttcttcagttgaactaaagctgcactttatgcaacaattatgtaatagtgtgttttcttaacagggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttaggtaactagtaagcgtaaagttggctttaaaaatattattgtaaatggttggcagcagtgagtgtttaagcaatgtagaagtaagtgctagttacaatatcagaggtttctaaatattatgatcatatttatgtaggtacgttttctttcctcctcaacatatacttgtgaaaacccatacatttgcccaaatgatctctctgattcaggtattttattgttaactctggacaactgtggtgagttactgttccataggggttatgatttctcttaggagcctgtactgtaatgaacactatatgtatttataccaatccagggttcagcaagtgtt

SEQ ID NO: 132900 - DNA, 1065 bp, Homo sapiens
ttcagcttggggaacacactgagtgttgatttatcctgctctttgacctacttagtcattttagtgtatatcaacatttgtcccagtagagtacaagccagggtggagacagaattgtgaaccgttggttctgttaaacacaatgcagggtctggcagcatctgacttgcgaataattctgaggatatagtccataaatgggaagctagtttaataggaaaacttcagaaaaaagggaaaagtagtataatttacatgttacaaaagttgtgtaatcatatatgggttttttcctgaaagaaattacaatatacataggataacagaggcatttttgaatgtcaggtatgggaccacttttgtactttgtaaatactgtattaaagactgagatgctgtgatttggcaatcataaatttagtaatgcccagagatgctctttgtgatctgtgtgactgaaaattgtaagcagggttgggacatgtaagctggaagtggctgctgtcagttttcttcattctcccacaatccctctttctatctctacgttttcttgcttctcattgactctttgtcctcactccctctaatagtggactccatggcagtgagtgtattcttgaaaagctatgtgtaagttgaatttttgcaagtagaagtccttaaattgcaggaggagctcactgtcaatacaaactctgttaaacctgtttgacaaagtaaaaaaaaaactcttcaaaaagctgataattggctgggtgtggtggctcacgcctgtaatcccagcactttgggaggctgaggtgggcggatcatgaggtcaggagattgagaccatggtgaaaccccgtctctactaaaaatacaaaaaattagccaggcacggtggtgggcgcctgtagtcccagctactcgggaggctgaggcaggagaatggtgtgaacccaggaagtggagcttgcagtgaaccgagattgcaccactgcgctccagccagggcaacagagcaagactgtctcaaaaaaaaaataaaaaaaataagctgataattatcacctcattgtt

SEQ ID NO: 132901 - DNA, 1051 bp, Homo sapiens
actttgctgtagttttgtgatattatcaggtgtgctctgaagtgtgtagagccgtttgtccctgcattaaatggtacagattgtcatctgttttcaattcttatatctgctttttatggctttttctgtctgtacccttgtttggtgatgacttctctttcctttgcatgcctttagcagccctctttctatttagattttgtaattattagtctactgtgaatttggagaccagaccacaaaaattgttagaattgtattttcatgaaaagtctgtaagcctggagtcctcttgtgagtaaagctcattcatatagggattaggctcgctccagacatggcaagtgaagttggtgaataagtgactatcagagaagtatgggatatttgggatattcttgttacctatggcattatattatagttgtattattttagttattcctaaagtagttaccatttctttttctttttccataggagcttccatgtaccagtctcaaaagtgaaggtatgactggggtggggcatgagggaatttctggggtgaaagtgtcgtcactctgaatcttgttagggagttgggttatgtatttgtcaaaattcagtgaaggcatacttaagatttgtggtataactttcacctcaaaaggaaaaaaatataaattgaattctaattgatgaaatgctgaaaaatataagctaagtgcactcatgtctacagcttgctttgaaatgcattaaaaaagaaaattagtgggtaggtagaagaatggatatgtatatgaaaaaatatgttaatggtagaatctagatatgggcatatggatgttcactgtaaaatactttgaactttttttctttttccttttgagacggagtctcgctctgtttcgcaggccagagtgcagtggcgcgatctcggctcactgcaacctccacctcccaggttcaagtgattcccctgcctcagcctcccaagtagctgggattacaggtgtccaccactacacctggctgatttttgtatttttggtagagacggggtttc

SEQ ID NO: 132902 - DNA, 1243 bp, Homo sapiens
ctgtcttacattttttcttcttctctattttatctttctttttcttttttttttttttttttttgagacggagttttgctcttgttgcccaggctggagtgcagtggcgcaatctcagcttactgcaacctccacctcctgggctcaagcaattctcctgtcttagcctcctgagtagctggaattacaggcacccaccaccatgcctggctaatttttttgtatttttagtagagacggggtttcaccatgttgcccaggctggtctcgaactcctggcctcatgtaatccgcctgcctcagcctcccaaagtgctgggattacagtcatgagccaccgtgcccaacctttttttaaattttattttaaaaatatgttgagacagggtctcactttgttgaccaggctggtcttgaatgcttggtctcaagtgatcctcccatgttggcctcccaaagtgctggggaaaaacattttcgtcaccctgaaaggaagccctgtattaattaagcatttactccccactcagtcctcccccaggtaaccactgatctgctttctatctgtatggatttactattttcgaatacttcatctaaatggagtcacaatatatattcttttgtgccctgcttctttcacttagcatgttttctaagtttatcatactgtagtatatatcagcacttcattcctttttatgattgaataataattcattttatgaatatacattttatccattcactggttgatggatattagaattgtttctactttttggctattgtgaatagtgctgttatgaacatttgtatacaagtttttgttccaatacctattttcatttctttggggtatatacctaggagtagaattgctggatccaatggtaatcttgtgtttaatttttttgaaaaactgccattctgttttccacagtggctacaccattttatattcctaccatcagtgtatgagggtttcattttctccacatccttgccaatacttgttattttctgggtttttttggtttttgtttttttgagatggagtcccactctgttgcccaggctggagtgctgtggcgctatctcagctcactgcaaactccacctcccaggttcgagtgattcacctgcctcagcctcccgagtagctgggattacaggtgcccgccaccgcgcccggctaatttttgtatttttagtagagatggggttttaccatgttggtcag

SEQ ID NO: 132903 - DNA, 1336 bp, Homo sapiens
ccagctactcgggaggctgaggcaggagaatcgcttgaacctgggaggtggaggttgcagtgagccaagattgcgccattgcactccagcctgggcagcagagtgagaccctgtctcagaaaaaaaaaaagaaagcaaaaaggccaggcgtgttggctcacacctgtaatctcagcactttgggaggccatgggaggtggatcacctgagatcaggagttaaagaccagtttggacaacatggtgaaaccctgcctctactaaaaatacaaaaattagctgggtgtggtggcaggcacctgtaagcccagctacttgggaggctgaggcatgagaatcacttgaacctgagaggtggatgttgcagtgagccgagatcacaccactgcactccagcctgggcgacagagaaagactccatctcaaaaaacaaaacaaaacaaaaaaaactgcatttacattattacaattgtattattactattgtattctttgagcctatagttactcaaatatttgttgtatgaatgttcatatcctttgtctggttttttttttctttttaatttgccacagcagatgctacatttatgtgtgacaagcggtgtaacaagaaacggttgtgtggacggcataaatgtaatgagatatgctgtgtggtaagtggacttattaggcataatcagattccattcatccaggtgctgggcttctggaagcctgagccatgtggagaatgcagcccggatttaaaagtcactgggacaggcccctaagcagcagtcagagagctctcatagtccccataacctctctgcaaagagacagactgggcctttttagcctcacccaggttaagaagtcagccagtggcatctggtagcaacacagaggaagagaaagagataagagaaggtctcacaccccagagcccaagacccctagatgagcacacagtcttcggcagaagattgtgtgttgtcccaacacaaactggcctggacttagcaacttgggcttcaggtttcatgtactgcttaggtcaggtcagtaggaaaaattattaggacattttttaaaaagattttttaaaataaaatatttatttaaaatatttgcttttatggaactaattaaatcactagctggctatttgtactctgttatctcatatactcttttatatataaaaaatataacgtatgctatatatgacataacatgtatatataaatgtgtatgtatgtattagtccattttcacactgtcagtaaagacatacccaagactagggaagttacaaaagaaagaggattaatggatctacagttccaagt

SEQ ID NO: 132904 - DNA, 1018 bp, Homo sapiens
gtaccagtttactgtattagtctgttttcacactgctgatagagacatatccaagactgggcaagttacaaaagaaagagttttaatggacttacagttccaagtggctggggaggcctcacaatcatggtgggaggcaaggaggagcaagtcacattttaacatggatggcagcaggcagagggagagagcttgtgcagggaaactcggccttataaagccattagatctcatgagacttattcactatcatgagaacagcacgggaaagacctcccccaccatgatttagttaactcctaccaggtccttcctacaacatgtgggaattcaagataagatttgggtggagacacagccaaactgtatcagtgtatatatatatacataaacaaggtaacacagtaccaatagcaaggtagtacgtgtgtatgtatgtatatagcatacataattattttttaaatttatatatttaagtgaagagtgatgaattgtgcaagtattataaactagtgttagaaggcttaaagacttcctcttattataaaaaaatttgcagccaggcattgtggctcacacctgtaattccactttttgaggccgaggtgggtggatcttgcttgatccaaggaattcaaggccagccttggcaacatggtaaaaccccatctctgccaaaaatacaaaaattagccagtttcataacccggtctctaaataaatagatttaaatgtaaaaataaggctggatgcggtggctcatgcctgtaatcccagcactttgggaggcaaaggcaggcagatcacttgaggtcaggagttccagaccagcctggccaacatggtgaaccctgtctctactagaaatacaaaacttacctggacattgttgtgggcacctgtaatcccagctactcaggaggctgaggtaggagaattgcttgaacccaggaggtggaggttgcagtgagccaagatcgcaccaccacactccagcctgggcaacagagtgaga

SEQ ID NO: 132905 - DNA, 1026 bp, Homo sapiens
gtggatgcctgtagtcccagctactcaggaggctgaggcaggagaacggtgtgaacctgggaggcggaacttgcagtgagccaagattgctccactgcactccagcctgggcgacagagcgagactccatctcaaaaaatatatatgtatgtatcaaatatatgcagaagcagagagactactagtatagagagtcccatatacacaacatccagtttcagtattgatcacctcatgacgaattttgttttatcttcatccccacctactctcccttctgtggctattttgaaggtatttccagatatcattttatccataaatgtgtagagctttgtttttattaatcttgttgttatttatggaaaatataaaatgaagaccattttatgaacaaatataaatctcttttcccaggataaggagcacaagtgtcctttgatttgtgggaggaaactccgttgtggccttcataggtgtgaagaaccttgtcatcgtggaaactgccagacatgctggcaagccagtgagtgtctttactgtatagtttattagaagagttttttagaaattcagacataatatactttgagagattgatttacttagaattgtatggattcttgaactaagccttcgtatttccaatatgttgagactttttttaaagttacttctaatgctgtgttgtagtccctgaatgtgcaaaacttgggatatgaacagtgatcctgagatggggcctagttcgttaatagattccttctctgctacatgcctcatatgtgttattgacctaggttctgtcctcaacaatcttctttctctatattattagcagcagtttgcaaactttttggttgtagggctcatttacattaccaaaaactatcctaaagagtcatttttatgtgaattgtatttatctttatctaccatattagaaattaaaactgagaaatttaaaaaataattgattagtatatttaagaataataatatacctcattgcatgtaatcacaaaa

SEQ ID NO: 132906 - DNA, 1277 bp, Homo sapiens
accaaaattcaacctcattttagaaaggacttgactcggtgtttttattctctgtcacaaaaatttattggactttcttgtactttgaatggatctttttacccgtgcatgattttataatagcccacattgatcatttggaaaataattcttcactgagttatgtgatctttgaaatgttgataaatttcctattataatattaaaaactcagtcattaatataatctccagtctagaaatatgttgggaaaagtattgggaagttgtcagggtcatagtaataaatgaaacttcatatctgttcatgcctttttcaccagcttagctttaataaaataaaagtttaataaaataaaaacctcttttgaaaaaagtagcacccccataaattctcctctaaaaatacaagcaaaaatgtgtgtgtttgtgtgtgttagtatgtacttgcacatcccaaactcagaaaggattcttttgttttacctgctgctccaccaggttttgatgaattaacctgccattgtggtgcatcagtgatttaccctccagttccctgtggtactaggccccctgaatgtacccaaacctgcgctagagtccatgagtgtgaccatccaggtgagtaccaacttgtcttcacacttcagcctgctcacaccatgtcatttaggatcctgctgtgttactgtcttcactgctctagagtcatgctgtgatggctgccccttgctcccggctcaggggctggttctctgaaggtgggtctgtgatctgggccacagcttggaatcacagtgccctccattggtttactctagggatgtcaaacacacctaaaaacgttggaagactccccagctgatcttatctctcaagaacttttctttctttgtggtctccactttggtgcatgttttgaaatttagcatctttttacaaaattaaaagtgacttttttgttgttatagaagcaatatatatttatcgtattaaaattaagaaaatagaggccagggccaggcgcagtggctcatgcctgtaatcccagcactttgggagagcaaggaggggcagatcatgaggtcaaaagattgagaccatcctgcccaacatggtgaaaccccgtctctactaaaaatacaaaaattagctgggcatggtggtgcacgcctgtagtcccagctactcgggaggctgaggcaggagaatcacttgaacccgggaggcagaggttgcagtaagctgagatcgcaccactgcactccagcctggcga

SEQ ID NO: 132907 - DNA, 1031 bp, Homo sapiens
tggaggtggaggttgcagtgagccccgagattggcgccactgtactccagcctgggcaacagagtgagacttcgtctcaaaataaataaataaatacaaactgttattgccagatgcagtggttcacacctgtaatttcggcactttgggaggcctaggcgggtggatcgcttccactcaagagttcgagaccagcctgggcaacatggtgaaaccccatctcttaaaaaaaaattcaaaaattagctgggcgtggtggcatgcacctgcaatcccagctacttgggagactgagatgggaggatcacctgagccccaggaaagtcataatcacactgttgcactccagcctgggcaacagtgaaaccctatatccgaaaacaaaacaaaaccaaaccctgccataagcttagaaatgtttaaagagaaagttaaaactcaccccaaatcccacatggagatgagaatctggctacttctgtctctcctagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtgggtatttctggccacagatgcagcattgactgtagttctgaggctactagtgaatccagaactgtctacagtggcccctgggcatgcatcttaattaagggtcattggttgcaaataaccacaagttagagaaaggtagagtaagtcatacaagtttctgcctgcccaacttggtatggccttttgattcagcaggtacccactgccaccggaccacagtctgtgtctcccttgggtgagattctcaatagtcactgattgtttactccatttatttaataaatgtataaatgtcttttgtgcaag

SEQ ID NO: 132908 - DNA, 1059 bp, Homo sapiens
tcgaactcctggcctcaagtgatccatctaccttggcctcccagagtcctaggattactggtgtgagccaccgcacccagccaagaaatgtataaaaatgaagtgtatatgttaatggaattctttacttttcagatttctatattaattttaacatttgtatgtctattttatgtaccttatctttaaacaaagcctcagagaaagtcatcccccattgaccattctcagtgatcccacacccccaaactcctcttccccaaataatctaagtccccagtgttcagcctatgacttgctcagatccttatagatctgtttattttcttttatgaagacaataccacctcatgtcccaagttgttgttattctctccttaataatccagtttaccaaaatagagataaataatgtgtaaagaatttaggatatagtaggcactcggggttactgcaagatagtttccctcccactccttttatttgcatacctctctctctctttcaggagattagcagaggcatttcatatcagtgaggattctgatcctttcaatatacgttcttcagggtcaaaattcagtgatagtttgaaagaagatgccaggtatgtaacttgttacctgctttcttaattgtggcttgtcagggtgtttggtcttttgagatgtcataactaatatgtactcctcctgtgattaagccagttcaagtttgtttgtttatctattgtaagagattatgtgctgtttaataaatatccttctcttggtttctcgaaactgtccccttaaagaactgaacttggggtagggttgagataagagtttgggtggggtggtggtaagagtttgggcctcccaagggctggactagactaaattggaggatctctgggcttcattccacttctgtccaccccagtctcacattcacatgcgttctcagttggagctataacagctcttatttttctcctggagtccctggcctttcagtggctacttctcctttcatcttctcatttcttatatttttctcttttgttcttccgtcagt

SEQ ID NO: 132909 - DNA, 1043 bp, Homo sapiens
attggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaactttatagggctgccttttggtgttttcatttttttatttcttttcattttttttcctcaatcctcctcctcctgtagcagggctgtcctttggtccttacccagtctgcttcaaaagggatcaggtacagcagcaggaacaggtgactggagggaagtgacacaaaacaaaaccacctctctctggacccatgtagtgcaggtcagtggccccacacacaacaggaagcccatgagcatctgttacctctttcaagcagtgggttcagtgggtgaatagtacgtgtgagagtatctcagaatcagcaaaaggcaggagacctgacttcagattctagctgtgccacataatttgc

SEQ ID NO: 132910 - DNA, 1135 bp, Homo sapiens
ggccacagccctagatcctgtcttggagaggccagagaaggtggcaggggaggaggaggaggaggagtgtcagtcttgagggagggggaagggcaaagactcgctcactgagtcctatagattaaggtttgggggagaatccctcctgtgtagtgctggccttccttctttatgcctgaaagcctggagaccttgttccctaaggagaacctgctgatgtgcctcctcttctaaaatcggggagggacggccaggccagctccttcaccatggcagacctgccttcctcattagccttcctcacacacaaatattggaaagttcagcctccctaacttcccacatggcctcaacacagatgtcccgtaccatctcccatggctcaaggatagccaggggcttctctaggccatgtcagtccctcagcctacaaaggccaagcccagaaggaacaggttccctggggtcacactgccacactagaaacatcctgtaccaggagggggctgagtcctcaggacaaggggagctgtttttcttcctggcttccccaaacacagctcagtgggaagtccttgccagtgtcccaggctcccctcagcccaggctttgcaaggtcattcttcataatgcacagccttctgggagagctgtctgcagagaatccagctggacagctaggatgtctgtgttgctgcctcagctcactctgtccctgggcagtttgggcatcagtttctgcatctgtcaggtgagataatggttcctgatcatgtgcttcccagagccgtcctgagggtggtgggtagacaatgagggtcagagatcaggagagtctcccagtgccacgtggcatctcagcacagtcaaacctctggagcccatacctggtacagctctcagagaatagctcttggggaagagggaaaggaacagagccgtagtcaagctgcttagacaagggccaaggttttggtcacccccactgacactcccctcactagcttcaagcttgacacatcagtgagggagttgaaagtcctcatctgctcacattttcccaagaaccttttttaacagtacgtaacggctattgagcgcttaatatgtgctgagcaccacagccatctcttac

SEQ ID NO: 132911 - DNA, 3554 bp, Homo sapiens
tcctgacctcaggtgatccacccacctcggcctaccaaagtgctgggattacagtgtgagccactgcaccgggcctacatgagcttttctttggggcagctgggggatgagtgagaggcttcccacctttatggtccaggcctgaagggctgtggagaaacttgtgctaaggtgaaagctgttcccctacacctacgcctgctgaaattcaaggaaaatcagtgaagatggttcagtcatcttctaggatcccagtcgcagaccctgcttccagccctttccatagggccctctcatattagagttgggacagtggggtgggaaggcatgtgtcctttttctggaaagtgcaattacagcagaaggggtttgggctgggttccaggaagcgcctctagtcctcccagtggtggcgagtgggcatgttgctggcttcaccccttccttctggagtgagagttgctggtcctcaccctccctgcctgttcttcttcctgacagatgtttggctgtggctccgtggcccaggttgtgctcagccggggcacccacggtggtttcctcaccatcaacctggcctttggctttgctgtcactctgggcatcctcatcgctggccaggtctctggtaaggccttaaccctgcccccagcccttggccctcaatagcattcccactaggtgtcctggcattcctaagggcaggtcacagctgtggcctctgctttggccccttgggaaaggagggtggagaagaaacttgacacttagaactttcgactctcaccttggaatcagagattatcagctgacctgttacatagaccaaccgccatcctgtgcaagaaacccctctctgcaccccttctcaggggaccctagcctgccgactgtggcaggctgcagctaataggtcccttgtcccctctgcccaggggcccacctgaaccctgccgtgacctttgccatgtgcttcctggctcgtgagccctggatcaagctgcccatctacaccctggcacagacgctgggagccttcttgggtgctggaatagtttttgggctgtattatggtaagcattccccaccctgtcctcctccactacccccgtccctctgttcaggacctgctggcaccaggccttttgatgacagacggctaggacctgcccaggccccgggctcatgactcactcattcacgcacagggtcaaggtagggggcacgaagggaaagaaacaagttgggcaataacagagtctcaggccctccaccccaccccacgccaccccctctgcctgctgcaatacagcagtattgctacttacccataactcatgggagggtggggagggcacacctgagagggaagtctgggctcaggcctctcccccgactcactgtgtgtctaatctgtcaccagatgcaatctggcacttcgccgacaaccagctttttgtttcgggccccaatggcacagccggcatctttgctacctacccctctggacacttggatatgatcaatggcttctttgaccaggtatgggctggggacgtgtgaggggaacgcagggaggggaccgagttgccttggtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgtgagtacagcccccacccagctcaccccagcctgcctctcctctgccctgccccccatgtccctgactatgagtgtctgtccccccaggaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctccagttgtgcaaatatctttctgcttgctctgctgcttttctggggccagttaaggagcttccgcatgcccacactgacccagggtgcccggctgagtgtctgatctggtcaggttaccctgggggtcatacagagaggttagagagcctcttcaccaaggctctcagtttgaactcagtggtcccaaactttcccccaagtttccgtcctcatgggtacccccagcataatgaatggaatcttcttcccaatccctgtacccacacatcaccccagaaaggcttgagccctatgcagggaagatcttgctgcagag

SEQ ID NO: 132912 - DNA, 1058 bp, Homo sapiens
ccactgagccccaggatcatcaggcttatcccagaccacaaaagaagagtgttaaattttaggggaagggttgcagactcagatggatgtgaggtattggatatcagtgagaagcagaacttcaaggactgcatgaactggaggggcaggcctggggatccctttgtagtgggtgagtgcctgcctgcctacctgcgtgttgggagcctaggcctgcagtggcagaatcagggttggctttggggtgaggaaagcccctttctctgagatacctggtgtgagggcagggggcggtgctggccgagaactcagggcaggggttgggggaggaagaggaagattagccccaaggtggtggaactggctctgacagctcctccctccaaggcgtcctgggatggagccaggtctgagcctttggcaggcaaggagctgctgccagggcctcccaagcagggcagggcgcctcagaccctcacgtgcctgtctcccaccacccctcctcacacatacacctgcaatctctgatctttgctctcacctgcctgcacacctttgccccatgtcattgccgctggcttctccgttatctcttggtctttctgggatgataatcaaaatgcttaactatccagtacaacaggcactgacccgtcagaataaacaaggtctgtagcacaggtcctggaaactgcctgctctgtgggcataaaacctttagttatgggcaggtgggagaggagaccagggcaaggcattggagcagctttgagggacactcagggggctcagggcaacaatgctttacagctgctgcagaagtattttcaggcttgaacaaggggaacagacatagtacgttctttttcttttttaaatagagacaaagtctcactatgttgcccaggctgttctcaaactcctgggttcaagatcctcccatctcagcctccaaagtgctgggattacaggtgtgagccaccacagctggctccagtatgttctatatttgtagaacaccagggctcttagtctcttttagttcccccatttttggc

SEQ ID NO: 132913 - DNA, 1793 bp, Homo sapiens
tgggaggctgaggcgggtggataacttgtggtcaggagttcgaaatcagcctggtcaacatggtgaatccccatctccactaaaaaaacaaaaattagctgggcatggtggtgtgcacctgtaatcccagctaatcgggaggctgaagcaggagaatcacttgaacctgggaggtggaggttgcagggagccgagatcacgccattgcactccacctaggcgacagagagagactccgtctaaaaaaaaaaaagagacagactcttccttggctgggggtaagtcagatgggagaggagagggttaaaaacagctgggactcagcctgctggcaaacatgtggcatgtggcatgtcggggcaactgcagctcagcctctggagccatgtgagcaatgcacgcaggtacacgtgtgacaagctaggtcacctagccatgttcaacaggcatgtgcacagccacgaggaatgcccagccgtacaattaggcacacaggacatccgccatgtgtagacacagctgtggacatagctggccaggacatgcgacacacgacgtgctcatagcacagggagaagggcccatgaagtctggttggaactcagcacgtgtgtctgtgtgcccacctgagtctggactgctgcccctctgacactagctgtccccttgaagggtcggtgccttatctgtcctgacagaagagacagtgttgcttctcacttggggctcgcagcctcctcctcctgcctcgaactgaggatctgttgggtccagtcatcctggagagatgcggccagtttctttctgacaggtctcctcctgcccgcaaggaagtggggtgatcacagggcgcaggtggtctctatgacagctgcatcctctccagccatggccctgaaccctgcctataatcccaccattggctctcagatctgcctaagcctctcagcccccttgacgtcccctcccttaagcgccctccgaaggccacccgtccctcaaagctcctcacactccatgcccgcagctccctccacccggcgtccgcaccagcctcccagccgaggtggggcgggggcgagggggcgcgcactcctcggcgctccgggactgcagggcggggctgcagggcgggcggggcccgtgtctccagcgctcctataaagggagccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtggtgagtggagggagccggggaagcccttctctctccagcccttgcactccccaaactctcacttccccgaaggggctgtgttttccaaggtagcctggacccacctccccagctgtgacccccacgcttaaccgcggaggatcaagctgacttccaaagtcctcttccccacggttctaaccccctctctgacagctccgactcttgccagaatgacagctgttactccccagtgatagtgccgatcgtttaccctcccacaagtgactcagccaacaggctgggggcagcggtcacgcttgcagtctgggacagccagccacttcccctgcctcccacacccctccagattcccagaatcccagcccccagatgtaggggagggggcggaggcaaatgagccattattaggttatttgggtcctgggtgt

SEQ ID NO: 132914 - DNA, 1023 bp, Homo sapiens
tatggcatctgacaacctcctctacccccgaatcctgttagctgaagaccctattttcctctgcccagctccatactttgggggaggaaagcaagaaccccaagcctaaggggtccatatggcatgttatatcaatgaaatcctcagggctgctcagtccctgacctattaagtcagatttaggctagccagcccccctcccccaagtttacatgtaacccccccaacatccggtacttgctttatgagtcacagattaatccaggtgagtgataagggcgaggggaagcctggggcacgtgagtcacccgtacccttcacaggaaaggccaatctgctcatctacccctgagagggagaaggaggaggcatctcacactgccccagggaaccaaggaggaccaagaagaagggtgtttcaaaccagagggagacttcctcttctacttcagaaatgaatggggagtataattttctggtttatatcaggccaagatgtgtaggaacttgtctagggtcacacaggaacttgtggggtacagctactgagaatctaggtgtcctggctccaggcaagccacctgcttgaacttggctttcctggggccaaggggtggagtgtggaggaagaaaggactagaaacgcctgagctgcagacctctccagtggggcaggggagtagggaaaagccaggagcctcacctgttttgggccacttgccagcctaaccccttctccttcttcccaagccttttatttatttattattattatttttttttttatttgagacgcccaggctggagtgcagtggcccgatctcggctcactgtaacctccgcctcccaggttcaagcgattcccctgtctcagtctcccaagtagctgggattacagacactcgccatcatgcctggctaatttttgtagttttgtagagacagggtggggggcggtttcaccatgttgcctaggccggtcttggaactcctgacctcaggtgatccacacacctcagcttc

SEQ ID NO: 132915 - DNA, 1053 bp, Homo sapiens
ggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgt

SEQ ID NO: 132916 - DNA, 1820 bp, Homo sapiens
ctaattatttttgtagagacggggtttcaccgtgttagccaggatggtctcgatcttctgacctcgtgatccgcccacctcggcctcccaaagtgctgggattacaggcgtgagccaccacgcccggctcgtaaaatgggtattcttaacagagctaagttaaggtgatttaagtggttttggcttgagcaactcatatggagttgtcttagcaaggaagacatagttatgggaagattgggagtttggtttcaaacatatcgatgtgttaaaatgtcttctagacataaagggtacatgtgaggaaggcagttgaatcagtatgtgtccctgtctctgcccccacagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggtaaggtccagggtttaggggatagaggcccaccacctgactacctacaaatcctggatccctctttcttatctgccgcttgccaggggattgaagtcagaattctaaatcagaagagcagaccattgcaggcatcctgaaggcagcttagatccctcgggccagttgctgtccttttggagctttgctctccagatatgagaactgggcctagtgttgctaaccgtggctcaggcacttctgtcagcagaggagccctggctctctcaccttggtttcaccttggcccacagctccacaagcacttatgtgcctggccttctcttctcccctggcccctccaggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggtgagaggcacacattgggctgagggcatagcatgggatggtaaatctggaggagaaggcacagaggcacggaggcctcaagtatggggggacaggatggggagccctctggctccaagggctcctgcagagtctcagcactcactgtctctggcaggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtgagcaggccctggtgttgaggtggagctggagggaagaggtgtggggacttttcctctcatggcttcccttttcatcccacaggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaaggtgagttgggggtggcgcagcctccctacctgagcgcctgtgtgatgggcaggctctgacctcagcctctccctgtctctttcagggccagggtgggtttactgggttccttgtctccatgctggttgtcttccttgtgtctacacgcaagatccataccaccatgagtggctaccaggtcctgagaagtgtcttgcagtttctgggtgaggcaactaggtggggaaaggccaggggc

SEQ ID NO: 132917 - DNA, 1202 bp, Homo sapiens
ttcataatcatacttctcattaatacttcttaaacattttggccttccaggccttttcttgcttgttggtatgcatatgtgtattaatttctttttacttccattcccacttctattcccctctgaatccttaggcaaacattgtagtatgtttgttcgtatcctttggtaggcactctttttaaaaacaattaaaataaaaatttttaaacaaccacaaacttacaaattcaaagaactattttcctgaaccatttgagggtgagttgccaacctctgatagtttcaccattcctctgaatattttaaagtgtatttcctacagacaagtgcattccacatcattataattattatcaacaattatgaagttaataattctcagcccccatttagttttgtcagttataataatgttcttcatagcagaaggatctggttcagagccaagtatttgcttttagttatcctgtttgtgtagtctctttcagcctgtaattgttccttagtcatgtcctagactttcatgacctttatagtttcggcagtacaggtcacttactttgtggaatctccttcaatttgggtaaattttccctatgttctttatattctttttaggtggtacatgattttgatttgtctcatttctggtgatgtccacttgggtcacttagaagatgtttgccaagcttctccactatcaagttactttttccttgtaattcatgagtattttgtgaggaggtgctttgaaactacataaacatcctattgctattgaacttctaatttattcatttatttatatctcaatggactcatctcctatttcattaaatgggtagtaatggtatacattcacataaagtgtgttttacatgcatgcatattacattggcataaatagtattattttaatatataactatataaaagtattaaaatattatctacatcgagaaagtcatatctagaagggtcaggataattatctgattggtagtaagactccaccgtaatgagataggtggggttcaacatatttaattaggccgggtgcagtggctcaggcctgtaatcccagcactttgggagggtgagggtgaggactgctgagaccaggagttcgacatcagcctaggcaacatagtgagaccctgtctctacaaaaaataaaaaacattaaccaggtggggtgg

SEQ ID NO: 132918 - DNA, 1014 bp, Homo sapiens
aatagcatcatttttaccagctcccacatcaagattgccttgaaactaaatattttaagctttttcccccatgccatttaatttgtaatttttaaaataaacagtatttgaaagcttctaagacatctgctttctgtaggttggaacatgtgaccagttgaaacagggccttctatcaagttcatttttatgctttgtgcattacccttatactagaatcacttgtgcattacccttatactagaatcacagatttcctctgctttgcctgccagttagcagcttgtttcttagtgctgaaaaaaatttttttttatttttcttaaatgccttttatgaaaactatcaataaaaaatttatatctctattcccccaaggtcttaaatttaattgtatcagaaaaattttaagggagggagaatttgaaatctgattgtactatcttaaaaagcagaatacttttaaatactgtaaatatgggtattcatagctgatccttttttcctgtttctaggactatcctattaagtgtaatctcactgcttaatgagcccaacaccttctccccagccaatgtcgatgcttcagttatgttcaggaaatggagagacagtaaaggaaaagacaaagaatatgctgaaattattaggtaaggtttttttttttattacctcaagttatacaaaaccaaaatatattctggaaccaagggtttaaatcaaacttaaatatcctgtccattccaggataattttcctctattagatttatagtgtgggaagagaagatttctgcctgagcctaaagaactttgctgtttaccgagagaacagccactagaagataaggcagtagcagacctgattttctaggaaccagaacttctaggttctggccaggcatggtggctcatgcctgtaatcccagcactttgggaggctgaggcaggcggatcacctgaggtcaggagttcgagaccggctggccaacatggtgaaaccctgtctctacta

SEQ ID NO: 132919 - DNA, 1433 bp, Homo sapiens
catgcaaacaacaaagcatgacattccgcccactaagtcaatacctgttctgattcttaagtcgccgacctattggcccttacatgaatcggaggacagccagttgacgaggtgattctggctataattgatccactgctttaaactcccttgatattaacagtgtatttcccctcctaaaaagtcaaagtttacttcaaaattgtacccagtgggttgaaagcatttggtgtagtacagggtatctgtcagatgctttcaggcaggtactgaagtttggagagctgagtcataagtaatattgattatttaaggccaattataaatctgtcttaaaaaaagacttaccgtaaaccatttctgtgtcaacctcccttcaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatga

SEQ ID NO: 132920 - DNA, 1202 bp, Homo sapiens
aagggctgctgggaagaagtcatgtgtttgggagtttgaagagtgaaaaccctgagatcagaatggaaggaggagctaaggaagtaagcgtcacctactctggccatcctaggatccctcctgccccgtccctaatctgccctttggttctttctgagttacgagccaaaggaggagttgacactagtgcccaggggtctgaaataggactacagtcagtccttgctgcattttccttctgaaatctgattttacattatagcggtttcctccaaataatgccctcctatgatctggtgcacccccataacaaccaaaaattaccttcaagttctgaagtctcctggatggtgaaggctgctggatctcaatattgattgaagcaacacgattgagatctggaaaatcaaagctgcagcaagtgcattgcaggaagatctagccttatctggcctaaaaactgcctgcagtcaactccctcagccctgccacaatttctatgcataattctgcttgcactccacagcctaagtatgttgaaaggagaaaaaaagttcagatcacatccaatgaagaaggcggtaactcgtctcacacacatccaagtttttcactatcagtataagcagctcgatgaaaaccgaaatcttaacacatgcacctaggattaatactgagtaattaaaagtggctacttaaaaaacaaaaacaaaacgtcatggtacgagtgtatttttgatgggaaggccatgctaaatctataaaacagatgtttcctctcccaacagtggtcaccagtagtttcaactttttccccccagtagcatcaaccaaacttagcatagtgatttttaactctttgctcccacacgcactcatcccaacttccccgcttgccccactccctggggggaaataaccctgcctttaaaataaatagcaaccaagtgctcagttctatggaaagtatgaatatttatttcaggctttcgatcccaatcgatttcaaaaaacaaagtctgatttctctcctcagagcagctgaggcctccatgttacgatggtttcatggagattgaaggagcacatttcatcaggcttagcacaaagtccctgatgcccaccatgtcccagccttaggaaaggaaagaaacagaattcaccaccatggggctgaacgaatgcacacacactaatgtaaa

SEQ ID NO: 132921 - DNA, 1086 bp, Homo sapiens
tttccccttccaatcagtttcttacaacatgtgccccaaacgtaaggaaaccagcaagtaaagaagcaatttgccagggtaagggaaagaaggttctacaaaaaagtttgactaatagaaaataactctggaatgattgataaaaggagaaggggggaagactgaaagaatcaacagcagaatcatatacttctccacccagcctcaaaatacacagaactgaagagcatctagtgaggcctcaattagaactaaaaggaatctaaaaatgcaggattttgagttcatgtcacatcaaataataagcaaaactgtacgtacatggttccggattgagcctgagacctccactcccagaagggggaaaaaaaattacaaactcaagtattttccacagggatgtgttctcagggacagagctctggaaccagcctctgggtttcgttcagtcagtctaaaataccagaatgtccacctgctagcaagagacttacccagtcttctggaactgattgtactcatcagaggcaaacccagcccttgacacttttaacaccccaaagggctgaaaggtacaacctccacttggcgctccggctccctgagtcaatgtctaacagaggccaatagggcctgatggaacagctgtgcagcagagcacctcccgcaatgccagggtgctggggctgccctgggagtgagatgctttagcaaaggggaatgaaaggcttaattttagggctccaagagaataagaccaagctactggctgtaaacttgcatgggggtttgggggcattttgggggaggtaaatcagcactgtgagaggctttggctccacaagatttgcaggttaatctggaagcattacttacaaagtatggggagtaaaaaggtagttccaacatctatgagagtttgtaatcaggtaacttgacaatgtattacgaagctgctctgttccatggatctgactaaaatcactagattctgggtgcaagtagcaaccctggccctgtggagatcacagattctgggaccaggctcaacagtgtcccctaagagccttgcttgttaaacagtcc

SEQ ID NO: 132922 - DNA, 1261 bp, Homo sapiens
agtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaatgaccctcttctttttttaccttgtgttaaagaaaactaaaaggtggtctcattatcactgttaagtttgcagattacgct

SEQ ID NO: 132923 - DNA, 3671 bp, Homo sapiens
ggctttgcctttcctcaggggccaggtgtgtccaggagtgcgaggccctggatggtgagtgagggtcaggtcagacctcccctcctccacgaagctccactgtgctttgccgtctctgtctccacactttgttgtatctgccatacttcccccaagtcctgggccaggggtgtccaatgttttggcttccttgggccacattgaaagaataattgtcttgggccacacataaaatacactaacattaaagatagctgatgagcttaaaaaaattgcaaacaaatttcatgttttaagaaagacgaatttgtgttgggccacattcaaagctgtcatgggccgtgggttggacaagcttgtcctaggccatgtcagtgttttgagagcagtgtaggtggtgacaggccagttctgggcttcacctggggtcctgcttattcccgtgcctacctggcactgccccctgtccccccttaaacctttcaggcccctgcacttctgttgcctcctttttcaggtctgctctgtttagtcagctttcctagctgctctagtctctcacacagaaaagccagcgaagttggttcagcccgaggcattcacacaagcacctgcctgtggtgtcaaatggatgtgtgaggcttggtctccagcagctctgcctggtgaagctgcagggttggccggtctgtgtgcttatgtgttaggcaggccgcctagttgcacactcttccgaggggcaccatttacttggcgttccctgggactgctggctctcaggcatggagtctgtttcaggagtgtggcgtcaccacttccatgtgctggttctgctctcctgggagtcaagcagggccagtcgctgatcaagcctccctggtctctcctaggactactatggaattccctttgctgcacccacagcgcttgccagccgagatgggagcctagctaataatccatatccaggtgagtttgctcaatggatgaggagtagcccggggccggcctagcgcgaactccaggagctgggaagcagcaacagcaagctgagagaggcctcttagtagcctgtgctgagctggcagccagacctgttcctgtttgcagaagccagtgtggcctttctctggttggaggaagggcagtggctggagtcagtgctctttcctaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtgagtatttcagagggtgtgactgtgtctcctggccttgggttgctggcaggtggaaacctgggacctatcttccagcagggagggagggttgtgattccactccgtcttacctggtcttcagaaactgttcaggctggggacaaggtcacttttcccctgctgtgtttagatccagcatgtgttgcactaatgaaaacacaggtcccctgtggttgtgggtatgtcacctgctgccttaggctctggcaggggtacctgaccagcctcagcttgcctcttcctacactaatacctcatctgcttgcccccccaggtccctccagcctcagccaagcaacatggggtgaacctcagcactcccacacctcccttccagcaggccagtggttatggccagcacggctacagtacaggtgaggggtacttcccagacagagacacatggggttagacaggcttgcctggctcacacttgcctcttgtaccctgccacgctaggttatgacgacctgacccaggggacagcagcaggagactactccaaaggtggctatgctggatcatcgcaggcaccaaacaagtctgcaggttctgggcctggcaaaggtagtgtttacctctcctttccaggataaggcctggagtggtgggctcctgcctgatcccctctcaggcagggcaacccctgagtgatcctggaggtggggagcctggagctgggaacaactgctgtggggaacaactgcttttcctcctaggagtatcagtgtcttcaagcaccactggtctacctgatatgactggttctgtctacaataagacacaggtgagggacaaaggtgggttgggtgtataggtttttgagaggttacagcccaacctgaccttcaccattgtcttctttgccctgtagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacaggtgagtacagtgatggaggcagccaccctactctgggccaggggttctgctccagccttgacagccttcccttctcctcttcctcagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgcatggtctctgtgtggtgtgactgaagggcagctcagggcagaagccctggacttcacagggctaaaggagatcccacatggtcatagtcttctgacacaggctataaaggcttgaaatggttttcctttttactggaccctcttggcccaaatcacaatggctgtaaggacagctaaacctccttaca

SEQ ID NO: 132924 - DNA, 1081 bp, Homo sapiens
cctcagtgtggtggccgggctttctgtctccccttcactgctttgtagaatgaccctctgcctcattcggccactgcccttctttgaacccatctggggtagctcagtgactgtgcctcctcctgaagcagctgaggactctcactctttgtggtgaccatttcactccatttgatttttccctctatacaggcaaagcacccccaaacttacctcagggggtgcctcccctgctgcacaaccagtacctcgtaggtcccggaggactgcttcctgcctacccggtgagtgtatggcggaactcctggcctgcccagctcccctggcctcgggggctggcacctggcaggaacctggcgttgggcccaggttgcccaccttgagctgcccttccatccctgagcacccccgtctctgccccactgagccctggtggtcttcttccatctagactccgtgaaggcaggatctgttcccgtaacagctaatccagatcccattcccgggtgtgttagagccccccaaccttgttttgactcctagatggacctgggcttcccagggtgtggtatgtggttcctaaaatacactttctggttctcacacagatctatggctatgacgagctccagatgctgcagtcacggctgccagtggtgagtggggtatggactggtcggagcagagggttcagaatcttttacatgtcccccctcttatggtcttggctgccacactctctggcccttaggatcctctgcctgaggaacctctcagcaccactactgagaaagctgttttcatctggcggttgtgccaggcgtgaccatagctttagcacagagtatccagtgctcatccctgggaaacatgaaggcctttgggacctggggccctggtaggccatgtcccctgttaaatgttggtccttatcttccctcctccatcttgttttctctctcttttttaaaaagaaaaaccatatgacacaagacatggaggttgcttacgtggccctggagttttatactgtcttcctcttcctcagagtaccatatagtgtctttggtctgagatggcc

SEQ ID NO: 132925 - DNA, 1096 bp, Homo sapiens
aggggtaccttgtcaaacaggcataagtggcaggccatgcccttttaggtgggcactggtgaggcattggtggactgaaaggtgtcaccaggttttggagcaaaggcctctctcagcctcctgtttccagaccacagtggctgagaatcccaatagaagggaaatctccaaaagattgagacttacgctgggcttcctgtggcctgtgctcgcctcttctcagactgtttgctttgctctgaggtaggtacttgtcccatattcagatagtctgtgttcatttatgatccgaagttatcttgggatttctatgccctcattttggatgccaagcatgagcaacttgaaggatttttacagagagttgtggtcattaaagcttaatgttaatagttttgatgttcagtttatgtattgtatcctgatggctggaaccagctgctatgtgaggggccgcagtgagcactgagcacagagcctctcaccttaagggagcctgggtggttacatcattgcctgcctgctcagccttgagacttgggcccaagcgccaggccaggctctccccagcaccctcctcctctgcctccagatccatgtgtcctggcttttcttttgccagcatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggtatttgctccagaggcctttcctgcccacccctgagcccctcaaaggtgcctgcttggcgtcccaggaaggcagtgcaggtgtcaggagagtctcaggcccgccgagtgcgctgcgtgttccactgaccttgaggcccaatctccccacccctgatggggatgaattcttccttgcaggattcctggcctctgcgtgcttctagcttttcagtctttcctctttgttctttcctggagccgagttgacattgtgacttggaggggccagggatgact

SEQ ID NO: 132926 - DNA, 2739 bp, Homo sapiens
tgacagaggaacttttgactctagcagtggtagtggcaggtttcttttgtctaggcatgggtcgagaactaaagtatctgggaagcagtgtacattaacctacttttcatttcccatactctcttctccctcacttcctcctccccttccctccccattttgtttgtttgtttgagagaggcttcctgtgaagctgttagcatcataatacaaggcccagggcggtatgttttggggtcttagttttaggtgaggtgtatctgtggtgtctttatacagtttatctatgaacaaggtttatatatggaagagactgccaataaaaagaaggcctctgtaagaactgacctaggtgtaagttgaccctttcattgcttatgtttgtttttgacctgcccttcctttagagactcaagtgctttccctgggttttagaagggtcaaggttgctcctctttcctaactggaaaagacaatgatgttttatttccaagcacatatctgagttgtatgtgtggacagcactgagactgagtctttccacagctaggactgagtgtctccacatcctttctgaagcctacgaagctcatttatgtgctctgagatacatctattcaagcacataccaaggaaatgctcactgtgcatttggaagtaggtgttggacagttggactgcagatgttaggtgtctgtgtctctccacaacataggcatcaaccccaatctgccttacgttggccgtgagcattggtagagtcagcctgacttggcggaagcacgtgtaggtggtcttgcctgttagcttcttactcccccttgctgtgccctttgaggagtttgcctcacgttataattctacatattaggctcagcacctgtttttctttctggatgcatctacagcttaggttcctttaggtgtgaaaagtatgtccccatataggataggttgggttataaaggtgtcatttcctattctttgctgcatcttgaacagctgaccatggtgtggtgtcctttgatagtgttgtttgacagacaaagggctatctggcgatatgcttggcattttcctggggaatgtaactttatggacgtctcaactgaggctgacatgtcacaagatattgagcatattttcaggcacttaggattggttttagaaataaacagatctgcttcttacagctacttcatctgttccagctccaaagacaacaggccctccctctgccctcccgtctgtgagctccctgcccagcaccacctcctgcactgcacttctgccgtccacatcccagcacactggcgacctgactagcagccctctctctcagcttagcaggtatggggaaggtgtgggcccaaagtgagaagtaccttggggcaagtcctggagctcctgtagaaggttgctttcatgaacagagcacacttgttgtctctgacgtgatgtcctgggcttttgcattacgactgtagcttaggttttggccaggttgttccttaaaaccaccagatatggaaaccttgcctgcttgtaccgcctctgctggcacagagcactgggtcccctgggagtagggtgaggccagcagctccctcctacctgtcttcaccctccagagggtgcctgagcctagcctctctgggcatcgctgggcccatgtcactgaggtggaatgagaatgatggatttctgagcaggtgtctgacttgaactttccatggctgaagaaacgatgttattagaacaaggtgtaggaaaatgggtggcgttgctacctgtgtcttctgaggagtgttctccatcactctttagctaggagcaaaagtggatttgatgggaattggcatgtggagttgagcataggaactttgatccctcgttcacagattgaatgggattgtcaaggatgaccgtgttcttagtgcaactctgtcttcacttttcgcatctgaggagcaaatggatgtcgttgagggaagctggctctggagttttccagacctcatggcgagtcattcccgtccaccaggaccccatcactgggctctgtggggataaggaatgaggatgggtctgaagccggtcctgtgctagggactatgataagtttgaatctagctcactgacccacgtgcgtcttgttcatctggagtcacttgttcaggtggacatacggcgctctgttttgtcttctagttcgctctccagccaccagagcagcctctctgcacatgcagccctctcctcgagcacgtcacacacagtaagtgtctgcgcggcttcctcttcctccgccatgcttggggagcctggagcttagtcacatgcagctggggcttcagtctgatttttagtgtctgataatctagagttgcttggctgaaatgtcttgatggcatgatctggttcgagcttctgatttcctgggcaccatctggggacatcttgctttctaagtttgtagcgcctgggaagaatcattgctccagaccttatctgtcattggcaggagtgtcaggtggtgaccttgctcccaggaatttgctgtttgatctttcctcgtgccttctttcctgactcagacgcagagattgcaagaaggtcaatgttggagaagggagtctagatggtggagggcaggagtggaagcaaacatgcactgccgagaagccaggcaggagggctggagtcggcgcgccagctttaattttcctcatatgccaa

SEQ ID NO: 132927 - DNA, 1132 bp, Homo sapiens
gaatcttcttattttttttctttttttctagacagagtcttgctctgtcgccaggctggagtgcagtggcgcgatcttggttcactgcaacctctgcctcccgagttcaagtgattctcctttctcagcctccagagtggctgggattacaggtgcccactgccacgccctgctaatttttgtatttttagtagagacggggtttcaccatgttggcaaggatggtctcgatctcctgacctccggatccgcccacctctgcctctcaaagtgctgggattacaggcgtgagccaccgcacgcagcctaagtattcttaaagatgtccccctatctctcagttaaattaggtgggtctcatttgggataataaattgatgcagtagttgcatctcgtgaagctgtttatgtttttttttttttatgaagctatttaaagtaacaaaattatgttgaatatttttgactcttttcagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatggtaagtggtattttagtttttttctcagaagatgtccgtcttatttggaaattaatgtttggttaaattatgcttcttggatatgattttattttacaaattgactaaccttttgagtagaatccttatagttcattgagtttgtttatagtgggcatctctagcacccatgctcttgagtgtgtggatagatctgcaggttcatacactttgtggagaaaaccaagcatgcgtgtagtatgagcactttggctgtagtactgggtacttctacattgtctgaaatatctctgaatatttcatgtactgctttctctctgattgccccatttgctttgaatgtatttgcttcttcatcactgttaggtatttttgtgttaaaattatgtattttctacctagtttttgttaataatactggactatagataaaggaaccaga

SEQ ID NO: 132928 - DNA, 1221 bp, Homo sapiens
cagactagtattagagggaatgggtttgtgctgagagccacagatccttatttcaagtacagatttgaagatctggctcagagaactgttgttcttgagggttttgctgtatcccatagttggaggatgcatggttccttgaccaggtgatactttcatcattggtgagtccccaaaaatagagtagtcagctcagtgttcacttcccacccaccatcacaactcccccgcattgctcttagatgcaggtggtgatattaatgccaaccattcctgtttaacttttaatttctcctttttttttttaaatgagacagggtctcgccgtgttgtccaggctggtcttgaactcctgggtgcaaatgatcctcctgtcttggcctcccaaagtcctgggattacaggcatgagccaccatgcccagccaacttttaatttttcttagcttgttttttttctttctctttttagaaaagtcttagcctattttctccttgtttctcactccttcttcttgccagtattgcctgggaacctaaatgcttgtttggctctgttataggcctttgtgacctggaatctgtgacctctgttcctgacacgacagctttgctttttcagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaaggtactgaatttagtcctttgttatgaagcaaaatagaccctaagagagatcaactggtggaaaagaatacatcctgtggtaatagctatcctcagtgtttatccagaccttccatcatctccataagaaaccccatacctgtagcagacagtctcagtttcttcattgccctgccccttagcaaccaataatctgtctctggatttgcctacctggacatttcatataactggaatcttggaatatgtggccttttatgtctgatctttcacttagtgtaagttttcgaggtacacccatgtttaatgtatcatttttattgccaaatatttcattgtgttgataataccacattttattcattcattagttggtggacatttgggttgtttgctctttttgactatagtgaatgatgctgctatggaca

SEQ ID NO: 132929 - DNA, 1099 bp, Homo sapiens
tttctaagttatattttagtaattcatatgttttagattataggttttaacatacttgtgaaaatacttgatatgttttaaagccttgggcagaaattctgtattgttgaggatttgttcttttatcccccttttaaagtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttggtaggtatacattgtttgtgggtttgcccctactgaggacgtttcaagctttggcagagtgtgttgacttgtgaagactaatgtggaatttgtccagagatgtttctttttagtagaactcttgcagtttctcagttaaatcagtcttcctttgttatacaatacttgcatttatttgtttttgttgttgttcttgatagtttcattattgttggtagtaattgtggtggtagtacatgccttgaaaagtatggtaaaagcatgcaaatatgaacatctaacactttgtgtaaatgcatggacagaattttctgagctctcttagaagagggtggtgatagaacatagaatgtggaaaacattttaagacttttttttttttttttttttttgagatggggtcttcctgtgctgcgtaggctgatctccacctcctggcctcaagcagtcttttaatctcagccttctgagtaactgggattatagatgtgcaccactgtatccagcctagacaatattttactctattattttattttttttttttttgagtcaggatcttgctctgttgcacaggctggagtacagtggcacagtaacgcgtcactgccatcttgacctcccaggctcagtccatcctcccacctcagcctctctagtaggtgggactataggcacatgccgtcactcctggctgatttttttgtatttttttaatgtgacaggggtttgccatgttgcccagg

SEQ ID NO: 132930 - DNA, 1066 bp, Homo sapiens
gcagctccactgccgtcaactcctgttctcctcagagcctggtaactcacttttatttcagtgtgggattttaagaaatatacccattagcaaatgtattctagaatatgatacatgctttataattactttctaaatataaaaatatctacagtaaggccgggcatgatggctcatgcctgtaatcccagcactttgggagctggggcatgaggattacttgaacccaggagtttgaaaccagactgggcaaaactctgtctctacgaaaaaagcaaactaacaaaaattagctgagtgtggtgttgtgtgcctgtagtctcagttacttgggaggctgaggttggagggtcacttgtgcccaggagtttgaggttgcagtgagccatgatcatgcctctgtactccaggctgggtgacagagcgagaccctgtctctaaaacaaaacatcaaaaaattctacagtagatcttagtccagaaaacaatgatgtggtaatttccaagcacatatctgatgattccatgtggaatttaactacctgagtttcctggacaaagataaaaatttttttatggtttgtcaaattctttgaactgatgatcactcttgagattgaaagtacccctttcttctgaatgatgttttccttgtgttttgtttcatattatgtctctatagttagtatattcaatttcttgttttccaattaaatgcgaaagtttatcagaattgacttgctataaaatcatgtaaaaacagtctgagtctgcctaggcgcttacattttttgcttttttttccccctaagaccgtaaaataagctacattttcttaaaatgccaaatgattaacagaggcccttatagtttggatgtgtttttattgaaacagtgtcatttagtactgtatgactgacttccaatgtgtgttaagctcccatccagaaggaacttcagaaactgttagtgaaggctgtgaagataggcttatggaagtataagcttagatcatagcttatacaagaatgttgctttagaatggtgaactgaagttcctacccaa

SEQ ID NO: 132931 - DNA, 1019 bp, Homo sapiens
aaaattaccttcacttgcagccgggcgccatggcttatacttgtaatcccaacactttgggaggtcaaggtgggtgcatcacttgaggccaggaattggagattatcctgggcaacatggcaaaaccctgtttctactaaaaatacaaaaattagctcggtgtggtggcgcatgctggtgcgtgcctggaggcccagctactcaggaggctgaggcgagatgatcgcttgaacccaggaggcacagattgcagtgagccgagatcacgtcactgcactccttcctgggcaacagcgccagaccctgtctcaaaaaaaaaaaaaaaaaaattgcattcacttgaaaattacttgtcatggtcacttgtatatttcattttctttagaatagctgttatgcgaagtgtaagagactactgatgactacaaatgatcaggaagtcagtgttttgggtttagtagtatgtagaataagattaaatttttcaactttccatacagctttctgaaacaaaggtcttcactgcctcatctgctccagcagagaatcacatcttacctgggcaaaggtaaatactttttgccatcttatatttgttattcaaagcattacagaaatcttttgcctcaggaaaagtattttcatttttgggtctctttctattttttccctttttatccaaggctaacttttattttaccactacttggtaaatctgacagagcttcaatcattttctaattgatgtatccactgatgaatttgttagcagttgttgcagacatcatgttaaactttttttttttttttttctattttgagacgtagttttgctcttgttgcccaggctagagtgcagtggcgctatctcggctcactgcaacctccgcctctcgggttcaagtgattctcctgcctcaagcctcccaggtagctgggattacaggcatgcgcccccacgcccagctaattttgtatttttagtagagacagtttttccatgttggtcaggctggtct

SEQ ID NO: 132932 - DNA, 1209 bp, Homo sapiens
caacacttttgaaagtacttagatgtgttatggatgagtattctgtaagaactgtttgagcgcatcctgtgtactgactccagaacttaaagcagcagacttgatatgagcaagagtaatgttgaactttgctggagacctattaggaagccatgtagtagagctaatattttattaaaaggatgcttctctaaatttgataattcagtaatccacctgaaatagggtccaagacagatttgccttaaaatgaaatttgttgttttgaagactatatcggaagaaatcaaaccattgttaaatgtctatatttgtgctacatccatacttttcttactcatggcagaattgcttggatgtgacctatattgaagcaaaatccatttgaaacactgatttgaggttatgtagatagtgactactagtcaagttgcatttgtaaacattatttcaaagagaaggggagaaaagaaatattactgattttaccgagaatagattaagaacgtcatgtttcttgggttgtaaactaaattgctagtgaggcgtatgtatcttttttccccgcatagtacacaaaaaggaatcatttggactgagactgtatttgactttgtggtataaactttgattgctgttgtttcccaacaggggcttggaagaattctgtggaagagtggacaacagaagactggactgaagatgtaagtgtttgctgtcagatgagacctttctttttttttttttttgaaatggaatttcacttttgttgcccaggctggaatgcaatggcgtgatcttggctcattgcaacctctgcctcccagattcaagcagttcttctgcctcagcctcccaaatagctgggattacagatgtgcgccaccatgcctggctaattttgtattttttttttagtagagacgatgtttcaccattttggtcagggtggtctcaaactcctgacctcaggtgatacacccgcctcaacctcccaaagtgctgggattataggcgtgagacactgcgcctggccgatacctgtctttctttcggtgtttggtggggactttggtgcttggaagaaagagcctgagacatcttatctcatcttggcttcttttctggcatgtatcgtagccagggtttttgagggttggcttttttagcagatgcttcttaaaaggaacttagattttcagattttta

SEQ ID NO: 132933 - DNA, 1042 bp, Homo sapiens
acaaaatgttttcttctttatctaatgtttctgtaaaggagcatataaatctaagctgtaaaagccaaacttggattctgacttgggaagaaaatacctgttgcctatttatgccttatttttcagcaggactctcataagagctcttattctgccttgaaagattatacgtctccttgtctgctttaggatgcagaggaccgtgtttcaggaaaataaggctattataccagaatgtgtggaaggtccctaggcaacttctggttttcacatctgcatctccatggctggcagaattagttatatttaaataggggaaggagaggtgatgtcttttacagtggctgtgagaaggcactgggcttgtttggtggaagatcatgtatggttaatattttggcttaggtgtttgcttcttttgcctttattatttctttatttcaaaccccaggacatttaatcctgcagactattcagattctacatctacagatgtgtgtgggacaaagctagtagtttgggaagctgctcagaatggtgcagatgagggaactggtaagtgttctgtttttgccagagatgagttttaaatgtttgagctattaagagttgtatgttctcatacaaagatgaagtctaaatgtgctgatggaaaagaatgaaaaacaggctactgtcctacctctgaaactattcttagttggttcttaccacccaaagtctgtcacatacaaatctcatgatgacaaggaatttgattttcccttctgcaagctaagaaagaggctatataaggtaattggcataaatcagcacaaacccacactctgatcaaagtatgtcacagatatatagaatttctgaggagaagattttttactggaagtacttcccatttctaatggtggattctttggccagataatgtatgataatgtggtagatgatagatgggtttgtagcaacgttgcctctgcaggtttttctgtatcatgctgtttctggattatttattttctgaaattcttggggtaaatattgg

SEQ ID NO: 132934 - DNA, 1073 bp, Homo sapiens
ggagtgcagtgaggagatctcggctcactgcaacctccgcctgttgggtccaagcaattctcctgccttagcctctcgagtagctgggactataggtgcgcgccaccacacttggctaatttttatattttttggtagagacagggtttccgtgtgttagccaggctggtcttgaactcctggcctcaagtgatccacccgcctcagcctcccaaagtgctggaattataggtgtgagccactgtgcctggccaatttttgtatttttttgtatgttgcccaggctggtctcaagctcttgggctcaagagatctgcccccctcagctggaaattacaagtgctggaattacaagtgtaagccactgtgcctgacctcattcagtttttaagtcacttttgtttttgtttttcctgtttttgaacccgttgtttaaattgtagcctgtttgtcattccttctttgcctttaataggtgcttgataaggttatgtacaagaggtttggaaatggaaatttgatttttctgctcttttccccctagttagaggtgaagaaaatggaattgattgcaatcaagtggacaaaccttcagatcgtggcaagcgagcccggggtagaggtaagctagagtaagagggaagaaaatgctttcaattagggggaagaagcaggcagttgcgttgctggactgtgactagggatggcagtgtgttctgaaagaatagcaggtcatctaaaatctgatcatttgtttactgatgcctgtaaatgaactattttgggttatgtagttttgaagaaaccaaagggttgtttttggatgagctgagaaagccctatgaataatttaaaacttaaagctctaaccaaaagcattgacaaattataattgtattacgtttggaatacaatgcaatagggttttttaaaccttattttaaaaatactttattgctaaaaaaggctatgatcatttgagctttcagtgagttgtagtctttttgctctagtcctcacttctagctattttgaagtgtataatacgtaattgttaagtagtcatcttactc

SEQ ID NO: 132935 - DNA, 1020 bp, Homo sapiens
agctgtgggtagttaggtttgaaagatacgtgcatgtgccgggcgcggtggctcacgcctgtaatcccagcactttgggaggccaaggcgggcagatcacgaggtcaggagatcgagaccatcatggctaacacgatgaaaccccatctccactaaaaatacaaaaaattagttgggcgtggtggcaggcgcctgtagtcccagctactcaggagactgaggcaggagaatgttgtgaacctgggaggcggagcttgcagtgagctgagagggcgccatgcactccagcctgggcgacagagcgagactccgtctcaaaaaaaaaaaaaaaaagaaagatacatgcatgtgcctttgataattgtacacactttgaatgataaatgattaacagccgttctctctgatagacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatgtaagtacagactttctcctcagttttttctcttctttcatctcaagtgaccctcccgcctcagcctcccaaagttttgggattacaggcatgagtcactgcgctcagctttctcaaattttttcttagtttccatacattctgaacgactgaaagattagtccatagtatgctcataaattcgtttcctcaatgcagaatttgttctaatagttaacactagaaatgagtggcacctgagtagtttcataagcgcctcccatgtggtttcgtatcagcattgacctgggctgtaggcaggtggttgtgtagtgtgatgactcccttctgttatgagtcagacacatttgttaattttagaatggtgtgtgtgtggcaaagaaggggccaggggccatttagttacaggtagataaagctgttttatattctccatttatagacactcatggtata

SEQ ID NO: 132936 - DNA, 1050 bp, Homo sapiens
atagttgtgagccactgcggctggcctttgaagtgttctaatccaaatggtgaaagccagcatatggaatattgtccctgacaaaaaatttgtattggattttccatgaatgatgaccgtgtactcatatagttccacctcatatttaagtttaggaatcctgtgtgcttgaattaaatttgattattcagatacttgatcttgggtattctgagaatgttggtacgtatgtgtgtgctgctgattaatgatctgctccttggtcaacttggaggaagattgatttgtagttagattctaccagtgttagtgaaaagacatgcatggaatggccacaaaaaaataagtaaacatgtcctcattgtaaactcaagagtctagaagaggccatcttcatgtagaaggattatgtaattctgtatttgtatagaagaatcttaatatcaagtgccagttttttgtttgcctctaaccattttctgatatgttcactagcttatggaagtgacagggaaaaatcaggatgaatgcatagtggccctacatgattgtaatggagatgtgaacaaagctatcaatatattgctggaagggaattcagacacagtaagtattattaattgatttgcattgtttacatttgtctccaattccgtagcacattttcaacttcaccttgtttgggggtagggatggaatggattatggtgccattccatatttgttttaagttccagaaagaacgattacctgaaaagactgtttttgttatgtatggtttcttcatgaagtcgtagaatctgatgacttgaaagagaacttggtgatctactccagccttacagtttccaaaaatctctgtgcctgtgtatattttcaccacccccacctgaaaagcatctcttggctctgttgcttatgtttcttcatctcagtcctcacctctgattacttcttacatctctattataacagaaaaccaggatttgctggtatatgtatttgcttatgtggaatattaagttttcttttttttttttaatattgggt

SEQ ID NO: 132937 - DNA, 1036 bp, Homo sapiens
cacaaagttctaagcctgtgtctgggcagttgtttgcattaccttttattttttcttttattattttttgcctaccaactacctctaaagatttcattactttttaagccttttttttttttaatctttttaaaaattaaatagagacagggtctctctatgttgcccaggctaatttcgaactcctgggctcaagcagtgcttctaccttggcttcccaaaggcatgagccaccatgccccgccaagattttattattttttgttcttctgctttctcttgagctgatttcccccactctaccaagggaaagaagattcaagtaagtcattggccagttaagatgaacaatagctttaggtcgtttggtcaaaggaatgggtcctttatgttacttaatttgatgcttatttttcctatgggaacaggttatatatggttgagaggcctaaattcactgtcttttatttgttgttacttagtatttctagtgcttgagagccttatctgtttgacccagattttggaatctaacttatgcttttggtgttcaaatccttaacaattgtatgtactttccaggcaacagctgaacagatgcgtctcgctcaagtgatctttgataagaatgattcagattttgaagctaaagttaagcaggtatgtttctggcaaaggatatcatcatttttataatctattttgattgtgcttaaaaagataatttcagtaaagatttttgttttaaagtattacttctagcttctagtctcacctgaaatctgtatattggattttggacttgtgattaaaaatacctttattggtgggcaagtgaaggaattgaatacgttcacctgccttacaatataatctttctgagttactagtgtttacatgtgaacattgaaccagacatttctgtaagcacactgaggttttccgatacctgtgcatagaaagtatatctaacatttggcacagtctctgggaattgtgtttaatgttagagatgaactgaattacctttaaaaaa

SEQ ID NO: 132938 - DNA, 1038 bp, Homo sapiens
ttccagctctttgggaggcagaagtaggaggattgcttgagttcaggagtttgagaccagcatgggcaacacagtgagaccttgtctttatgaaaataacaacaacaaattagccaggcatggtggctgccatggttgctactcaggaggctgaggtcagaggagtgcttgagcctgggaggtcgaggccatggtgagctgtgattgtgccactgcattccaacacagagtgaaaccctgtttttttgttttttttttttaatgaaaaaatataaataccaaatacataaatagttttggtgttagatggtcactttatggatttttcaatttttcttgtgtttgacttgtaaagcttataatttaagaaactgtaatgatgggaagggatgagcatcagtggtgcttggattggaacaaggctacctgaatctgctggtatggtacattttttaggtttgaaacacagggagcagaaaataatagtgttagggaaaacaggcaaactcttcatacaggcttcttgcaacagggacactaacagtctactttcattttgtgaaaattgattatatgaattggagttatcttgtcatacccaactaaatttagagtcagtggaccaagggttacggtaaaaaagtgcttggggcacaaaccgcttgcccagggattatattgcaggccagctgccacaatgacatgctgtaaccttaaatccagttttacctactagctgttgagatgaactcttgtgactctaagtctagttttaccaaccgtgttcactcaccaatcagagcttaccagctcccaaaagctttagtagttccagtgagttttctttcaaaacaataggtcacatttctttttctaataaaactcccaaccttctttgtgttctttggacacactaggaggctaccctagtatgtgtatgtatgtatgtcctggattgcaatcctacttatatattctttctaaataaaaccttttttacttagagatttgtttctctctatatttttgactttaaca

SEQ ID NO: 132939 - DNA, 1082 bp, Homo sapiens
ccttgtttaacttaagaattaccagttgatcctgatttttcctcttttttcccaagctgtaccgacctcttgacacttcctagagctcagcctggtaacttccctattatactcttatgtttggtgctttgtttatcaaatatttattgaattgtttatcaaagaaaattatttttttcttgactcagggtattttataaagttaaaaaaaatacttaaagttctcattaaaatttattttcataaatatgctagcactagtgttactatattgttattgttaaatgactattatgtgtattggctatgctttcagaagtagtctgtctatcccttttatgaataaaaaagatattactgaagagaaatacagtatttgtgtcatataatacttaagctgaaaaagctaagtctgaataaatcagtcattggcatttaccttacatatggcaatgaatagtgactttatagttagaaatgtatgggtgaaacagtatcagaatgataatgtagaaacatatataagccccagactgccccctacagcaaaatgcgattattaataactattctgcttgaaatatttggtgagattctttcacccatcaagtgcttgtttgttaatattttaatcgggtcggtgtttctttggttttgtaaattgtgcacgtttacaaagcactggctgttctcaggcagttttcaagtttaaatattcttgcctttagggtcattatttgttcctggttcccccactctgccattactttttcatactttttccacaaagatttcagccatactccctgactttggtttatcttctactctgacatatctgcatgaagtagtttctgtctgaaatgtcttgaaaccagggatgttcttataataatacttactgtgcagtgagtggatagccacaagtaatccataattttactttttaaaaaaaaatgtttgttgtagctcctgtttaacacatctaccaccccaagccgccgcctgtactccttttctgtctgccaaaatccctccccacaatgctttattatgaaaatggtcacagatgaagaaaagtt

SEQ ID NO: 132940 - DNA, 1083 bp, Homo sapiens
ctcgtgaattgctgggattacaggcgtgagccaccgcacccggccacacaattgtttctttaagatttattatttacagctgacttttgcttttaggcatagcctgtttcttgacacattttaaattgggctattggcaggtaaaatcttggctgggtgcaatgttgttttggggttcaaatagcaactgcaagtagtaagaggcagatagcacttcatgtacagtgactacatgtagtgataaaatggttgctggttaaaattggtggtacttgagatttttgtttagaattgctaagctcgtaaaccatagacttagattgcagtagtcgaattggtttaacagataccagcaaaatgtaaaatcctcaagggctacttcttgagaatttgtattccagagagcttttatcttttattgtaagtgtccttgttttctctgaagtacatgcttatcttttactatgattgttttgcttaccatccctactttcttgcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggtaagtttttgtggaactctttttttttttttccttttttttcttttattattatacttgaagttttagggtatgtggaactcttgtttgccttgtttagaattaaggaaattaagggagagcatatgatttaatgttttcctttgtaggaaactttaggattttggaccctttgtttaaacagtaggtgatggccgggtgcggtggctcacgcctgtaatcccagcactttgggaggccgaggtgggtggatcacttgaggtcaggagtttgagactagcctggccaacattgtgaaaccctgcctctattaagaaaatacaaaaattagctgggcgtggtggtgtgcgcctgtaatcctagcttctcgggaggctaaggcaggagaatcgcttgaactcaggaggcagaggttgcagtgagcccagatcacgccactgccc

SEQ ID NO: 132941 - DNA, 1043 bp, Homo sapiens
ctgtttcactgaggtatcttatcttcagaaaggtccttgaaaaaaacagcagttaaaccgggcatggtagctcaggcctgtaatcctagttctttgggaggccaaggtgggaggatcacctgagcccaggagtttgagaccagcctaggcaaatatgggaagatcgtatgtctatgaaaaagaaaacaaaaacggaaacaaaactttttaggcagttaaaacttttttccaaaactattcctttcatagagaatatctttgtagttttatcaggttggtttattcggccggagactttctttcctcattacatttagacaattttttcactttaatcgttaataggaagctttatattatattttgctgattttgtttctaaagaagttaaaaatgtagcagcagttctttacctgtgttaaaatctatcacatctttaattcactttgaggtgagataaatacgggtttcaaaatttggttggatagattgaagtaagcctggtgcttcctgcccctcaagaacttgagataggtatgtttgagtttctactggattatttttagaatcttttgctcttgtctgtttctattctgagaattctcttggaacctgttccagtgtagtagaactcttgggagtggaaagtgatagatgatggaacacaagtgtacactgaattcctatggtctggcaactgggtacttgttgtagaagcattcctatttactacacacagctccatttcccagaaaaggaggacatagaagttcctcctaacagtatgttagttgaaggtgttgatttttacggtctagtttccatgtctcagtcatttttacagttcagtggtggtaacaatttttaagggtcttgaagaatattttggtaacttacgcttttaccttgatttaatggattcacaattatcagaagttttttttttttggggagacagagtcttgttctgtcgccccgattggagtgtagtggcatgatctcggttcactgcaacctccgcctctcgggttcaagtgattctc

SEQ ID NO: 132942 - DNA, 1057 bp, Homo sapiens
tatgccaggccagattcttttgtttattttttaataaataaattcaagtggattctcctgcctcagcctcccgatttgctgggattacaggcatgcgccaccacacctggcttattttttgtatttttagtagggtagggtttcactatgttggccaggctcatctcaaactcctgacctcaagtaatcctcccgcctcagcctcccaaagtgccgggattacaggtgtgagccaccgtacctggccttggcctcagattcttaatctgagctttgtcttctgcaggtatgaataaatgaatttcctctgcagagaaggttgagaatattgactgttttcttagtagaaaatgcgggaacacagattagaaattaaacaaaaataatagtagtggtcacagaaatataccagtatagaacatatgggtatctgaaaggctgagaagctaggtgagatctgatctagaccagatctttgtcatcaggcacaagctttgcaggtgatgccaacaatagttatgctgttgtatagaagaagaagctgaattgggaactattatttatctgtgactgaacagttagccttacaacatagcataatagttaagtgcacacactgtagagccaaatgtcctgggtttgaatactgccttcaccacttactagctgtgattctctgtgtatcttagtttcctctctgtaaaatgggagtaaagtaatgtgtactctagagtgttggaaagattagtgacttaatactgtacatataaagtgcttagaatggtgtctggcacatagtgaatggtatgtgctttctgctagtattgtcattaccattggttttagattttgggaatgagtggacatatatagatgaaggacctgagacccatccttgccagtttgagatagaccctgcaccactggtctcatgactcagtgaacagcatctctggacattcttgatgaagacttgcttctttaacataaattgtgtatcctgtttttagtagttgaacccttagcccattatgtaattcatgtcatctgaattata

SEQ ID NO: 132943 - DNA, 1037 bp, Homo sapiens
tctgagccactacgcctggccctatgtacacatttttaggtgaacgtgttttcagttctcttgggtgcatacccaggagtaggattgcttggtctttatcataactgtttaatttctttaggaactgttaagagttttttttattttttaggagatgtggtcttactctattgcccagtctggagtgcggtgacatgatcatagcacactgcagccttgatctcctaagctcaaggattcctaccacctcaacctcctgaatgggtgggattccaggtgtgcgccaccaagcgtggctaattaaaaaaaaatttattgtatagacgaggacttgccacgccgcccaggtttgctcacctcctgctgtgcggcccagttcctaattaccccagtctgcagcctgggagttggggattggggatccctgctttatagtataggcttttttgcttttttttttcctttttgtaggagagagagaactgttataagtagtggtgaagactggttatgaataattacatgcttttcaagagattccagggtgaagagtcctggttacctgctgggcaaaagacaaggtttaaggctggtcgcagtggctcgtgtctgtaatcccagcactttaagagcctgaggtaggcggatcacttaaggtcaggagtttgagaccagcctggccaacatggtgaaccccatctctaccaaaaatacaaaaaattagccgggcgtggtggcgggtgcctgtaatcccagctacttgggaggctgaggcaggctaatcgcttgaacccaagaggcagaggttgcagtgagccagtgttgcgccactgcactccagcctgggtgacaacagtgaaactccatctcaaaataaataaataaataaataaataaataaataagacagggtttacagctgaattagcaggataggaataggacagatgtgtgcaaacagctatgggcaattaattcccttcgtggccttaggtaacctgaaagagaattgtgacgatatcaaataaattttgatg

SEQ ID NO: 132944 - DNA, 1086 bp, Homo sapiens
aaagattatcttttatttgaagggcatataatttcttgggtgaacccagttcttatattcctcttccgttgtgacagcacttttttcaacaaggggtatgcgactagttattgcattcctcacttttcactgtgaattgtgtatccgttttagtgccagtttgtgaaaggtggaaggaagttgaacatgatacctaagctctcccgtatcctacattggtgtgttccccttttacctcaggaaagggaatgtattccactccctggagatgatagtttccttcaatacactcacctgtggagccccttcgctagggttgtccttccattgctttgaaggcttctcttatcattaggcagaagtgattagtttcccaaactgcccttttgcttgctgccagcatactcctgattttcctacttatggctagttgatacgtgtgacgagagattttcccacagcgctgatttcccccatttgcttccctgttgcctctcaccctcaataattatgaaacctttcagagaaggaaggtttttgttgtgattgaaatatgcccgaaagtggtggcatgggagagaatgaggccatgggaaagggttgtggtaattgcctctcttgcctgtttcctgctgctctggtttcctctgtcctccctttaaatgtgggctggatcagcagtagtcacatggagttgcctttagaactatattggaacaacaataacacctctgcttccctttcctggttactagtgcagtctatgtagtgatcaccaggagtgtctctcttagtattagcctgagtgacttttattgtatggggagaaatggtgtgatggtgtgagaacatgtagactaataggtttatttcaatatgtacttgtattgtgatgggaactggtcccggtatctaccctcttaagtataaaatatgtgtagaaagtacaaacctttcttgaaggtttggagtggtctgaagtgaagccttctttttttttttttttttttttttttttttgagatggagtcttgttctgtcgcccaggctggagtgcagtggcctgatctcggctcactgcaagct

SEQ ID NO: 132945 - DNA, 1705 bp, Homo sapiens
gtctctagggggttcgtctagaagcccgctggagaaaggctgcggtaggggtcgccttggctgtgcagcatgttgggagtcgtggtcccctcgtgcaacatttgggaggccaggcttgccctgagtggttggaccacatcacgtgatgagcacagggcggccacaggggagtaacctgtggtgctttgtgaggtcatcacggcgcgacgacgagctgcagttgtgggcaccttgtatgcggtgggtaatactctcctgatgactccgagtacaatacatattatcaagtctcccttatttgttcctttctgtggtccccacctccacgcggttggcttcgcggggttggggtggaggtggtggctggaagaggccgcgcgccgcctaggctgactctgaagccgcgcacgagcgacgtgttgtggctcctccttcgcccgtgacgcgaggtcacgtgacgggttgggcagcctgtgccgccgccgccgctttgtaagaggcacattggcaggtaacgagcggcggcggcggcagcgggtcttgggtcctccgagagcagcagcggtaattgccatcctctccctctccttccctcttccagggccctgagcgctgcagcgtgtgctttctaattctgggttcagctcgtctgaaaccccaccgcctgcagactgccccggcgcccacccgtgaggaccgggccgagcttcactcgccaggtccacggtccctctacgtccaggcccgggctccctccttcctcttcccctcacgttgccctgtgcttcttcctactttcccccgtccaggtcggctgggccccacccagccccaggggtgcctcccctcccccctttcgggtttctgccctggagggtgtggttttctctcccacctcggtgcctgccagtagactggagcttccccgccacgctgtcggtcccatctcatcacctttccgctttcacgcccgtagctagtcttgggactggccctgttatagccccaacttatgcgctctctaacctttcctggcttacccggagtcacagttcagttctacttcttttcaattctgtagggcattggtctcaattgggactcagttttcctccacacccgccgttcctgtagtctggttatatcacagttcattatttaatgtaggtttttgagcgctttgtaaacggcaaagctctctctgttaataatacatactcaaaatgttattctttcattggtgcattacaactcagttgtttgcctctgaatcactttcccactcggcttttccacattttcccctgagtttttagtctaattagttgcccacgcatctcaactgtcaccactctggtctctaatgcttgctcgctttaggggttgatcccatcattattactgttatttcctgtttgatgtaatccagtcatttactaccacttctattggatattgtttttacctcacattcaaggaaggtatatggtttgccagtatttaggcttattgtctttctacagcaccagtgtatcctaacagttgagagattttaaaaaattactattaattttagagatatggtctccatatgttgcccaggctggcctccagctcctgggtttaagcgattctttcacctcagcctcctgagtatctgggattacagtgtgcaccacggtgctcagctagttgagggtttttt

SEQ ID NO: 132946 - DNA, 2557 bp, Homo sapiens
cagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgcacaatggtgtgagtgagtattgtgtagccaggagcctgccaaaaaggccccacatgactagttggaaggttggcttgagctgttgggattgcttgtggcagaaggggaacacaagccattacctccaggttagaggcaggtcaagtgcaggcacaaatactaagacctgcttgctctgggtccccaactctagcccaagatgagttgctctgaggtccagctgagggtggatatgcccagggtactgaagtagtgtgacgttacttctgttacataagtaagggttggtaataggccctgtctgcttggatggtgccctgagaatgacgctgaaagtgcttgcatagtactctgggaataggatattaatttttgttttttgtagttggaaccatagaccttcactgccctttgtaaggggaagacacagtgaccacagtgagtgatgctcttctagagcctatttg

SEQ ID NO: 132947 - DNA, 1061 bp, Homo sapiens
taagtcataggcctcaaaggaaagatttaagaaataatgatgcttagagcatcattcaggatacataatagtgaaaacagcctaagaacgtatgtcgaagtatttaaaatagcacacttggctgttttttagtgaacagaatctaaaaatgtataaactgaaatatgagaaatacatgaactgtttcctataaggaaggcagggaatgtgtgtctggtagtatatttcagggtataagcattagctctttggaaagtagcctttttaagagtgaatagaaagacagttataaatgaatgaagtgaaaaatttctcagtaagctttgtaaccaacccaattataggccaggataaaataagtcaaagagcagaaacgtttggaatagagtccacgaatagcatgatgtcacaagactggcaaatgaaaagaggcagggcctagggcctaggggtgggaaatgattacgcccagccctccctcggttttcacctcccctgtgtgaatggacaagtaatgtcataatgtgtgagtaaattgaccctggaatgaaacacattttggatcattaaaagagagaagattgctctagatcaagaaagtcttaagtactaggagaagtgtctgtttataaaggacataggcaaaaatttaaacagttttaaggaaggaaataataccatggtggttggtctgtttataaaggacataggcaaaaatttaaacagttttgaggaaggaaataataccatggtggttggggccaacctttcgtttcctcttctgttgaggagtcgcttgtcttacccagaagcctttcaaaactaagtggtggcaacgggcctccacagaacttccttttcttggtctctccagctgcccactcgtggttaagaactgtcatccttgtcacttggagtagaaaaagagtctcctgcttggaagagttcattccactccccgcacgtgcatcatagtgtttagcctagcaaatattactgaattgtaaactgaattaatcatcatagcctcttgcttgttgaatttattgacactattttga

SEQ ID NO: 132948 - DNA, 1047 bp, Homo sapiens
gatcatgccactgcactccagcctggctgacagaacgcatctctgtctcaaaaaaagaaaaacaaacaaacaaacacattcagttctcacacttgaattaggtaggtaggttgtgttatgcgtgctttttatgtattgaggaaacaggatcacagaggttgtgtaacttaactaaggttacaactaggtagactgaatttgaactgaaatctgtccaacctcaatgcctatgctgcattcttttatgccattttgcccctcttaggtggtcacaggaccattccaattcctataaggtataagcactagttttaaagtaataccattgtgaactgcttgttctcattgaaataatagtgtaactggaatgataaatagttcattaaaattttagtcacattatgtcatcagaattctaggaggaaatgaatacctgattattttgtacttcacaaaataaactggataaactggataaatgactgaaagtttcttttttatattgctgagtcagattggatccggttcattaagggccaaaatttgtatttggcagtaatcctcatgtgttctcagaatgcttgattggtcattatcagttgcttaatgcttaccaaacacttccagtgttttgagtcactgaattggctcatggtaattgttaatcttgtggttactgagtcaagagccagcagtgtgtgttttggctgcttcacttcctcctcaacacttgatattgtcagattttaaattaattttttttttctaatctggtgggtttgaaattgtatctatagtgttttttatcagcatttcctgaagctgggcatcttttcatgtattttcgttggtcatttgtgcttctgcgaagtgtatattcaatttcgttgcctatttttttggtcttttctctttttctgatttatttttaagagttctttatatattctggatactaattatttgttaatttataggttgcaaatatcctttcccaatttgtgacttgtcttttcatctcttcatagtcttctggtgagaaaagct

SEQ ID NO: 132949 - DNA, 1145 bp, Homo sapiens
tcaaggagtaactcagtacatttctatataactgagccttaaagatgggaggactgagaaagaagccctcgaagagatagcatttacacgcaatctagaatagatttgaacggagttttcagtatagtgagaaaaagaatattccaggtggagataacggctcatgagcagaagcaacatatagagagataacgtacaaggtctaacagactactagtaacgtggtttggagggaacatggaggaggtgatgagctcaattgctttgtcataaccttatgtctagactatactcaataaggactggttagtcattgaacccttttgaacagttatgaaaagggatgtgacaatttaaaactttaagatcattctagaaactatgtaaaaaatagaaggaaaacaccgcaagcagaagggccaattaaagaggctactgcaacagcccaggtgaaaaatgaggtcaggctgaactgcaatgtgagacacagcaaatctaacttgagtgactgaaaagagaatgaggacattagcagagaaagggaaagaggtgaaaaagctagttaaatgggcaatgggaatttggtctgtgtgaggtacagggccccaggaatatacaatctaacagaggacacaaaatctgtatgtgtgtataacaatgtgagccaggcaacaataggagctataagaaacaaaaataagataatacagtcataatgacaaggatacgctctaaaaaatgcatgttaggtgatttcatcggtgagggcagagtgtatttacacaaacctagatggtacagcctgctatacacctaggctatacggtattgctatggtacagtattgctcctaggctataaacctgtatagcatgttactatgctgaatactgtaggcaattgtagcataatggcaagtatttatgtatctaaacctatctaaacatagaaaaggtacagtaaaaatatggtataaaagattaaaaataggctgggtgcagtggctcacgcttgtaatcccagcattttgggaggtcgaggtgggcggatcaactgaagtcaggagctcgagaccagcctgactaacatggtgaaaccctgactccactaaaaatacaaaattagccgggcatggtagtgcacac

SEQ ID NO: 132950 - DNA, 1054 bp, Homo sapiens
cctgtacctcacacagaccaaattcccattgcccatttaactagctttttcacctctttccctttctctgctaatgtcctcattctcttttcagtcactcaagttagatttgctgtgtctcacattgcagttcagcctgacctcatttttcacctgggctgttgcagtagcctctttaattggcccttctgcttgcggtgttttccttctattttttacatagtttctagaatgatcttaaagttttaaattgtcacatcccttttcataactgttcaaaagggttcaatgactaaccagtccttattgagtatagtctagacataaggttatgacaaagcaattgagctcatcacctcctccatgttccctccaaaccacgttactagtagtctgttagaccttgtacgttatctctctatatgttgcttctgctcatgagccgttatctccacctggaatattctttttctcactatactgaaaactccgttcaaatctattctagattgcgtgtaaatgctatctcttcgagggcttctttctcagtcctcccatctttaaggctcagttatatagaaatgtactgagttactccttgaaagcaacaaatagccctgtgttacttacttactgcagtacacatttactaaacgcatgtttatgagaggtggtctactgggcactgcaggtagagataaatgccttaatcactgccctcaaggtacttacagttgagagaagttacctagagcaacagaaaaatatggtactttaactcttcttcctgtgacttaagaagatttttaaaaatgcagctttcaggaaaagaagttttgtttttctggaattcactaaggcatcaccattttattctaaaaggtattactttttttatcttccaaagtctatatgcagtaagtaatcataatgagggaacttcagttacttttgggagaaaaaaaatatttattgagatataattcacataccatgaaatttacctttttttaaaaaaaaactttttttggtttatttgtagacacagtctcac

SEQ ID NO: 132951 - DNA, 1097 bp, Homo sapiens
atgcgtgcctaactgccccctaggatcctctcctgggacagcatgaccgtttttcacagtgctggtcacctggattgggccgtctgcactgacttctctcagaggtgtggtgactgtgtctctttggtctggggatccaggaactgcaacgtgggacaatgagatagtgaaaccatcttcctctggggatggcaagttgccctcattctccccagaaacctcactttgggaggcatcctttctgagatcaaaggaagagcctccacctctttcctgtctatatatgaaatctacctgtgaacagtatggcttctctgccaggctgtctctgggagaaggccctgaggaagtagagttctctctgctccagtccacgggccccttacttgggctgcagctgtgatcgagtgctgctcttctgtggtttatggggtccctggagtccacccagcttttagttagatctttcttgtcacctgtcctggggctagaaaacagactctgctgtctttctgccacctgcttctcaggaccctgtccccacgtctggtgcaggaagaatgagtcttcgctattctccagggtgttcctttgctttgtggccctctgactagagatgtgtgaaaaagaatcttcactgaaatcactgtcatcaagttcctctacttgggctccatcatggttttcagagtaagagtggaacagaggcggagtctcattcgtgagctgaccctctgggggcctgtactggcgtaaagaccttttcagtggttggtattttaacttctgttggaggagaggtggctgttggaactgctggtgatagaaacgcagatgttcctccctctccttctgatgtggcgggatgtttgtccaagcttcagaggcaggcctagcaggcgtgcccctctggctgtcttgactgtactcagccctgtggtgggcgttgccaaaggagagctcaactcgagacacaagctgcttctgtactggctgcactgtctgcactttcttgcacttggtggacagcttaccacgcactaggccttctcctgggcctgaggccctgctttcccacccaaggacagttttgttgc

SEQ ID NO: 132952 - DNA, 1015 bp, Homo sapiens
agaataagaggaaaagggaacattctgtttcagcatgagatatccctctgtacctgaatgaaaaagagcagtgttggctggttgtagtggctcacatctgtaatctcagcactttgggaggttgaggcaggaggactgtttgagcccaggaattcaagaccaacctgggcaacagagcaagacctcatctctactagaaataaaaaaattagccagacatggtgatgcgtgtctgtaggcccagctacttgggaggctgaggcggggaatattgcttgagccctggagttcaaggctgcagtgagccatgatcacactattacactccagcctgggtgacagggtgagactctgtctttaaaaaacaaacgagaaagaacagtgtcttctctgaggatgtaagcatgcacccaacattccatgatcagaagaagccttttggaaatcaccacagccccatgtaagggacaggccagagacgccagtctcagaagtgcactgtgtttatgcagggcccacactgcttcctggagagaggccaactcaggagttcgtgtccaccacttacctgcaattccacagagtcctctttttctgcaaaccaccccctttcaggcttctctaggaagatgagttccctcaaacctgctgggacctcaggaagcaaaacctccagaaatacacaggcttgtgctcattccatgaaaggaaaaatgacttgtctattcccagggtttctcaaccttagcactattgacattttgtaccagataattatttcttgaaggatgtttagcagcatccttggcctctgctcactagatgccagtagcacttcttcccagtcatggcaatcaaaaacatcttacctactaggagagcacatgtgaccacagggtgagagatggaagggatcccagcagataccacagtcacccacaaagaggcctggccaggcagtcaagagttgctggctctgacaccaactcctagtgagcctttggaaagatcctac

SEQ ID NO: 132953 - DNA, 1624 bp, Homo sapiens
gtgagactccatctcagaaaaaaaatcaatgaacaaaatatatattactattatatacgtatagttgggctatatgtatataagaatatatatgtatgtatatttttatatatgtgtgtatatatactatatatacgagctaccaacataagaatgatatatattcatacatatatatatgtagttgtacctaccaacatggtaagcccctaaattatggaaataattacagctgctgaattaatgcttttcagacccaatgtaatggggtcttttttctgtctttttccaaattactgtgatttttcatttggaagtcgtcttggacccctttctctccccagctccccacctctagtcagttatcaaatttcttctgtatccatctctttatttccatggttgtcaaataatttagatgctttttacctcaccactgaattactagtgtctctgttctcaaaccattcatagtgtgaagccagattaatcttccagtaaagactgaaatcatccttcttgcctataaagttagtttttcattgtttccccactatttactgaattaaatatgagcatcctgccccccagttaagactggtgtcccaagacccctacaacacagtcctaactcattattctagtattctgtctcttttttttttttttgagatggagttttgctcgttgcccaggctggagtgcaatggtgcgatctcagctcactgcaacctctgcctcccgggttccagcgattttcctgccttagcctcccaagtagctgggattacaggcgcccaccaccacgcctggctaattttttgtaatttaagtagagatgggtttcaccatgttggccaggctggtctcaaactcctgacctcaggtgatccacctgcctcggcctcccaaagtgctgagattacaggtgtggagccactgcgcccggcctctgtttcacttttctacttactgtgatactgtatttcaatcacattgaatccttgctattccctaaacattaattaattaaacagttaattccttgtgcttctatgctttgactctgttcatacttcccctgtgcctggaataccttccccccttccatcactccctttcaaattcctcttcttcccctgtggtccattctcagtatagtctttttcataatcagagagaatatgttttcctttgaaatcgacacgtactttatcttaagattcttctaccttccagtcatttgcatacttgtgtagattaacatttttaggaggtaagatagggaaatgctagggtaatgtctatatccttgggccccttcaagtgcctactgcaatgtatgtgctaccagctgagcataaatatttatggaattaaaagttaagctgtgtaatctacagaattgagatcttcccctagaattcctccaaaattctttttttttttttttaaatggaatctcgctctgtcactcaggctggagtgcagtggtgccatctcggctcactgcaagctccacctcctgggttcacgccattctcctgcctcagcctcccgagtagctgggattacaagtgcccaccaccatgcccggctaaatttttgtatttttagtagagat

SEQ ID NO: 132954 - DNA, 1001 bp, Homo sapiens
gattctcagctgtcttgggcttatacttaattggcgaaaattgggctctgagcagaccactttatacagggtagattgcagtgggtaaataaaatccagagatatgatttcacatctaacatataagggtttaaataaaacactaataactcagccatgtaaataatgttcactgcctgctagagtgattatgaagagtccaaggagaaagagtttggtattgaaagaaacttattccaagctgaaggtaccttgcaataattctttagtctcatagggaaacagcaaactccacagatggaaagaatcatcatttaggtactcctaaaattgtgaaaaattgtgagtaatctaaaaccagataatccattggatgttaagatttgagagtacacagtttctcttactctgaatctacttccctaaacattcatattatatttattctttctctctctcttgttctcttgcctcaaaacccagtgactggtaggaagaaaaaaaaatctggtatgctagcaattcaccttagtcagctgagatcttacattagtggaataaatcctttaatgctgaagtgatttgttaacactttcaccctttttcaaacttgtattgttcttctttttctttggttaccaaaattgtgtttcacagagatattcagagtaatccactgagtctttctactggtactaaattactaggccactgtaaaaccaacccaatcactttaacagccttatcgattgctgatcaatgcacggtctattagttctcagtgggagatatttattttgaaaatggactaaatgaccaattagttgtaatgctatctagttccatggctacttatagccatcgtaatagccctatccaatcactgtctacctaagacttccttaatgatgcttctgtcacagtaattccatcaaggaggcatcatcttatctttcgtatttttctgttatccccaaacacaataaccttactttttttgt

SEQ ID NO: 132955 - DNA, 1059 bp, Homo sapiens
ccaatactttttttttttttgagacagaatctggctctgtcgcccaggctggagtgcagtggcgcaatctcggctcactgcaagctctgcctcccgggttcacgccattctcctgcctcagcctcccaagtagctgggattacaggcgcacgccactatgcctggctaattttttgtatttttagtagagatggggtttcaccgtgttagccaggatggtcttgatctcctgacatcgtgatccgcccacctcggcctctcaaagtgctgggattacaggcgtaagccaccgcgcccggctaaaaggtaccaatactttgacctgttaagtaatcttgtcctattattaaaaattaaaagcctgtttataaacatattagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcaggtatgatgttttcgttttatgtttggaactaatattatcaagtatgtcatttttttttgctttttgtttgagtggtggcatacaagtttctgttagaacactgaaaatcaagtttctggttcgggtgttgacattcattcctgatgtgacactgtattaagtcattgatatccagggccttcattttttcaaaagacggtgcaataggggatacaaaaacaatttctcttgtgcagtggagctacatcatatattcacttaacatgctttgtgtgaatttaattatacatattcagcaaaaaaaaggaggaatgaaggaataaaaataatttaaataatgaagtggggccaggtgtggtggctcacgcctataatcccagtgctttgggaggctgcagtgggaggatcacttgagcccaagagtttgagaccaccctgggcaccatagcgagatcctgtctctccagaaaagatcttaaaactagccca

SEQ ID NO: 132956 - DNA, 2207 bp, Homo sapiens
ttcacaaaacaaatctaccagccagtgtggtggctcacgcctgtaatcccagcactttgcgaggctgaggtgggtggatcacctgaggtcaggagttcgagaccagcctggccaacatggcgaaactccttctctactaaaaatacaaaaattagccgggtgtggtggcacgcacctgtgaatcctagctactcaggaggctgagacaggagaattgcttgaacctggaggcggaagttgcagtgagccaagataccaccactgcactccagcctgggcaacagagtgaaactccatctcaaaaaaaacaaatctaccacaaatagaaggccaggattagtttaggatgtgttactcagcccatttagccttttagcctaagtagtatttcccccaaagctaattattcaacgttctttggttatctttattaccttgccctcacctctttctctgtttctgctagaaagaagatgaaatagaaattaaaacgaaaacaggaaagttgtaccactagttacctaactgaatttttgaaaactctgaattatgaaaccattttaaaaaagaaaatgtactgtatttacttttggatattctcatgaacttgattaacagtgatatagagagctcaggatcctgacttttaataatagaccaggattatgtgttattaccacattatttgttagtatttaattaaatatcttgatattaaaattttttaaaagatacaactatttaaaatcttgaccttagtattaatttcctgggcaaattatttgattcatattctgtacaggtagagatcgatgaccaccttttggaatgatctgaaatcctgaattggctgatgctgaattgatgatgtctttacttctatttaactaacttttgccagtactcagcaaatgcaaatgctatcttcctttgagttacattagtttataatcctctgtggtatgccatttaattctgcttttcattctgaaagagttcttagcccctgttcattattcatgggaaacagttgtgcagcatgccttgacattaagttgagcatctaaaattagtcctgctacaatcagttgttgggaacaaggtttcaatagttgtggcatgtgttaagtagacattgcaaggttggaaggaactccctagaaataagtaagttatgtgttatgtatgtgttcatttgtgtatctatgtgtatatatatatgtgtgtgtatatatatgtgtatatatatgtatatatacacatatatacgtatatatgtatatatatacgtgtatatacatatatacgtatatatgtacatatatacgtatatatatacatatacacgtatatatgtatatacacgtatatatacacatatgtaaaatggaatgtctctttttattaagcaaattaacaaattatatgttaccacaaattcttcatatgcaatacaaagcatctttgttcatgcactatgctatttaatcaataatttcagaagaaaaatatgttattgagaacttgacagataaaacattttttgcatgtttgttttgtggttttgtggttttcaatttttaaaataaataattgtattacatgtactctatttcaagcgaatggcttttctttctctcttcagagtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgca

SEQ ID NO: 132957 - DNA, 1079 bp, Homo sapiens
aggtgaaattagaaatatatataattttttatttagaaatatatgtttaaaataaataatacagtcacatagtttcaaaatttaaaaaataaactgttttaggtcttgccctgggtgatagagacaccagtgacatagaaatgacaataggaaaggtaataataactaccagcatttaaaagtatacagtagtttccttcccataatcaccctctaccacctacttcccctcacctcctcaagaccactattattgtgcatcctgcaagtgacgttttttgtctgataagcaaagatatagatttattatagatcatttatctctctcttttacaaactgttctgtaccttgctttattaacaatatattggacagctttcttttttaaataacattttacagtttacttactctttgtaattgtctcatagcattatttcattaaatggactatcataatttatttcaccagtctctattccatgactttgctattacaagctgtgctgtaatgaataacattatagttaacgtcattttgtacttgtacgtattatctgaaggataaggataggttcctagaggtagaattgctggatcagtgcatttgcatttgtaattttgatagatataaatcagtggcatgcaatcataatcacctagggaacttttctgaagttgttatgtctgcctttcctaaaacctgggagttatttcttgttgttttttggttttctatagatctgggatggggctcaggtatctatatattttaaagtgtctaaactgggctgggcatggtggctcatgcctgtaaccccagcgctttgggagtctgaggtgggtggatcactcgaggtcaggagttcgagaccaacctggccaacatggtgaaacctcctctctactaaacatacaaaaaaattagccgggcgtggtggcgcgcgcctgtactcccagctatttgggaggctgaggcatgggaattgcttgaactcgggaggcggaggttgcagtgagccaagattgcaccactgcactccagcctgagcaacagagcgagactgtctcaaaaaac

SEQ ID NO: 132958 - DNA, 1045 bp, Homo sapiens
ctgtagtgcactagcatgataatagctcaccgcagccttgaacgcctgaatctagcccctttagacctcattttttccatctggaaaatcaaagaattgaattagattaaaattcctgtggctctactctcaagtcaagtagttgatgtcaggtagaccacacactctcagccttccaaagaccatacagactttttttttagctgctgaaagtagtagttaccatttattgagtgttcaccccgtacaaagcactgtatccagggctttatatgcatattacatttttcttagtgtagcacattactgctaagatagcattttatttaaaatttgtggttttatattgttaatgaaaatctttagttattcagagtgtgtccttggggcaacctaaggtatgagcctctcagtttttagtttagggagaaccacagtttctttctctgggctgctcttttgtcgtaaagtgaggggctgaactcttctagatcccttccagatctagtattctatgatgcctgatatattaatccagtttccctatgctggctcagcaaaccagtttataatttgcacagtgtagatcctcaacacattttgttaaataaataatagagttctacttcttaaaccttgagtgtatggtcattgtatacctcccaagttactgtctcaagggttttgatgttcatatcgtgttgaataagaagagttttctgtaggtataaactaataataatagtataatatattgttgagtgtttatatatcagacactgaatgtagcagttaatttacattattctaattaaccctcatgaaaggaaacattttttccaagtcagcatttttttttgtcagttcagtgcagtagcttcctaaatgatctccctgtttccacttttgcccacctgctgtgatccatttcctcacagaactgggagagtgaactttgaagacgaatcatagcatatactttctccacttaagatcctctaatgacttcctacttcacttaaaagtaaaattcagacacttttat

SEQ ID NO: 132959 - DNA, 1329 bp, Homo sapiens
tgccagaggcagattcccatcgctccaaggctcatttcctccactgagaactaaaatcaagtgggcccttaagggtactcacccgaagcagaaggaggtaggaggcggaccttggacggaaactgaagtacaccggccaatcagaagagcctggttacgcttgggcccatcaatagaattcggcagaaggatcttcgacccgcctcaaaggtgcgcgtctcacactgaaacgtcgcgagatcttccctcaagcggaacgattggctgaaggtcggaaattgagagttacgcccacggtttcttcagacctctgattggtcttccagaggagaagtcaacgaacgtcaaccgattccttggatgcccattggtgggcggtgcgggactggcgacgcgcgggccacagcgcgggcgttcgaactggcgcttggcggcgttgccatggagatgcggcctggccgccgccggtggctcccgggttgacgggactgttaggttgcgggctttggggctcactcccgacggcattgtcttctcctcttctcagacagggcagaccgaggagtttggaccgaggtgagaaagggcggggagaatagaggaggggtaggtctggtccggaaccgtggcgcctgcccgcggacacgggtgcgcgtgacgtcggctgagcgcgggaggaaactggcagttgtgagggaaccgagagttggcccctcttggctcttcctaaagttcacctactttcctatctttcatccccatatctctgccttttcttcagcaattatcttgaacgccacttctctcactttgggagactaaactcttgagtcccaaagccttcttgcttttgaaccgataagcctgaccggcacctcttttagggcatttctattcgcccttgggttgtttacttccgggaagcccgttcgcttcccttttcccataaaattttgaagcctttgaggtaaggcaagcatcgttcacaatgtcttgcacatagtagattttcaggaaatatttgttgagttgaatttaatttacaagaaatagattggattcctcttcatgccctgccttgttgtctctctgcttcagagacgattttttatttcgaggctagggggaggccaccctaatcttcaatgcaaaaggacctaaaagtccacacacagtccacagctggcctttctactctttgtgaaaggctaaacttttttggattggttgctgcaactcttcctgcatctgtggcttttagccttggtctcccaataattttattagactccttttagtctttgcttaaaataaaccattctgttgctg

SEQ ID NO: 132960 - DNA, 1041 bp, Homo sapiens
caaggaaatcttcgtgaaattcaatcatgtcatttagaaaaaaatcaaagctttggtgttcaaggcatctatgatgtggcttcttttcactcctctgtctctgcttctgtgagggagacacacacacacaaacacacacacacacacacaccccatcatattttgaaaggcatttgaagaaatactaccttctattctggaaacagctataccaccatcccttccaggaaaggtctgcacagactcagccttgaagaaaaatgcagtggcaactgcgtggtttcctttcctgccattgttcgactcagtggggcttctgctgataccctaccctctccagacacacccctgctcccaaggaagcagcctgctttttatcttaaggctagtcctgcccaaggatctttccagcagcttgaggagagggtagaatactcggccttatgcggcgagccctgggttgcatggctccagggttgcggggaggtatgggagaaaacagaagaggaggccccgttctggggagctctcagtctagagaacaggaaaaggttgtgcctcttgtgctctgtattcttgtgctgtttttccctctcaggccccttttccctccccagggagtctagttgagaacttcctattacataatcctgagcaggatggcggcgggaggggacggaaagtggatttggtagggattggggaaaggcagacaatcggtctcaccgagactgggcccccgtagcacagcttcaagagagcagcagcagggggaagggggaatggcacttctagaaaagaaagaacgagttgggccaaaggatggatggctagaggtcagagcctctactccccaaacataggggcctcacttggggtcacatatctgcacaggaatttcaattgaaatcctaccattataacttcattccttaaagtcttcaattcagcaaacaagcactttcagtagaggtgtaaggcattgttttttaaggtcaaaagggtattttggttttctactgcccctgtgaaatgccccta

SEQ ID NO: 132961 - DNA, 1047 bp, Homo sapiens
cctttccacccccacactcacaccaatctgcagaaacctcttccctggggtggaagccagagagcttagaggaaaaaggtcagctctcttcctgttatacatggttatacatggttggggtttaaaagcacaaagagaaacctccccctcctggctttcgtggccatctttgtccatcttaggtggggacttgatcttatttaaggtctccaaatagcccccaccacacttagaacgtgtgttttcttagtgttagaagccaggccctgagtccccagcactcacctgaactgtggctgatttggtcccagtccagctggggaggtgtttggctgacaaggaggcaagagatcccctcccagggaacaggaggactgggcttagcacagagccatcatcatgttcccaatttgtgaagagactcctaacactgcactaacccatttgtgtacatacatgggctcagccctgggccaaatgtgcctgatgggaacagacttgcagggccatgcaggccagacttcgtgccttaactgaagagtgtgcgtgtgtgtgtgtgagagagagagagagagagaaacacgcatcatgggtccctgatctatgaaatgaacacaacctctctgaggctggatgatctggaggaagggggcatggagcaaatttgaggctctgattgctgagccagcctcctcccaggcggtttccccaggactctcgtaggaaataaatagccctttcaagattcctcagctgcctcaccccctgcacatgtgcctggggtgtggcctagaagggagtgatgttcttactctggtggtctgtgcttctgaacacaggctacatgcacacactgacaactaccaataaacagacaggggaaggtctttcatctcagccattttctcttccccccgcccccccttagatggagtcttgctctgtcacccaggttggagtgcagtggcacaatcagctcactgcaacccctcctcctaggttcaagcgattgagtagctgagattacaggcatgcatcactatgcct

SEQ ID NO: 132962 - DNA, 1046 bp, Homo sapiens
ggggttgaagagaggtggcagagagaggaaaggggggcctgcgttgtctgctgtcatcctgggacaactgatccaatggttgtccctaattggcctgtgatgttgtctctggacagcagaatatgatgcttaatgccccatcccctcaggaaggagccctactccctggaaaacacctggctagacttggactttgggaatatcctacaagtcagggtgatttgagtctacaaaaaaaaaaaaaaagatgagaagggggtgaaaggagtaactgctatatttagaaggaggttaaggatagcaattgattttaagggtggggctagggaacttgtctttaaaatcctgcatttgcacagcaagcacagttcgtattgagattttgctatttggaactgtaagggaggtataggatgctgcctaatgggaggtgggattgcagagagttttctatgtaatttcttggtatcactttccctctctttcctccatggccagcgatgatgactttgacatgtctagatactcctcctccggctactcctctgctgaggtgagcccctaccccttctcaccctagacaccaccgggcaggatcactgccatcccgggggagggctggggccaatgcccaagtacaaggaaaaagagggctgggcaaggctgggtggtgccctgcacagggtgggcctgggataggatggaagagaagtggttactggcctcaagtgcatggagcccagggttaggagtggggctttagattgcagcaggccatttaaatagaatgggtgtaaaatacaggtgatatcctctagtagccggcctgagataggggcaaaacccgaataggagcaggaccagaggtgtgaagttgaccatagaatggggaggggtgactagaaagagaggccagaggcgaaggagggcgcctaggcaggagcggggcctgggggtacagacagacccgggacagggcggggctgatatccagggcactggctggactggggcgcagacggcctggagtggccgcagagctgtgg

SEQ ID NO: 132963 - DNA, 1580 bp, Homo sapiens
tacaaatagtcatttaaataaaatttgctaagtgcatgaaagaaatgtatgggggagcaggggctgtgagactacattatagaaggatctaactgagcctggcatttatgggaagcttcttttaagaggtgatgtgtcccagcctgggcaacgtagactccatgtcaacaaaaatatgtatgtatacaaaaattagccaggtgtggtggcgtgcacctgtagtcccagctacttgggaggctgaggtaggtggatcacttgagcccaggaggctgaggctgcagtgagccgagattgcgccactgcactccagcctgggcaactgagtaaggcactgtctcaaaaaaacaagaggtgatgtgtgtcagctgaggcctgaaggatgtagtaaaatttaaccagaaggggagcatgaggttaaaaaggatattgataccccatcaggagtaaagaagaccagtgtgcaaactagtaagcctggggaagagtggcacaagatgaggttggggagatagaagtaaaggcaagtgactactcctttgccatcattcttagcctggtctggagaaaaaaaaaaaaagtgctggttgagaccacccaaactgctgttccatcttcctagcagcaggggcctcacaggaatgctcagggagaggtgcttctagccccaacctggggatcacacaaatggaatggtcctcacctggcagcccagttcagaggagggaggaggaagaaagactaggcactcactttccctgcaatcctctctctatttttccattgctctgaactgtttattaatacatgacagaagccatttccctatttagatggttctgctgggaattccacaccaccaccatccctcctgaggcagattttaaagtcagctttcaagattttatacttggatttcagaaactaaattacattactacgtccagtgaaacggcgccattgcctgttcctatctgcatgctccaggcactgtgaggccgataacatcagcatgtcaaagcagctcgatccagacaatttgcagctagctagagctgggctattggtggggaaggggaggatgaaaaattatctcagaatccaaaacagcccagggtgtactatagactaggatctgggatttttgggttctttctatataccatcatttctcctatctataaagatacaactcatcttagccccacctggacataacaaggagctgaaaattcctctcctaaacataggaacaggacaaaatcactgatgtttcaacattcgggatgttttcattggagtgtaaaatagaagggagtggtggaaagagtgaaagtcattatataaaaaattcaggatcctactgcctgtgaaattaggtgtccatataaaagccaaaatactccttgaatggctattctgtgcttctgtgaagcccagatgtgaaggccttataactaaccctctgacagccacaaggttgcagagtaggtgaagacaaactattgctcccctgataggaacaaaggaattttggagtttctaattctaaccaaatttaattgtacagaacaagcatt

SEQ ID NO: 132964 - DNA, 1069 bp, Homo sapiens
agctctgttgcccaggctggagtgcagtggcgcgatcttggctcactgcaagctccgcctcccgggttcacgccattctcctgcctcagcctcccgagtagctgggactacagacgcccgccaccacacccagctaattttttgtatttttagtagagacggggtttcaccgtgttagccaggatggtcttgatctcctgaccttgtgatccgcccgcctcggcctcccaaagtgctgggattacaggcatgagccaccgcgcccggccgaggccacttcattcttaaaaccaacctgagcaacggggagggcagaggagagtcggaggcttatttcctacttgattcacttctgtattgtgttactttccccattgaatatgcattacctttataagttaaggaaaccaatacagattttttttaatggcttaaaatgatacagtcagtctggatatagaaattggaagtcatctgcatagagggctgacagttagggcaaagagatcaaaggatttagaaagatggcagttggaggagcagccagattggcaaactggggtcatgtttttaaaacttattggatgtcaggttgaggagtttttaagtggtaggagctatcagaaggtcttgagcaaaggagtactgcaataagagcagtgtttaattctcagaagagtcttttaacagtaatatacaagatgagttggaggaagaggagacaaggtggggagatgagtgggttactactgcagtgatcctggaatatgctgagaagggcctgaagcaggttgttggctgataattttttttaaagataaacattagatattctgcagaaccttctaggttcatgattagtttcccatagagataaaggaggaagaagtagatcaaaatgagcccacagggaggttaaaacaggagccaacctgaaagtgttctcaatggccaaagctggaaacatttgagcaacaaaacaaatatgataatattggattataacctcccaaaataagtatacattaatccatactgatataaatacatgattgaataaataagtaaa

SEQ ID NO: 132965 - DNA, 1049 bp, Homo sapiens
ataatagtgagaaaaaggtgagaaaagagcaatctaggctgggcacggcagctcatgcctgtaatcccagcacattgggaggccaaggcaggtagatcacctgaggtcaggagattgagaccagcctgatcaacatggtgaaaccctatctctactaaaaatacaaaatgagccaggtgtggtggtgggcacttgtaatcccagcaacttgggagtctgaggcaggagaatcgcttgaacccagaaggcaggggttgcagtgagccgagatcatgccattgcactccagcctgggtgatacagtgagactccatctcaaaaaaaaaagcaatctaaacctccatcagggaggactgatttaataaatcatggtacctccatcccatagcatacatatgggcagccttttaaaaggaggatgtaaatctaatatgaattgacataaaaagatattcatgatagatgcatttcattgtggtaaagcgcacataacacaaaagttactgagtaaaatacatatggaagatggatcatctgattccatgtatgtttaaattggtatatatgattacatatctttaaagtctggaagtataaaataaactggcaacagtaatgaattataggagaactttcatgttctgtattcacctttttgcatttgaatttgttatgacaaaacagcatcacctttttctttgaatttttttctatttggggaaacaaatggtcaaaaatcatgatctttgactctatcattttttcccaggtgatagagctcatgctttccatatttttaaattgggtatgcataccaaaagggggtaagatgaattgagtgtggaaatgctgccagagacctgtgtgtcacttgtctaaacaatcttgttcctgctatgcaccccagctttgacatgccacacttgactcacatcttcccaattccttctcaagttctacagagccctgtagcttctaggaggcagggcatttctttggaaacagaaaatcatcaacactggccaggcacagtggctcaggcctgtaat

SEQ ID NO: 132966 - DNA, 1092 bp, Homo sapiens
cagctgaccacccagtacaggattcctgataagagcctcacagccttggataccctgcccacactcctccttatgtctagttcttcctgaggctatgagaatccagagggcctcattctgttttgggaagggacctgttgctgattacttctttgctcccttctcctgggcggtcacagaagggactgtgtgaagccctatcccttttatccacatgaaagtaaacatcagaggaaagtgtcatcaagtagcaggagtgccccgtgtagccccttacacttcaacggcttccactcgttcttattataaagactcaaatccttagtataaccctaacatgtgatctggctcctgccttcctcttcagcttatctcatatcacattacccccagtcactacattcagcatcactggcttttcctccacttctctaatgtcccaggctcccttctgcttgagggcctttgcgcataatgttcttgctgcctggaatgcttttgctgcaccttctaccttttttttgttgttgactcctactcatctttcagttcttagttcagctatagtttcatcacagaggacaatccctagacttggtcagtagtcttccccttattgcacttttcacatttataattttacgtaagtatgtaaaattagtctattaacgtgggtccttttgaaggatgttgcatgaaaccagattcatttttacttaccatttgtctcctgtgccttcacataatggacattcactaaatagcttttggttgaatgaatgaatgactgaatgaattgtcttctagtctcatttacttggtaaccccatgtcgtatctgacattcaaccatataccctgcagacgtgtgtcctactgtttagaagtgtgtccggaattggtgggttcttggtctcactgacttcaagaataaagccgcggaccctcgcggtgagtgttacagttcttaaaggcggcgtgtccggagtgtgttccttctgacgttcagatgtgttcggagtttcttccttctggtgggttcgtggtctcgctggctcaggagtgaagctgcagaccttcgcggtgagtgtta

SEQ ID NO: 132967 - DNA, 1166 bp, Homo sapiens
ggaacccaattaagttcttctacatcaggcttgaacttctccactggcttttgaggcatctacactaggcttttacccctcaaagctggccatacttgctaccattcaagccaactttctttctagtaagtccagccatgtccttcaccttctttcacctattggcaccttgaggcctcctctcctcttaacaattctcttctgcccatttcactcatacacattcttcagagatcaatataaactcccattcttcagagagctttccctgaatattctagtgagctcttaaccaatccctaagcctctataacctctagcacataattttatacaaatgatattctggtttagggtgtccactttaatgtgctgtgagtcttgtcaccccaactcccctttgatctccttgacaagatagcttctacctctagaacttacagactggtgaagaagatacttgctcttatgaaacagaactacagaagaatacagctggctcctttaaagatgagtaagagtggaaaggagaggaggttgggaggttattctaaggaggggaacagcaaagacctagagggggatgagtaggtgagaattagtagagtggaagccacatgttggggaattaagggagattcaggggaatacagggatgggacattcattcattattcaaataacatcttttgagcatctgctatatgcaagacactgagccaaacataggaagtaaaatgatgaataaagcaaacatggtacctaccttcataagctggcaatccagtaggagagacagatactaaacaaagtgcacaaacacaattaccaactatgacaagtgatagaaaaggcaagaaatgcagtaggaaaagagagaataataaattattctcttgtggatgtcaggtaaggctgctatgagaaagtgatgtttgaactcagaccacaggatgagaaggattttgttcttacaaggagtgacgtgctcctggctccccagtgggcaggggtccctagctgagttagcaatctgagttccttacaaattggccttttcccatcttctccctttgcagcattaggtacattttcagaagtaagggacgtagaataatgtaagaaggccaatccagcccctctcccattggtagcagagctgataa

SEQ ID NO: 132968 - DNA, 1105 bp, Homo sapiens
tctgtctgctcagcttgttggtgcagccgcacagtctatgtcttctcttcggctgcaattggagaggaagagatttgttttaagaacaaatggagcttttaagcacttaattgtgtcaggcaacaccctgcctcctgtgctctcagggaccaaagagacttaaagaatggcaaatggcaccagatagggtctctgcacagctgaaagaaatgttactgtagcgtcactgaaaccaggttatcagttaactcatttgtttagttcacgagcatctactcagatcaggtactttaaggatacagggacaagtaagatctctccagtgggtggccaagagaaggatgggctcagatggctataggaaggtttttagatatatgtcaaaaagagtagagatcaatgaagtgtcatgagaaagagtgacaccctgctttgggagagggtgaggaatgctgagattctgactctgactacatgagcttgggaaggagtttcagactcctactgcttcctgacactcagggatggatggggatggtcaggacgggacattaattcagtgggtaggctacagcggctcctgaaagtggcggagagaacattataaagatagcaagtagccactgtggaaaactgacctatatatattctatgttctgggcaccttaagttgcctccttgtggtcagatgacttttcagtttaagggtggattctcctagtggatccatgtggctcatgacccagcagtatttctcaggctcctgggcagaggcacccttctttcctgccctatattacaaactgaggatcaggtttgttcaagcctgcagctccttactactcatctcctcatcaaacaaacaccaagtaagaacctattctctgctagatgttgttctgggctcaatagcacagaattttgctccagggagatgcacagtctagaactcagattgaggcactatagaatagtgagcactgcaagagaagaaccaggcccaggagcaccaaatgaaagcaggaagggctctcatcgagtggtcagggaaggcttcatagaggccctaggaactggccataggaagagtactagaagcttggca

SEQ ID NO: 132969 - DNA, 1071 bp, Homo sapiens
aactgaaactatgggagatgcttacctccctggatcagagtgggcagggcaggctcccacccatgtctaccaccctcatggtgtcatggctgtactcctcccccaaagaatgaccatcatccctcctggagggttgtccaactctgccagcttcaacctgggtctctctcctcagaaaattaagaacacattttatctattccacaaattatgcttcctccttcctcctccttgaggccaactagctgggctcagcaaagagattcagaccacgcccgactccctccctcccctcaagcccaccacagcctctgggccacagctgcaggcgcttagcagccttttgagtatttatagccaagtccaccctctcccccagctggctacaattacagggccagccacactcccagcccttgcctccctggccatggtggggaacaggccaagccagcaccagagggatggtgccgcagtcccttccttggtaggagcacagtgcagggaagacagtagtcgaaagacacaggcccctgccactgcctcaaactgcagtaaatgcctcaaattgccaggagggatggtcattagggcaagctggcccagtcctgatcctggcccagaacctggcagaaagcaaagagccatctctactcttagcacacaaatgggcaggactgggctctgggttcttgggctcaggattccaaggcccgggctgcaaagcctgggttcataagtctggatctggactcagatctagactttaaggtcatcgctctgggctccagacctgtatttggggcccttggcctctgggcagggtctcctgatcattggagaccctagaaacaggaaccagagctcagaaggagggctgcatagctgctgacctagttactctccttgcggctcatttccttcctctctgtgtagacccacagctcccagctcagggaccactggggctgaagccctgtgaaagcccagtcaatgaggcagtggctcagccccaggccccctgcctgggtgacctgtcctacccacagcatttccactgggaagaaatca

SEQ ID NO: 132970 - DNA, 1056 bp, Homo sapiens
atgcctgccagggcctccacaaagttccctctgtgcaagctggcgcctctggaggtctcctggtcgggctggctggagtcctgggagagaggaggcgcccaggccacaccagagctgcttacaacccccatccttttgggctgggggcttcctggatcccacccaccaacagagggcttttgagggctgcaagcttggtgggcaggaccagggcatgcccaccaggtctaaggagaatgagatgacggctgcctactgcagcttccccacggtggctacacactcattcaggtggccagaaccaagcctgtggatgggggtgatggctctgtggggtattcgagcctgttgggacccaaggtctttcaccagggaggccagaaatgtgggagggaggctctcttccctacctctctcctcctaggcctcaccccacccttcctcctcaccaccctctcctttactgtatacccccaacaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagat

SEQ ID NO: 132971 - DNA, 1071 bp, Homo sapiens
gaggactggggcctctatctctctgcccccagccctaagagagaacctgctctgcctcaagcccagggtggctggaggggcagcatcattgcctctgactagacaactggcctgggcctgcgggtggtcaccttccttgtgggtcttgggcccttggcctcacagaggctgtttgccttggagggtctcagttgctgactgttgcctctctatagtactgtcccttcacatccagttcccatggtggttctggggagccaggcataagtgcagacatcggtcattggagttaaaacagaatctggagaattaaaacaaccctgaggcgtggggggaaggggaggctgggatcccagaccccaggtgcattgcacaggggcccagccttccagccccctacttctctttgctccccgacaatacactgtggctgggccccgctctgtgtcctggcctatcagccccctgcccacttgatctcttccagtgtggctctgctccattcttacaactctagacctgtctctgtgcaccctgcccctctcttcttgctgaacccattctcatttctatgttgtttgtctcttctttatttatttattttttttttttttgagacggagtctcactctgtctcccaggctggagtgcaatggtgagatctaggctcactgcaaccgctgcctgccaggttcaagcgattctcctgcctcagcctcccgggtagctgggttacaggcgcccgccaccatgcccggctaatttttgtatttttagtagagacggggttttgccatgttggccagactggtccaaactcctgacctcaggtgatccgcccaccttggcctcccaaagtgctgagattacaggcgtgagccactgtgcccagcctatatttatctctttctgtcccattcctatctctgaatctgtctttgtcctggttcctatctgcatttctttctgtatgtctctgttccatccctgtctctctgtatgtctccatcttgtgtctcttctcctgtctcttcttccctcgtttctatattcatccctctccatgcttgt

SEQ ID NO: 132972 - DNA, 1045 bp, Homo sapiens
gtggactgtcttttacccttgacccaggtcttagtttggaactggaaaagttgaagtgaaaaaccaggcttgggggaatgtgtgatgctggtgtaggagggggtagtccaggtgacagtgggggtgacagtggtaactatggaggcatcatattgtcttagttactgggatgcaggtcagtatgaggatagggttgggatgatgggatgatgagatgaaatttggaatgttgatattaagagttggtgacagtgactgtagtgacagtcattagtgatgatggggatatcagacttggaactaatgagatagttgtctatggtagttatcagaattgacaacagagaagaggcacgctgactatgatgttgatgacaatggttggcaatatgagagggtcaacatggtggctggagttgacaaagtgggttgttgccagtgattagtgtagtaatgaagctatgtctcctgaacagtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtgagtgccctgcccggccaagatcctgggtgcctgagttagaatcatgtgcagtgagtggcacccatatcccacgtggcagcagctccagtgtgagacctgatgcatcaggctctctgcggggaaaagggacaggtgggcctgggagaatggatggagctgaggcaggtgtccttaggggttcccagtgacccctgttagtgcagcgggaacacatatgtctttctgtggctccctggggtcgtggagagaaatgcagggagggagatggtgagggagggagatggcgggggagggagatggtgggggagggagatggcgggggagggagatggcaggggagggagatggcgggggagggagatggcgggcaggacaggcaaggctccctttccttacctcgct

SEQ ID NO: 132973 - DNA, 1077 bp, Homo sapiens
tcctcgtgtctctgtctctactgagggaagtctggggtgtctcttctctaggaagtgcacccgatactccagcagtcggaggacccattcaagactcccctcgtctctgcagcacagtcttcctctgggagtggacacaaagtggcaggagatgtggggctggggccgattcccccagacatcacctccatcctgtgattgatgagttgaggcccgcagccccctgctccccacggttcctgcctccattgagcaggtggagggggggttccgtgtccgcacagcccttgtttttctttaattaaacatctggctcttgtggcctgggaagcctcagaccctcgctgacagcctccccgccacaactttggcatcaatgatgggttgaggggggagagctggggctctggggcccacctgtccccatacagtgcaggggactgggagctccaagaatgccctgaccatactgtcctcacccccagtgccgccgcgggagcctgtgctcagctgccgctccaacacttaccccaagggcttctactgcagctggcatctgcccacccccacctacattcccaacaccttcaatgtgactgtgctgtgagtagctgcgcctgtgacccgggtccagccctgacctctgacctctcccccatcccaccaccatgccctctgtccataccccagccctgccttgggcttgacctttcctcaacctctgccccacctgacccttgatgttcgtaacagtgcctgggtctcacctctccccaggcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattggtacgtgtggcggttggggggacctgctgcctactccagtgggaatgtaagtggatgtgtgccattggtggggatgtccacatgcatgcacatgtatacatggcatgtacatgcctctgcacaggtatgtaca

SEQ ID NO: 132974 - DNA, 1012 bp, Homo sapiens
atcttaagctaaaacaaaccagagattaaaatgatttttaaatggacagttccttctccagttttttaaaacttttatttgattggttaggatggaagctctgggtcccctggttcagcactgctttccctgcagccctgtttggctggaaaggaaagagtgaggagagggctatggtcaaagaagacgtctggggagaaatcacaagtgggaggtcgccggggcatttgggagtccagaagttggaatgcctcaagggatgccacgagataaggctgagccaggcctgagccttgagtgccaggcaggaggcggcgtgtgggtggggcgtgggtagggctggagtggaagggtcaccctgccccaccctgcctgatctggcctggcctagggtgtgggcagcttgcccctcctcctgtctgggccggcgggcaggcctcatgcgtgccgggggctccagcccaggcaggctggcgagatgagaggaaaaacatgcggtttggtgggctggacatggaaaaacaagccaattaggaggaaaacaaacaaaccctgggccagtgggggcacacgcacacatacacacgcgcacacagccccgcgtgggacccagggacaccctgccacaggctgacagtcacttgggtgtctcaagagcccccacaaggggcaacccagatgccgtgtatgcccagagcctgatactgtgacctgtgtgcataagagcatttgctcacacactctctttaacatgcactcacacggtgttcagttcatacgtgtgaacatgctgtgaattctgggcaccctcccacatgcacagtttgcaaaatacattcagcctcactatgctccatcacatatgcactgcctcatgtatgagctctagctgtcactgtgttcagacacaatggcacacttacaggcactctaacagagtaccttggccacacagcctagcacatagagacagtctcgagattgaacagcctcaccctgagtcacgtgcaaa

SEQ ID NO: 132975 - DNA, 1040 bp, Homo sapiens
gtctcctgggctctgtccatcacgcctgggttgctgaaggcagggctggggtttgcttttggctctgacaggccgctcctgggggtaggagaggaatggtcagagtgctcactccatcccagcagcaccgcaccccccaagcccccaacctgccctaagtagttcctgccttgtgaacttgacagctgccaggagttccctagggttccctgctgcccattctcccttctcctgctgctgcctgagccctggatggctgaggggcgggttgttgtggggtggcaggctgggaaggcagaggaaagggagagagacaggaagagagatgggggaggtggggggtagagacaggacagaaagagacaaggatggggtggggaagagaaagagataaggagaccgaaaaaggagtccaggagtggggcccctcaatgccagcttgcctgggtaataatggacgtcagtaactgggctgggcctgtgggtggcaagagatccgggtcatgggggtcaggaaactttaaaaaacccagggactggagaggaactgggttttctctgagaactgacccctctcagcactatgcaaactctctgtcacatgcaaacacacacacacagaagatcgcccattcacatacctagcccctgtacatgctcactcacattcacatttggagacattcatatacccacacacttgcacaggcatagaggagctttgaacactcttcatctccccaaacactcacacagacaccgagcctctcgtcctcactcatccatcctcacaggctcttgtctgagcacgctcgcctgcgggtgctgggccgggctgtgacctgtgacttttgccctgtgcccccaccccccacagaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggcca

SEQ ID NO: 132976 - DNA, 1062 bp, Homo sapiens
tctctgttatgctatgtctgcactgtctggagctgagtctctggcactttctcggggtatatctggcactgcgtctctgtcagtttttctggctgtgtgtctggctgtttctctggcagtctttataacggtgtctctggcagtgtgtctgactgtgtgtctgacagtgtctctggcagtgtttggagtggtgtggatacttcctgactgagcatctggctgtggctctggctcttctctcaagctgtttttctgggtgtacgcctgtttgcgtctatcagtttctctggtatttctctgcttgtgtgtcagacggtttctctggcactgtttctgacagtgtcttagctctctggctttgtcgccgacggcttcactgcctgtgctccttgctcgtccttcggcagtgtatctgcctgggtctagctgagtcctttacagtgtttctggtgggtcctttgattgtgtcgctgttctctgaccacctctctggctggttatctggtttcatctacctgtctctttggctttgtctgatggtccttctaacagtctctggtgtatcttccactgtgtgtggagctgtttctttggggttctgtctggtggtttggggcagtgtccccggccagcatctttgctgtgtggctggctggaatctcggagagtggccctggttgagtgtctggtagcatccctcagtatttctctggatctttgcttctgtgtggttgatagttctctctcttcagactgaaggtcagggggtttgttacatttgcagcccattctgcaggaaataattatttccctgccatcaagtgtaggtgtgtgctgggggagggggagagaatagttggactcatctcaggaagcaggacaccaggttggggggcactggatccatcctggcttctggggccatgtcctgagtgcatcctgtgtacttgcatgggtgcatgtggacactgatgcacgcctactgggctgggggtcccaggctcctaggggcacatggctggggtcaagggtgggccggggttcctgacaaggacttacata

SEQ ID NO: 132977 - DNA, 1066 bp, Homo sapiens
agtaaccttgcttcgaggtcacttgccttgaggcccccctgatccttcattgtccaggccagactgagcctacctgagcctcggcgtgcccacagcaacccaaaccctgaagtgcgcaacacactattacagatcaacccgcacacacaattacagctgagacgcagttagtggtgctcattatcccccaccctgacctgatggcggcagggcttccccagggttggccttctacaatctaaactgctgtaattctgcagggataaatagaggctttccaaaactcacacctccttcccccaggttctgccctcagctgggcatggggtgaggggaggggtacagggcaacccggaacattgctgggactggcaagacggttcttgggtcttgggtcctaagccagattcttaaactgggtaacaggggttcctgacctggagcctgtcgctgtgtctgtttgttaccgacggcggctgtcagacttcagggctgccagtattgctgtggactagtatcattctgtgagactgttactgagtctatcaacattgctgtgtcactgtgttgatgtcaccgtcagtgtgactcgatgtgactgagtctcattgcatctttgattctgaggttaccatcactgtgactgtgtcagtgtcaactggtatcattgccccgtttgttggtgtcaatgtatgtgactgtcactcactgcattattgtcatcgtggtgactgtcaacatccctgtgtgtcattgtcaacggtacaactgtgtcattttcaatgggtgttgttatcattgtgtaatggtatctttatgccacagtgggacaatggcagtaagttggggccccagaatttgactcttaatgtgttacctgtgtgggagtaatgatgacactagggttctgtgctgggagaggtgcagggacccttgtgctgacaaggggctcaggggcttttgggcgctaggctccttccttgcttatggggtaccccctctgttccctcctcattctggggctgacctctttgaggggctgagaggaatcctgggctaatttgca

SEQ ID NO: 132978 - DNA, 1083 bp, Homo sapiens
ggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacctatttgatgagcctctactcagcctgctatgtggagtgggattaaagaaatgggagtccccgcccttaccccggggggctgatcgggtgaagacagaggaagagtagtaggctcaggccggtgctgggagaatatagtgtctacaagaagcctcagtcagtactgaatatatctaattccctggatagttatttgcccctgctttggcctggtttaggaacactgccaggtcagacatttctctccatctgcagcatacagtatagtatagtggttgtgagcatgg

SEQ ID NO: 132979 - DNA, 1048 bp, Homo sapiens
tattcagatgtggactagcactgctttataccagtgacagaattttgacaactacgaagctcaggtgccctctcctcccctttctactatgggaagatcttttattgaagaacttctgatggcgtgtcaggcatgtcctggagctaagtgcgtccaaggtaatgatgtctgtttgtacactaaatgaggaattagttgtcactagcagactgtgctcccatttcagaactaacttctcaaacattctcttcctttgggatctatgacgctgaccctcctggttttccttctacctcttacggctgcttctcagtgttatttgcctcccccctggcattcctcatcctctaccctaaaaactgggtgagtgcagtcacttccttagtctcctcctctatttgaccctttaatattgggattctttacattctacccctaaactttaggtaggctcactcgcttccatggtgtcaattactatttacatgtcaatatgtctcaaatgtatatctctggtccagatttctgttctgagaaccagacttttatgtctagttgtctactggacttttccacttggatatccaatagtcatttcaaactcaatctgtatgcccttaactgtactctttctctcccctaacctgattctcttctgtattccctaattcagtgattgcaccatcattgggatcccagttgtttggactcttccatctcccacaccaaatttgatgtggaggggatagggctagaggtaggccagccaatctagaggtcatgaaggcttgaatgaggatgcttgtgtttctcatgcccaaacccaggacttaggaaccagaaaatatattgtgtatactctatattccatagactctaaaatagttcgttatcttccccatcagacttgaaactccccaaggagtacatgattctctctctccactttaaggattcctggaaggtggggctgcatctcctttaatattagagaagggaggccaacctagattactgggattcaggtttgagagtctgggagaatgag

SEQ ID NO: 132980 - DNA, 2100 bp, Homo sapiens
tttttttttttttttttttaatagtgaaacaatttacttaagaaatagagcactggacttcccagtatatttgaggttgggtgtatgcatcgcaggcatggtggttgaacagctacacttttcagataaagcctcacaagtcctggaactacccctttcctagctacaagcccagcccaggtttagctaaatttctgcttgattcgagtgaggcttgggagtgcagacttccatacagtgggtccatggccaagcgaggtagccgtccatggcttctccaaagagaggacgtgggtcagatgatgccacagaacatttaggagtggccatctgggccagcccagtgaggtagggctttttgtttttctgaagctccctctccattccccacccctagttagtccatgggccagggaagcagcagccatggaagggcagggcagagctggcttttcacttgggtgctccctgtcccccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccatctttttgtgtgtctgagcagccggaaaaagcctctgacccctggggacctcaggaagatctctctcttgctgtgtgattcatggtagattttttttttttttttttaagagatggggtctcctctgttgcccaggctggagtgcagtggcacagtgacatgatcatagctccctgcagccttgaactcatggtcccaaacaattttcctgccttagccttatgagtagctgggaccttatgagtagcaaatgccaccatgcctggttagctttttaaattttttttagaaatggggtcttgctatgttgccccggctgatctccagctcctggcctcaagtgatccttcctcagtctccagagtagctgagataacagaaacaagccaccatgcctgacaagacagtggcttttgactagtagggactatatacttgagtgtgccttagaatcacctaagacactctttgagtcagtaactca

SEQ ID NO: 132981 - DNA, 1709 bp, Homo sapiens
ttgctctaggggctggtccctgtgggctggcatgccccttctgcgagctcttaaagacactgctcaggtgtcaccgcctctggaatgcccaccctggggctcccagcttgaactgcctcctctccgcttcagtcctggtaaaggcgggccttaacaatcgttgagtcccagaaggcttcacttccgggctcgtctgcttcaccagccagtgagctcgggcgagcccgtccattctgggtctcactatccccacacctatccgtatgtagagtggcgctagctaggtcagacctcgcctgaagaccctgacatctgccgctgggcgacttggccccgcccccttgcctcccttgcgcggcaccgccccactcctccgtgctccccccgaggaaatggttcaaccgaagggcggtgccaaggtgcccgggccgctccgattggtcagggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggtcagtgctagcggcgggccagactgggaggctggggttgtaaaggggcccatgccctcctttctgatgtttggctgggccatgcaatggcgcgaataccctgatagtgtcatgtgcgattgtcactcagggcgctactgggctgagatctcggataccatcatctctggcaccttccaccagtggagagagggcaccaccaaaagtgaggtcttctacccaggtgggtaagaaggctctgtcagagaagtgggtcccttcacgcggggggtgcccacaattgcggggagcatggcatggaaaaggagtgtgttgggggggccctcctcatggttcccttcctccaccctcccataagccacaggtgattggttggggcagagctgagggactcttgctttcctctgtcaaggggaaacaaaacataacaacttcctattaaacatgtctgatttttatctgcccaggcacaattttgcccagacagtattccaacaactgttggggagacaatgggtaatcagaaatgctctcaataccccaaaagacaagacagacagttatctttttatttgtttgttttttgagatggagtcttgctcagtcgcccaggctggcgtgcagtggcgcgatctcggctcactgcaagctccgcttcc

SEQ ID NO: 132982 - DNA, 1054 bp, Homo sapiens
gcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggtcaggactcagaacagtctggcgtctccagactctcacatgcagtatgtgcaggcacctgatacttctgttgcccttgtgctccagtcattgcacaaggcagaaaacagctctggcaggaagggactgccaaagttaggagccctagggcctggaaggagagtatggtcctcagatcccccttctctcctgcttcctccagggaacccaacagtcatgaccctgatagtttcccataacaacctgggcattccttgggactcaggagctgctaaactctttcatcccctggtggcttcagcagtccttatcaccagcctcacaatcccacaggcccacccccagtgggcctgtggcattcatatttcatattcatatttcaaaccacaatatccagcaaaatgtctcctgagcacccagaactccataccatcggccgggtgtggtggctcatgccttaatcccagcactttgggaggtcaagatgggaggattgcttgagcccagaagttcgagactagcctgggaaacataggaagccctcgtctctacaaaaaaaatttaaaaagttagccaggtatggtggcatatacttgtggtcccagatacttgggaggctgagataggatcacttgggcccaggagtttgaggctgcagtgagccatcatcatggcatcattgcattccagcctgggcaacagagcaagacctcgtctcaaaaaaaaaaaaaaaatgaagtccatgccaccattcttggcagcccagcccttatcctccttaat

SEQ ID NO: 132983 - DNA, 1398 bp, Homo sapiens
gtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctgggcggagccacccccgctgcgggggcccagggcgggagggagtagaggccggggcagagggcgagggcgagggcagagggcgctggcggcagcggccgcggaaggtgaggcctggtgtagacgccaaagtcttgtcaggagtgggcggggcagggtgatgtatgatctgaaaggccgggagtgactaacgactgtcagtgtgtatgtgcctgtgaggctgtgtctgtgtgacagtatcattgtgtgcgattctgagtgtcacttggtgcagctgtcagctaatgtgactgcgtgtgtcagtgtgcatggagctggaggtgcatgtggctgtgcaagtgtgggattatgtgtgtatctgtcaatgcacatttttggtgggactgggttgtgtgtttgtgtgagagggactgtgaccacatgagggaatgtgttttgggaaggtctctgtggggtttgagaccatgtctgccagcgtgagagtgggtggctggctttgtgtgtgccaatgtgtgacttcagcagtagcagagcaaaagtgaggtttgtgactatgtgtgtgtcctgggtcctaacttaaaccgtgtgggagtacagctgtattcatgtattgggggacctacctcaagagcccatgggactgacctttctcttaagtgtccagcattgacagacacacccacaacacacgtggcttcccctccttcctctgctcaagaatccccagcatcaggtctactgctccttattttctgtttccctgcttggctcagtttcccttacgtgccgttttctgtccctattgctgtcttactagagatacctctgtgtgtttcttcacagctttgttcccctggtctctctgtgtgggtgcatttccagttttgcctttcctttctctctgtctctctctgtgcccctatgcctgccttccctgctgatcttgatctctggctagttgggggcctgtaacagtgatgagatgcgggtctgccccggctaagagctccctgagagagggggcttagaccatgatgaagagttgcttttaggcggtgc

SEQ ID NO: 132984 - DNA, 1054 bp, Homo sapiens
ggtggacttcccttcagggtattagtattagtactaatactcttccagggtattagactcagagctggatattcatccttttttttcaaggtgtcttggatcagtgctaggtcccctccttcattcttaatgtgcctgggcccagagctaggtccactcccgtatcttcagtgtgttgaagaggctccctcagagctgggctcctctactcatcttcagagtgttaagcttagaactgagtcacctccctcattctcagggtgtctgggccaagatccggtcttactgtctctcctgatttgcctcctgcttcttctaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaattattatccaatgctgctttattatttggctattgggggcttcagcccattttccttagcatcccaaaattcagcttgggcagagtcccatggagctttctctcttggtgctcaaaccactgtgacaggctggggttctgggggtggatgcagatgctgcgttgagccaggtgaagcctgggtagagaaaggtccaaagctatgaccatagcttggggatgagattagggtcatccccaatgaccctaattaggggttaggagcaaggaccagatgaaaacctgagttggcaacagaattagcagttagggctg

SEQ ID NO: 132985 - DNA, 1067 bp, Homo sapiens
agtaaaaaacttagaaactcttgaatactagaatattcaaaagtgtgaacacaaatcatgagggagagtcaagagtgggtgaagagcggagcgtgtgagcagcacagaggcctcctctcctctcctctcctcacctcgctctcgcggcctacctttaccggcccgtctgctcggcacccagaacaccttccaccatgaccacctcagcatgttcccacttaaataaaggcatcaagcaggtgtacatatccctgcctcagggtgagaaagtccgggtcatgtatatctggatcgatggtactggaaaaggactgcactgcaagacctggaccctggacagtgagcccaagtgtgtggaagagttgcctgaggggaattttgatggctctatagtactttacagtctgaaggctccaacagtgacatgtatctcgttcctgctgctatgtttaaggaccctttccgtaaggatcctaacaagctggtattgtgtgaagttttcaagtacaatcgaaagcctgcagagaccaatttgaggcacacctgtaaacggataatcgacgtgatgagcaaccagcacccctggtttggcatggagcaggaatataccctcatggggacaaatggccacccctttggttggccttccagtggcttcccggggcctcagactccatattactgcagtgtgggagcagacagaacctatggcagggacatcgtggaggctcattacagcgcctgcttgtatgctggagtcaggattgtggggactaatgccaatcatgcctccccagtgagaatttcaaattggaccctgtgaaggaatcagcatgggagatcatctctgggtggctcgtttcatcttgcatcgtgtgtgtgaagactttggagtgatagcaacctttgatcctaagcccattcctgggaactggaatggtgcaggctgccataccaactttagcaccaaggccatgtgggaggagaatggtctgaaatacactggggaggccatcaagaaattaagcaagcgacaccagtaccacatctgtgcctgtgatcccaaa

SEQ ID NO: 132986 - DNA, 1055 bp, Homo sapiens
ccgttccactggccctctgcctggaagctgctctcgttctctaggggcaccctcttggtgtgctagggttctttcccagtcccaggggaaagaaggtgtgggttgaggcagaaatggcagaccacccccccccgctccctctcagacggcttttgctgccatttccgaaaacggttgcccccccccccaacgaggtgctctttcttctctgcctctcccaaccccaccccccaccccatctcccccacagacgtgacatgctggtggggggcaatgggggagtacccgcctttgtggagccttttcttcgtcagagaaaggtgactcccagaaccatgagtcaacccagccacctgcagcagggcctgtgggggcagcagtgagggccattgtccctgcccacctagggccttgggcgcctcccccttacccggttacaggcctcactcctggaaggacaccctgtacacctccctgctgtgaagcagtcagaggcagaaaggcaggtctcagctgtggctgccagcctaggacattgctagaaagactctggttctcctggctttggcaggggttggccaagtctcagaagggctgagaatggcttctggccatcccccagagagctctagctacaggaaagtcccccttcccctgatatccaccacagacacaccgatagagggagactggaatggaagaattcgggttgtacgtttctcttataacaaatgctcctgcacccaccttaaaagggactcagaggaatatgggtctgatgatgggccggatcctaaaccacagggtggactgggggcgtagggtgaggctaggagaggtattaaggaaatggtggttggttagtgcccaattgtctcctaacagctggggttgaaaaagtcctgtccccaggatgcttttgttcactcacactggtgcttaggcggcacagccctcacagttttgtgtgtagacgctggcaaatgagtaaagggaactgttgccctggttgggggaaggatagtgtcgccccccctgctaatgagggagttgga

SEQ ID NO: 132987 - DNA, 1059 bp, Homo sapiens
cgcaggcccacagaacaggcatgacctgctgaaggttacccagggagtcatttagggattgcaagatcatcaggaacagggctggggcagaagagaaggcatcaagtcttggccctgggtttctttcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggtaagagggcagcactccagcccaatcccggacccctccgcttggtaggggtcccaggtgcaccagtttgtgtagcggggaactggaggctgtggagggggtgagggcagcaagggtttccagcactgtcacccagagaagagagaagcccacccactacccagctcagctcaccctagttctccccgcctctctctgccccctccctcctcgggttcaggccttagagaggtctgaagcaagagccagaggccttccccgcccttctttccttcccagccttattagtcctgcctgaagtctccgctgcttcattggctgatgaggaaggttggggagagggagtgtgtggctctctgaggacagagcatttacattcatcagcataaaagtctggcccttaagcagcctgggaattaactaccagagctctgagcagaaatggttttccccttctctcccccggccctgcctgcttctggccagcagaacagaggtggagctttgcctcccagaggaagtggcagggatccaagggtggacggggaactgctgctggcatcttcccccttccctggggtagctggtggccatggggtgggaggcaggaaaggcccaaataaagcctctgagagggaggcccctcccagcacatcccacggccatgatgtagctgctaattctg

SEQ ID NO: 132988 - DNA, 1032 bp, Homo sapiens
ttcctcccgggttggatccctagcctatttgcgactgttcacttaccagccccctctgtggtcacatcctgtctgatggccccttgtcctatatgtctttggagataagcaaagatttgggaaccaagtatcacttgtaatgtgacaccaggctagtcattcaaggctttttgagacatctttggaccatgagtatgtggaaaagattacaggactggaagtcacatcctctaagtcctctagtcctggcttttccacctattgggtaagcaagcctctttgaatctcaagttgtgcatcgttattaaatatataattaggaatggaagataatcttgccagaagcctttcttactctattagcctggccctctctgtgggatttaaaggttgcttctttctttaagcctgtgaactgggagctagagggcagggggaagacactgggattggggccagaataagccacactgcccctaacttctcctcccctctaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaa

SEQ ID NO: 132989 - DNA, 1053 bp, Homo sapiens
ggctctggtagaggagtagagagtgagctgggggctgggagctcagtggcccagtggttctttctttgctccactgcctccccgtcaggcttatagttgctttggtctgcgataggctcacttacgtgggactttgaaacagagtttgaggatgggctggagcccctacctgggaacacaggaacacagttttctttttgctccatttcccctacaatagactgagaatcagacaagactcccagagggctggctccatgcaggtcttggggtaagttacaagctgggtgcttagaggcccaggagttttttgtcttttgtatgtccccacatctagcttcagaatcagacaggacccccatggatctaactctgagcagctccggtgcaagagctgggggtgggctgagggccagagatggagacctagaagccgaggaattcctggaatgctcagtatccttccatgtagcttctgatgtagcgaggcattccccaggattgattctgtgtggttccataagggtggttggaggtgtgctatgaacagggtctggggaatcagatgcccagaggttctctttctgccccatggtctcccacaaagctttggattcagacaggactccctgggggcccattactagagactccaggagagggactgagggaaggctgggaggtgaaactgggtctgcagggacccaaatattttctctactttgcatgcccttccatggtgtctcagatgctggtgggacacattcagggctggttccagagagctctgggttgaggtccaagactggagactcaaaagcccagaggtttcctgagttttctctgcattcccactggggcttatatctggatggatcttccagggaactctctctctggagttctggcagggagtctaggggagggcaagggactggcattgaagactcagaggcctgaggtttctctctgtatcccacggttccccagaagtccttagatatagcaagtcctccttcagggctaacttttctgggttctgacagagaagct

SEQ ID NO: 132990 - DNA, 1041 bp, Homo sapiens
accttttgcaaacccctggtaagggaagccttgagggtagggaaggagagatacttctccatgtgggcccaaggacagtgcttacagtggcgaggggtcaggatgtcacttgctcttcgccctgcctctggctgatcctggggacccgaagctttggggagaagcagctggggaagagcagtgtgttgagagctctggcccctgtgttgagacctttggggaaatgtgcttacaggggcctctactaggcttctggcctgggcagggtggttcttccctgtgactgtggataaccccaaccttgcagtccctcttctatggtctcctgctttgggtttcctagggtgctctctctttttggctgaggatgaggctgaagccttgtcctttctcttgcctgagaccagaaccttagagtttgagggttctcctgggcctggagatagatagtccacaccagcctccatgtgtacacatggcccttgggatgggacctggctcaccatcttccccttcattttctcccctctctgagacccttgttccgccctgccagactcctgtggctgaagctgggaagaggattggaagtgatgacagtgggaggactggacaggctgaggtactgtgcgctgaacttcttgaggatgacaacttgaagagtgggggcatggattggggggataaatctgctgtggtgggcaggaagggagtccccagaagtctggaattgtggagctcagaataggggagctgcaaaatgattgacttgggccaggggctctggaggcagggctctgccgcagtttcttcagcctgagtttcagctctctactccactgccaggcatggatcccaggatgggtgagcaactctgggacagtccatctctgggagagtggggcctctgccttaacccctgggcacgttactcccttgggtagaccaggatgagtgcgttcaatcttcacagcttcagctagggtgggaggctggggtactgggtgtaggggatccactgccagagggctggggccttgg

SEQ ID NO: 132991 - DNA, 1067 bp, Homo sapiens
cccaagcgacccaaatatcattcacagctatttggaccaaaccaatatctaacctaggtccacaagttggcatctgttagattcctttattcaaactttgaaaaataagagacagggtttcgttctgttgctcaggctaagagtgtagtggctatttacgggtgctatatcgctactgatctgtgcaggaattttatctgctgtgtttcccacctgggccagttcaccccttcttaggcactggtggtcccccacttctggaaggtcaccattattgatgccaaacttagcatcattcggttcccaatcgtcatggcacactacatcctgggctcaagggattctcctgcctcagcctcccaagtagctgggcttataagtatgtaccaccacccctagccttttactcaaacttttatgacacttgttgaagagatcggggcagttgatctccagagaattgtagccatgtgcaggatggattagaaggaatagagcaaccaatttagtgagaaataatgactaagacaatagtgatggtggaaatggagaggggaagatggatttgaaatacatttcataggtataattgacaagttttgttttgttttgttttgtttttttgagatggagtcttgctctattgcccaggctggagtgcagtggcatgatctcagctcactgcaacctccgcctcctggttcaaacaattcttctgcctcagcctcccaagtagctgggattacaggtgcacaccaccacacccggctaatttttgtgtttttagtagagatggggtaccacccaggctggtatcgatctcctgacctcaaatgatcctcctacctcggcctgccaaagtgctgggattacacgcatgagccactgagcctggctgacaagatttggtgatggcttagatcagggaggaaggaagagtcaaagcttaagtatttaggtggatgtcatgcattttgataggaatgggcgtgttggaggaaaaagttaaagggaaaatacgtttttggacaagtcaaatatgagataatgtctggtatgctgttgaa

SEQ ID NO: 132992 - DNA, 2637 bp, Homo sapiens
cctgccatcctcagacctggccgtcttgatcagctcatctacatcccacttcctgatgagaagtcccgtgttgccatcctcaaggctaacctgcgcaagtccccagttgccaaggcaggtgcaagatcatgggctgtgggagacttgcatgagtcctcaggctggtacggagtgctctttagtttctggacaagattccactggggttagggttggtctaaagggaaggtagaatttttgaggatatcaagataatctagaatcaggaataaaatggggtggccaaagaaggggcaaactgtagttgggagtgctcgggtagcccaaagatctgcgtatctcgagaggagaggctaaatgctaaggtacctctgctgctgcttttaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggtgagtctgcatcctttccccagatgtgccaatcatggagagccaggcagcagccaccaccatgccctggagttgagagtagaagctgttggaaagatcatctaactgagaagaattttaatagggcatcaaagataaagaatgctgaggtgaatccattcaatttggaataaggccgagaagagatggtcaggctccattctcagtctgaaccaagctccatgagggaaatcaaagtatgagagtgcagcaaacacagcaaggttttttttgttttttgttttttgttttttttttgagacgaagtctcactctgttgcccagactggagtgcagtggcacgatcttggctcactgcaacttctgcctcccaggttcaagcgattctcctgcctcagcctcccgagtagctgggactacaggcacatgccaccatgtccggctagttttttgtattttttttttagtagaaacgtggtttcaccacgttagccaggatggtctcgatctcctgaccttgtgatgtgcccacctcggcctcccaaagtgctgggattacaggcgtgaaccacagagcaaggttttgagctgagatgagactcatatacttatccctgatggttggggaagggatagggtccacagacctcccaaaatgaaaaggcaaattcatgtgtttgtaagttccataaaggtaagatctctgtcatctcacttgttttccactatgtcttgtgttacccttaattaattcattaagttccaaacatgggacttaatgagcaaataaatggctttctttcccttttgaagggtctgtgacatcccttctctctcccataaaagcttaacaactactgatgaactaatcctaggaggtagtcacataagtcacagaaattggcctctcaatggaagagataggttttgagctgggctgtgaagagagtagaatttgaataaagggaataagcagcccaaataatgtgctctagtagtaggattgcaatcattgggaaaccctgggtagatttaagagtatatatgtcactggaagtgagaccgctaggtaggatgtaatccaaatgtggtaagcactgaaagccattggcatttccttttaaagtattaaggtttattaaggtatgatataaatacaataaaattcactctttctatataccatttccatgctttatgacaagtgtgtgtaagttctataactactaccacagttgagacttaaaatttctactatctcaaaaagtttccttagccacttcagtcaacatctcccctccttaagccccatcactgatgtgatttctgtccctacagttttcccttttccagagtgcattgacaagtttttaagcagagcagtgactcaattttaggaagcatggcctagcatcttacctcaggttggattggaagggcaaggagaccaataaactgcagtaatgggaggcctgggatgaaatccaggctgggctttaactagccctagtgatctgtgtttaccaactataggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcaggtaagttggttgggagcattagacagtgcttaagttactttggggacctacaccaaaagggatgggagtcctaaggaagctagaggggtagttgtggaaatcttacacaggccctgtcctaaccctcttttttggctttgctcttgtacacagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctgga

SEQ ID NO: 132993 - DNA, 6201 bp, Homo sapiens
tgatccatctgccatggcctcccaaagtgctgggattacaggcatgagccatcaagcctagtctcattttcttttcttttttttttgagacagagtgtcgcgctgtcccccaggctggagcgcagtggtgcaatctcggctcactgcaacctccgcctcctgggttcaagcaattctcctgcctcagcctcccaagtagctgggattacaggcgtctgccaccacgcccggctaatttttgtgtttttagtagagacggggtttcaccatgttggtcaggctcgtctcgaactcttgacctcaggtgagccactgtgcccggccgctagactcattttcatatatttgtatacacacacatgcaaaccctgcacacatattcatatgtcttaccctctttttttcctccatccttcctttgctccatctctccccttctctgttccaggagagtaagctatctttatggatctctgaaggagaaagtggtccattttggctgggtcagggtccagagtgcacagttctaccattggtggttgtagtgaaaacttgggctacctatatggcagaagtcagaacttgatgggcttctgacatgtcaggttttgttcactgacctcttgtcagagggactcttcacagtttacctttctcatcttgcctgctgcttattaagacaggtggggtggagttggggagaggtagggcaatatctaatgaagggcactatctaatgagcttggcattttgaccccagggtctgatgagttctcactttgtcttgtagttgacacctctaactgtgcttgtactgtttgctctcgcaggagacatttttcttgtccgtggtgggatgcgtgctgtggagttcaaagtggtggaaacagatcctagcccttattgcattgttgctccagacacagtgatccactgcgaaggggagcctatcaaacgagaggtgagttttctccctgattccagtatccgattttatgattactcagtgtggcatcatgtggtaactgtcaggactgggtgctcggccggctgcggtggctgacacctgtaatcccagtactttgggagactgagatgggcagatcacttgaggtcaggtgttcaagaccagcctgggcaacatggtgaaatcccatctctactaaaaatacaaaaattagccaggcatggtggtacacatctgtaatcccagctactcaggaggctgaggcaggagaatcggttgaacccaggagtcggaggttgcagtgagctgagattgtgccactgcactccagcctgggtgacagagtgagactctgtctcaaaaaagaaaaagactgggtgttctttggagaactaaccatctttcagggatgagaaacctgccagctattcatttctgggcctaattgtttcttggatttacctaatgccaggaatttcaaaaaactagactgaacccaaaatatataagtgattgaaatcatttttgaagtaaagctgatggtggcttcaggcctctgcccattcccagggtttccagcttcagattttagagaccccttctcagtaagactacgagtaatgtgagaggcaaggactgtgctagaaatctttgccttgggatttttgtagttgttctttgaggccggatccctttagaggagaatcttttttaaatttaatttaatttttaatgagatggagtcttgctgtattgcccaggaactcctggactcaagcattcctcccacctctgcctcccaaagtgctgggattacagatgtgagccaccatgccgggttgagaatcttcttatacggtaggtttttgcacactaggtagtggaatgatttagagaaactcagcttttgctgatataatattcttgccttctcctttctttatctcctccatattcaggatgaggaagagtccttgaatgaagtagggtatgatgacattggtggctgcaggaagcagctagctcagataaaggagatggtggaactgcccctgagacatcctgccctctttaaggcaattggtgtgaaggtgagcatcctgggctctggaatcaagtctaaagtggtgccaatgtctaatcctgtcccaatgtctaatcctgggactgttttcatgcatggctttcattattgccttggattagaggggcaataacgtatcctttagtttacctaaggctctaaattcattagagctgatggtctaaaaccagagtaggctaatcaaattgtctgttgtgtgcgtgtgcgcacaaaacacacacacatatatatatgggtttttctttacaactcttagaatataaaagccattcttgtatcaatggaccctgtaaaaacaaatctcaccatagtttgccagcctgtctagagcaatgtcacccagtagaagtaaggaagttaaggaaattttcagagtgttaaagggttctgagtctaaaacatttgagaactattggtctagagtgtagcttctcaatcttttcctagtgggaaagtgtttccatggaacacactgaagatgaagttactcattttcctagtgggtggcacacaaataatttcattttctatgtggacagtttacatgttctgcttgtggatgaggccatagaaagggtagtgttgaagaagaaaaatgatgattgtaaggaacagcattccagtgtgataaattctggagggcatgattactggagtgagtgatcctctggcaatgaagaaaatagaccctgctctcttaaatggcttagctagtctttggcccttggtctgtctaaaattgagcccttagtgtaatggcctcttgcctttccctagtcatgtatcttcaaacgcatttggactacagtttctctgcccttagtctcctatgcaagttgcaatcataaatgttgcccactttctagcagtattttccctgctagtaatagaaatgagtgtggcctaaagtaattgtcttcttagcatttactgcggagggcttattcttaatattgtcagggttgaagcctgattctcaccctctctggagcgctagtcaagccattttagggtttgggagaaggtgggaacctaatcacactctgcattggtccacagcctcctagaggaatcctgctttacggacctcctggaacaggaaagaccctgattgctcgagctgtagcaaatgagactggagccttcttcttcttgatcaatggtgagatatttggttcatcttatgtctagctagacccaattttgaactgggcttatgagctggagcacttatgaacacatcctttttgcacccatgccctccttcatgtttatagcatatttcttatgctggggtatgttacagacagaagagcaataaagggaagatattttacattggtgctccctgtcctgccccctttgagaaagattgtggacagactgcagagcgggagcaagctagaatgagaaatcaaagggtgaatggttagtgatttgagagggtttggggcaaatgaactttgatcactggctcttggagaatgctgtttagtggtgtgccatctggtgtgccatctctcttgctctagccagaggtcctagagcatttgctgtcacctttacagttcaactgtgagaagagtatagtgagtccctgggcttctctccagccttgcctggtggctgtcctgggataatggctggtagaggatgtgagaagtaggcagaggttaccaccttctcacccaggacctgtctctgggccaaacaagcaagataactgatttttgggaggaattgggaaagactatcattttgttattgtctccattctgtatcctttcaggtcctgagatcatgagcaaattggctggtgagtctgagagcaaccttcgtaaagcctttgaggaggctgagaagaatgctcctgccatcatcttcattgatgagctagatgccatcgctcccaaaagagagaaagtaggagcttacctgaggggatagaggggggttgaaaggccctgacttcacttctgaccagacatcctgttctggcagactcatggcgaggtggagcggcgcattgtatcacagttgttgaccctcatggatggcctaaagcagagggcacatgtgattgttatggcagcaaccaacagacccaacagcattgacccagctctacggcgatttggtaaggactccagatacttttgaccccgtccttgcttaggtcctacttctctccttcatctaagtcacctaatcctcttgaagcccttcacagtgattgggtccaggggtctttttcctttaccctacgtcctgtctagagtgaccaaccaccctggttttcctgagactgaaaggtttcccagagcttgagacttttttagtgctggcattaggacaatcctgtgctggctgagatggttggtcaccctaggcctgtctcttacctctggactagagatgagccctgtttatgtttgtgtactgtcccacaggtcgctttgacagggaggtagatattggaattcctgatgctacaggacgcttagagattcttcagatccataccaagaacatgaagctggcagatgatgtggacctggaacaggtgaagtgatgatgatggctgaccaggcgttacagtgtctctaggcagttgctgggaactggctagagacataaggttaagatgtgaggagatgggttttgatttctggacaggggaaaggaagtaatctgagattgaatccaggaaatgggagttggcatttttcatagttgacgctgcatttagagtaaatcagaattgttggagcagccttatttctaggtcccaagtccagaattaagtacttaaaacccagcccataaaggtattgatagtatatattcaaggaaatgagaggacccagggatagcagtcaggggaaggattctattgtctctgagcctcctgcagcagctgggtctttgaggcagcatagtaagtagatctttctctgcaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccgggtaaggaccacacccgtgcctcaggtacacacatacgtgctttgacccctcccttgataagtctcatccccagttttccctccttttctagtgggccttgagccagagtaacccatcagcactgcgggaaaccgtggtagaggtgccacaggtaacctgggaagacatcgggggcctagaggatgtcaaacgtgagctacaggagctggtccaggtagggcaacttggtccagggtgagtcactgtctcagtacattgtaattgatctgggtgatctcagggtgtcaacacatttgctgcaagagttgtgagagcacgacttaggaacctactgttcttaggtttgaggcactaaggagtcttcttctagagaacctggatctgataccattgggtacaccatgaaataatggaggggatgcttctgtttagttaggtttctttcaaaatgtggaggtagccttgaaccctctttccttttcctcctagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggtgagctacaataggctgaactatgtattgatttgcctgagggcaaggaatagaggctgtttttctttaagagggttgaaatattcttagtgctggctgctcaactgcacagtaagtcacttgattttctttctgaggtctgagagacctagtgttattttttttttctctctctctctcttgagacagggtctggctctgttgcccaggttggagggcagtggtacagtcatggctcactgtaaccttgaaacctgggcttaagcaattctcctacttcagcctcctgagtagctgggact

SEQ ID NO: 132994 - DNA, 1090 bp, Homo sapiens
agggatttggatttgccccatgtctcagcatttcttggttttgattttttgagccaactttatggaattgtgtacttttgcagatattactgtgaagttccttttgaccttgagcctctttctggcggtttgatgtctgttagtgttttttccaaatatgatggtctttatgcttggcattcctttggtactatggaatgccctggcatcagtaggtttagcctataaggagggtagcaccaatgattctgcttcgttgtccccaggcttgcttggtagaacttaaggcctccctgagcctcaagggaggttgtctggcttacttaattccctggaaagttagcttatgctttactctatactgttaatcatggtgaccattaataccatgtgccaggtattatgttaagcattttacattcattatctcccttaagacaataagcctctgagataagtattatattccttcttttatagaggaggacatcaaagttcagaggttaggtaacttgcccaagatcacaattaagcagtggcataattggaattcagacccaatgggtctgactatagagttcctgctcttaaccactcttctgtaagtctaagactatttttatttctctaacaactattcagcctccatttctattatgtcttcttcttaggccattattttctgaccctggggcaggatcactcacttggggccttatagctgggacactgacgctcaaaataccaggagctgctggaatgggtattgtaatatgtatggtagatactgctcctcgtgaccttggctgcctttccttcatctgagctttctggtctagggacagcttcatctattcactgtttctttcctaagtatgagttttagagactggcgaggcgcttggggcaggagtatctactgactccatttcctccttctagttcaaaaggtgatgacctatcaacagccattctcaaacagaagaaccgtcccaatcggttaattgttgatgaagccatcaatgaggacaacagtgtggtgtccttgtcccaggtaagctgtggccacagactagtctttccttactgc

SEQ ID NO: 132995 - DNA, 1750 bp, Homo sapiens
gagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcagggtaggcccggcggggcctggccgtgggcgcgtcagagaggtggagaccaggaaagagggaagggaagctagggggcgagtgaggggccgtggacccggcaggcccggctggggccagctgcgcacccgcgcgccccctaggcggggcttgcgttgggtccgggtcggagcctgggccggatcgtgctgtgtcatgcaggccccggcccgcccgattggctcccttagaacggacgtctgggcctggccaggtcttccggcccactccgccggcgcggcgccccggggctttggggcgccagtctgccgtccggcctaccacccgccgaaagcctttggtccccggagagagcaggccccgcgagcccgaggccccagccgggcccggtgggcgtggactttgcgccatgtgaaggcctcaggagctctgccaccgaggcggagcccggggtcggggaaggcccgccgagctcagggaagctcacagccgcctttttggagccgggtcggcggggccggaggtgggcatcctctgtgtgtgacctgagtcgtgaaggactgttagggagagggcgagccctacctttcgcttctggtcttcttactttaggcctgttgttcatactagaaagtttgagccagttttccttaatgttatgactcgtgggtggggagaaaggaatttttctttaacattttaggttcttgctaaagttggaatctcagttcgtgttttgtgcgcctttccagatttccaggtttcgtggtgtgcagtttagagttgcactaactcttcaaaaacacaaacgtgcgcgcactcctttccccaaccagctatattgagaaattacccgggctctggggctttctgaccccacctccatccttaggaaagcgttagataaaacttggctacctcagcccattcaatttagaatagagagcttttagaggcaaaaaaaaaaaaaaaaaaaaaaaaaaaaacacagccagcccaaggaaactctatgcaaattaccttccttccttgaagagattagttttttgaggtgtgttcctttttctcaagtt

SEQ ID NO: 132996 - DNA, 1068 bp, Homo sapiens
caaagccttacaggacttcctcctcagtgtgcagatgtgcccaggtatgtatacttgcatgacgtcggctatgcatagatgtgcaaggacagagaggcccatgggaaatacttgggcgtaagtgtaagagtggtgttctcagacaggaggggtgattggggttgtgctatatatacctagggatatatccaggtgttcaaatatacacagtgtgtatgcagggctcccaagagttccctggtttccccgatatcctcagacacaaagaccatgactctgctgttgtgggttgcacaggagtagggggcagatgatggacactgggatgggaatggttgtgaatgatctgcccccgcttccatatgtgagtgtaggcaagatacttcctctctctaggcctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattga

SEQ ID NO: 132997 - DNA, 1004 bp, Homo sapiens
ctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataattatgtgtgtctgagatgtgggggagccccactgttctataggggttgtgaggaggatcagtctctcctgccaccaggcacagatgagatcagtcatcttaggaaagcctggctgcacctgagaacctttatgaagtggttggagttgtctgaattcactgcctccacctcttcccaaatcaatcctattatcccaccgctattttcctttgccatgcaacacattttgttaagttcctgttctttgtctgataaagagagaagactgagaagacaagcccaggcatcatgcagcaccgactttaactgtctgaagccccaaatagtgctatgcccccgctccactgggccttttcactatagaacaccctttgcccttcccttctgtggaagcctcccttgtttcccaacctgtgccactctttatcagatctacatgcccatcttatgtagcattccaccttgtcccattcattattcctgacttgaagccaaaattgtgtgaatccactggttcttttctcatgtgtatgttttgtgccctctgttcaccccagcactcc

SEQ ID NO: 132998 - DNA, 2029 bp, Homo sapiens
tatgtctctgacctgttccccttggcctctgaccttttctctgccaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtaaatatctcagctctgattcacttaaagacaatagtgatgtgagttcggcccctcttgttttcaaggaggtgttgctcctcatgttcctgagcttgacagagggtcccatgccccacacaactaggaaggtcttcttggtgtcctctctcttacctgccatagccaagcaaattgatccctcctgttggttcccagggttcatggagaggagagacaaggagtcctctaagactccctgtggaaatgctgcatcctcatgagcacatttcttgattttccagtgatggaagtagtaaattgtgaatatataatggcactgagctgtatgtgtttgagagaaagaaagagattggccatagcaggattcagataagcctgatggcgcttttgtaccacagagagaattagaataacagaatgttgactgtaaggaggttgggctgataggcat

SEQ ID NO: 132999 - DNA, 1022 bp, Homo sapiens
cagtttccatggcaacgggattggggtcagtccccagtgggagtcctgggcacaacacagcgggactaccagagaatatcactatggcaaccatggcaacgagtcagctccaatccactagtcgctatggtgacagatgggggcgatactacgctctggtgggcaaactgagtctcgggtgaggacgaataattcagtgcgtggtgtctgagtgataatgcccgcgaaaaatagcctccattttggccatcaggccggggatcttcggcgtgaacagctaaacccagaacaaccacagccttcgcccttctctagaaggtctgcgtttcccagggaacaacttgacgcgccgttcgaccaagtaacgctgattgggtgagtgttgaagcgggggagggagctgccggaagtacatccgggggagcggaactgcaagaggaaaggctcgggtaggcttctgggagcgaccgctccgctcgtctcgttggttccggaggtcgctgcggcggtgggaaatgctggcgcgcgcggcgcggggcactggggcccttttgctgagggtgagagcgaggcaacctttccagagggtcaggacagagattacctgggttctccgctggaaaagagcgaaattccaacttttggagaggactggggtcagaggtcatggtccccatgtgattctccgaggatcctgagggtcgtggtttatggagatgccttcaggaccgaggggcggcgtgtctggccagatgggatctctgctcaccctcttctttccttcagggctctctactggcttctggccgcgctccgcgccgcgcctcctctggattgccccgaaacaccgtggtactgttcgtgccgcagcaggaggcctgggtggtggagcgaatgggccgattccaccggatcctggagcctgtgagaaacctcttctgcccaccctgggccagccagatgaccaatccctcacgacatgcaatgtcgggaggacttcctttgggcctgcccgcactgtt

SEQ ID NO: 133000 - DNA, 1035 bp, Homo sapiens
ccctgaccaccttttcttctcttctcttacacagatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggtaagccaataaaggacctcatttactctttt

SEQ ID NO: 133001 - DNA, 1030 bp, Homo sapiens
gcctcccaggtcccttctcactcctctcctccccacagcctgggacaggccccatactatactggagcttcggagatttgctctttccctctagcacactcaccccgctcccaaattggctccgcggaggtggccgctgctccgggcccttccgtcccgtcccgtcccggtccctccccttggttccccggtcctccctgccacgggcccccaacccagacaaagggtggctcaggctgagccctgctctgctaggctcttcgctgttcagcttcgtgtgcaacactagcgggccctggcgcccgcagccccccagccgctgccgcgcccctccctgcgacggtccctccccggggccgccccggctccgcgccgccgactccactgcccctctgactcacaggccatttcctaccagctgatggggccgcccgccccgcccagtgccccaccacccgcgccgcggcggccacggccgccacgcccccctcaggctacgccctccctggaaagcgaccatgctcattggtccataggaagccagcctccccgcgacctcaagtgcgaggcacgccccctccaagaggcacacgcctattggtccataagggggtaggcttacccaaggtcgctccgcccttctccttaacccgacagctgccggagtccaaagcaacaccctgccctgccatttaaccctttcaaaggcgtaggccttccacatcttacccctccgccctactcccccgcccttcctccttccaggacggttaataggaagcccgagggctttaaagatacggtttgacaaccctcaaagtctgcctgctgtctataccagaccccagaccccaaatacctcactcccatttgtctttccccaccttccaaaccaaagcttcagagctggagaactagtgaagcccaggaagcttcctccatgccagagaagaaaaaggcctgaggtgggaccctatctccttccatgttaagaagtggtacttttccctctgttactcttaaattgatg

SEQ ID NO: 133002 - DNA, 1027 bp, Homo sapiens
tctacagattagaagcattgttgttgtttgtgatttctccaataacgatgtttcccccagctactggcagatgaaactgctttgctctgttctcttccactattttgttgaatctgcattaaccaaaatggatttggccatttcccgggattatgagatatacagtttttcttctttcatggttgatttttcattaatgagaattttgctttgcttttagtaagacattttctctcagcagctgggaatctatttattcctttagatccctgctgctgagtagcaggatttgggagaggttggactttgctgtgtctcttggacagtttaattctctacggccacactgtattacagagctggtccttatgaaagactctttaggcaggagcactcgtgaatcagaaattcctatttaactgaatttatataactactggtgttttcatttgttttaatagcaggcaggtttcattgtctagaaattctgctatttagctaacttctttcctttttaatgttactttagtgaagtttcttcttttttgaatctggagaaacgagatcagcaggccattgtctttttgaatagagatctagaagattttaaatactgaaacaaacaggtaccttatatgcagatattcatattgaatggcaaagtattcattttgggaaaacttacagaaatgaattgaaatacatctttatttttatttctttttctttttttgagacagagtctcattctgtcacccaggctggagtgcagtgctgcgatcttggctcactgcaacctccacctcctgggttcaagtgattctcatgcctcagcctcccgagcagctggaattacaggagtgaaccaccaggcccggctaatttttgtattttttgtagagacagagtttcactgtgttggctaggctggtcttgaacttctgacctcaagtgatccatctgccttggccttccaaagtgctgggattagaggcataatccactgcacccagcacaaaatacatct

SEQ ID NO: 133003 - DNA, 1022 bp, Homo sapiens
ctgaatgttattgtcatctgcctcagctaactcctttttgctgggcttccatcgatcgtggttctagtagtccctgcccttagagcagagctgtggctgtgttcctttcacttagggcctcaggaagttgattgtgctttgtgtgagccaggcagtgatgggggaaaggaccaatttgctctgctatgctattgttataaactgttctgttccttataagtagcgtattctgtaatttagtttctaaaaatggggtttctgaaagttgggctctttaggccaataagcttaatttttatcctatttacctgtgctgtgtatttcagactttgagtttgtttaaagtttgggctgtgtatcattagtaaatatttgttggatactttctctgtgcatgtttatgacacaaatctgtattgtagataagaggccacggaatctagataggttttaaaatgtctgttatacagtgttcttatataaactcaaataatccattaggattattaggtctgatttggaataagcagaataaattaagttcttccttgagtagggaaataactgcactgtcttgttttaacatttattttcacattgttattattactgttttttttttgttttgtttttgagatggagtctcgttctgttgcccaggttggagtgcagtggtgcaatctcagcttactgcaacctctgcctcccaggttcaagcgattctcctgactcagtctcctgagtagctgggactacaggtgtccaccaccacgcctagctaatttttgtatttttagtagagatggggtttcaccatgttggccaggctggtctctaactcctgacctcaagtgatctgcccactgcggcctcccaaagtgttgggattacagatgtgagccaccacgcccagccttattttatgattagttttttgagactggatcttgctctgttgcccaggctggagtgcaatggtgcgaacatggctctctgcagcctcgacctcctgggatcaagtg

SEQ ID NO: 133004 - DNA, 1111 bp, Homo sapiens
attatagtagctgatgagtatttgggcagtaaagaagtggaatgagcaagtgtaggctacacattcagaagttctgcagtgaagagtagggttaagagtagtcttaaaggccaggcgtggtggctcacgcctgtaatcccagcactttgggaggccaaggtgggtggatcacttgaggtcaggagttcgagaccagtctggccaacatggtgaaaccccgtctctactaaaaatatataaaaaaaaaaaattagccagacattgtgctgcatgcctataatcccacttatttgggaggccaaggcaggagaaatgcttgaacccagaaagcagaggttgcggtgagctgagatcacaccattgcactccagcctggttgacaaagtaagactctgtctcaaaaaaaaaaaaaaaaaaaagagtagtcttaagaagaaatttgagtattttgtagcttgaagggaaggaatctgtaagaaggggaaagtcaagatgagatggggaagggagagatgataactgatttcttttgtaaagtaggatgcaaaattatcagctgatagtgaggtggtggggatgatttagagagcttgaggagagtgcaaagggttcattcatttattctttcaacaactattgggccgggtgtggtggctcatgtctataatcccagcattttgggaggctgaggcgggtagatcacttgagatcaggagtttgagaccagcctggccaacatgacaaaaccccgtctctactaaaaataaaaaaattagctgggcgtggtggcaggcgcctgtaatcccagctactcgggactctgaggcatgagaatcgcttgaacccaggaggcagagattgcagtgagctgaaatcgcaccactgcactccagcctgggagacagagcaagagtttgtctcaaacaaacaaaccaacaaacaaaaacaaaaaaaccccacaactgttgtgctaggcacttggggaggaatggtgaggaaaaaacccctttccttcttggaagtttatatagactagtaggactacggaggagttagacattaaacaaggaagaatcatacaaattaatataaaattacgagtaggaaaaaa

SEQ ID NO: 133005 - DNA, 1017 bp, Homo sapiens
cagctttgttagagttgttttttttcctccccctccttcacaaacatcttgctagccagtcagaacagctgagtcaactgtggtcagttggctgagagatgtcacggtccatctttatgtccaaatatttgacaaatgtaaaaatatagctgaatatgcaaattaattattgtaaccatgctaatacacatacacatatacatgcatacatatatatacagggcagtgggattatatactattcctatcttttgttttttcatttctatcatttaaaatgttaagttttaaataagaaatggtggttattgtatttttgtttttcatgtctatcttttaaaatgttaagttttaaataagaaatggtggttattgtatttttgtttttcatgtctatcttttaaaatgttaagttttaaataagaaatggtggttattgtatttgggaggtgatacacctttttacttctagattctgaaatagatgggttacaaacaagggaactagtgccacaatgtttggaaattgttccatgcatagaactggctagaacaaggcaagttagccattccctgtgcctgaggaaccaggtcactggctgcagagtcagtgtgaataggattatttcccataatcccttgtggctttggttctatatcaaggtcagagagactcaggagcggaagttacatgtttttttgagggttaggtacagttcttatatattctcctatttctgcctttacttgtaaagatcttggggaggatgctctgcccaggcattttctctttatcccggacttccagggttttcatattggctggagttttataagaacctcagtgttttgtaatgaatatttcttttccacacatcttttctgtttttacatattgtagtagtaatatggatgaggcaggaattgtgtgctgaagtacctcccagctttgactctgaaaatactactttttaaaaatctatttatttatttattttctttttttgaggcatggtc

SEQ ID NO: 133006 - DNA, 1040 bp, Homo sapiens
tcgagcttgaaatctattttctttgtgaagatttttccttaatttttgtccctgttaacagctcagctctgcagttctttatcactttttcttttttccttctggtatgtatctctttctacattttattaaatttacgtaccttatctttcctagtaggtcaattagatttggatttttccccccagatggcaagtgggctatataattaacatagtaggttaggattaacattgtaatagattaaataaattagaacaggaaatatcaatgtatcatatcttggcattcatgaatctgtttcagtttgagtgtgtgtgtatgcatatctgttgggtcatatataaaatttcttaaaattaaaaaaatagtattttagattatgctcttgaagatagcacgtagttttataatttcggcaactctgctatgtcttgaatgaggctatgttgtacaatatagcttaattttttcctgcacatgtaatactttaatttctatattgcttaattccaagggctttgtgagatgggtaacaatctgagcactaagtattatgtctccattttgtattttttcaaagataaatttaacacatatgtgaccctgaaagtacagaatgtgaagagcacaactgtagcagttcgtggtgatcagccttcctgggaacaggatttcatgttgtaagtattttgcagcagcagtgtgcctacatattttataatctttttaagggaattgcattggatgaaacaattagaagattttgtgtatttttgagatttataaaatgtactggcactgttaaatactgttttgaaaactgtggagttatagaaataagtgaggttcatggtacatgaagcacaactgcagttttgttttctcatggattcgtaatttgttcttagagatgaatgataatgcaggtaaactcccaattgatttgtgttggtgaaaaactacataggcagattttctcagtggtcagaattagaatacagtacaacagacttagcatgacattaaacataacttca

SEQ ID NO: 133007 - DNA, 1052 bp, Homo sapiens
ccccccctccccactgaggtttaattgggatataagaaactgtacataattaatgtatacaatttagacatttatatacttgtgttaccatcaccataatcaaggtagtaaatatatttatcacctctaaaagtttacttgtgtctccttttttttgttgtatgtgtgtgttaagagcatttaatatgaaatctaccctcttaaattttgaggtgcacaataccttattgctaactggaggcactatgtggtatagcagcaggtctctggaacttatttaactgtaacaaaggcagttttctatggatacctattataggtttcttggagcctaaaaatggtcgtggcattctgggaaattttgatttttcctgaagacaggatcctggtgagaaagcattcaaagtttagcaaaacaggagatgtagttgtttctttcatattgtctagctttcctcaaagggctttcctctttcccttagtgagattagtcgcctggacctgggtctaagtgtggaggtatggaacaaaggactgatctgggacaccatggtggggactgtgtggattgcgctgaagactattcgtcagtcggatgaggtcagtcattgcattttctgtttggaagtatggttcccagcccatgcttctccccatgctagctccactttagctaatattcatccatgcatcttggattattcttccccctttctaattagagggcatgcaacctgcctgttcctaacttcacctgaaggttcagatgattttatttatgtctggcctaccctgtgtcctgtgacaactcacaggctccagagcacctcttcagccttatcaggtagatagccccttctgaggtatgtgtgtgtcggtgtgtgtgtttacttagggtacttgtggtttctgtgttctcttctaagtcactgccctgggaggagtcccattaaacttccttagccagctggctggctattctctgctttgtttctttgagttaccaatctccaaggaactagttttcagtgcccttcttctgcatgtaagcc

SEQ ID NO: 133008 - DNA, 1089 bp, Homo sapiens
gagcatctcaatatctcagcatataacttttcttttaagctaatcctttggatggttttggtcttgctgaggggaaggtagtatggttacatagaaagaatgtagtttttggaatcatacaaaccatggtttgaatcatggctcatctctttataaactgtgaccctgaccagattattttagctctctgagcttcagcttcttcatctacaaaataacaatgggaataacagtacattgtattggtttttgtgaagagtaaagataatgttcatgacaagaaccaaaccatcagttaaaacttgtgcatcactaccaccttctgacttcagtcattagacagagtaaagtgttatctgctgatgatttattacctgctgatgtgatttcttttctttttcttcttttttttatggtagatatcccagaggaggaagccagatattggacctacaaatgggagcaaatcaatgccttgggagctgacaatgaggtaggagcagccttatttgcagtatagagagatgggggaaaatctccaatgctctttataggttgcccagggaggggcccaagagcatgttgtcctgagaatgaaatcacttaaattgcattgaagaaaaaaggcagctagaagattgcctgaaatgtcactagaaggttccatctccaatttattctgttcttcccactctcccatactgtggtactagtctggctgtagactcttagagagggagcttgtaccagggaatctgtcctcttttgttacacctgtgagttggaggcatttcttttgcttctactgtctctcagttttttggatattattcttatttgtgtcctgtttttgaggatgtttagactattgcattgtttgttcttgctggtcctaacttacctccagagatgaggctggtgtgtataagagaatgcattcagctcaacctggggcatcaggattggagaatgtttttgttattgctgatggagggaaaagatgataaatttgtttattttggacatgtgggctactaaaaaatgggtctgattataagatatactttgagtgccagaggatatttcagc

SEQ ID NO: 133009 - DNA, 1047 bp, Homo sapiens
tgaagatgatggtaatgattgtagcatttgttgttgtaatattagtaataataagaactgtaggctgggcatggttcccagcactttggaaggctgaggcaggaggatttcttgagcccaggagtctgagaccagtttgggcaacaaacagatacctcatttctacaaaaaaaaaaaaaaaaaaaaaaaaaaccaagtgtgatggcatgtgcctgtagtcccagatacttgggaggctgaggtgggaggatggcttgagcctgggaaatcgaggctgtagtgagctatgattgtgccactgcactgcagcctgggcaacagagcaagaccctgtttcaaaacaaacaaacaaacaaacaaacaaaccatagcagctaacactattgaggtcttacagtatgccagatgccattctgagactttaagtattctaatttatttaaacttcacaacaaccctaagacagattttactgttgttcccatttttgagagcaggaaactgaagcataaatagattgagtaattcgccacaaatcacatagctagtaactggtgaagtaaatattcaaacacagaaaatctgacttagtagctcctacctctgtgtgaaccactgtgttatattgattccttcatattgtttctgaaaaggaaaacctttgtccatggtttgtgaatctgttggttgccttcaatttggtacattctataggcccactttcctgataaaagtaaaggccaatggtagaggtgaacttttttttctttatttaaagaaaacctatttttcatatgatttattactaacttttgttttttgctgtttaggaccgaacatttaaggtcataggaggtcagaagaatctgaatccaaaaccaggttttcaggtttacaggtccttttcaaaactcattgtaatgagttcattgtgattgatttaatcttttaaacctttttccacgactgctaatgagaagcaaaatgtaaagattgagattttacttcctactccttcctggtctcattgatgaaatataattgaag

SEQ ID NO: 133010 - DNA, 1032 bp, Homo sapiens
tttttttgtttttttttgtttttgttttttttttttgagatggagtctcactctgtcgtccaggctggagtgcagtggcagaatcttgggtcactgcaacctttgcctcctaggttcaagcaattctcctgcctcagcctctcgagtagctgggattacaggcacctaccaccacacgtggctaatttttgtatttttagtagagacagggtttcaccatgttggccaggctggcctcgaactcctgacctcaagtgatctacccacctcggcctcccaaagtgttgggattacaggcgtgagccaccacgcccggcctgttttattttttctttatactttattgtactttccagatttcctccaaagaacatgcatttgttttataataattttaaaagggataaatattttaaaataacccaagcctgacaatacagaagcaagttattgtagattcacttttttagtttgaatttgagacttagttgaatgataatttattgttgagattgacatagtttagttcaacaataccagtgattccttcactgaaaattccacgtagcttttagagttgcagtgtaccttttattaatgatatccctaaagcctcccttaactacttaccgtgtctgaaacaaaaagcttctggggtctatgttatttctatatgtattatgatctaaaagatagcttgaacttttgcttgagatatagcccaccttggagtttcaaagagatttttctggttatctattaagggtttgtttcactggttttcttacagtattgcctataattagtgatctatacaaatcataaaccaaaatgtcctgagtacgaatcattcttttaaattagtaaaacggcataacccaacatattgtttaaaaattttcttgaagaatgaatcagttcagaacagttggatgtgagtcatatcatgaataacaagtgaccaaacattcagaagcattgtcagtaatatactgcttagttgctgggttgtgacaaattatttgaccacca

SEQ ID NO: 133011 - DNA, 1032 bp, Homo sapiens
tttacattctaaacaagagcctcaagtaattattaaaattaaaagatggccaggcacatggttcactcctgtaatcccagcactttgggagcctgaggcaggtggattgcttgagcttgggagtttgagaccagcctgggcaacatggtgagaccccatctctacagaaaacaaaaattagtcgagtgtgatggcacgtgcctgtagtcccagcttctcaggaggctagggtaggaggattggttgaggcagcaatgagccatgattgtcactgcactccagcatgggtgacagggcaagacctggtttctaaaaacaaatttttaaaaagtccagtcaaatatctgtaataattcagaataattctgtaatctctaataattcataaggtaataagtttcttgataaggatagttaaatcttcaaggaaagcacaaaaggaaggagatttcagcagaattaactactaagtttgttgactgattggacatgggaaataaagaggaattttaagaatggtcctgtggtttctgatttcaaagtattgggagtttggtggttttggacatgaggtgtacttgctatactcccgtatttctagagaatttttaacactgtaaatacaatgccattaccactgggggctgtgatactgtgattttataataagaaacatatattttggtctttgtccctggttcctgacacagagctcctaatctcttagaattttatggatactaggaatgtctgttgttctaatgagggactcttgatgggcttccacataggaaccagttatcagacagaccaagccatgtttggaagcttggaactttttttttttttttttttttttgagatggagtttcactctgtcacccaggctggagtgcagtggctgtgatcttggctcactgcaacctccacctcccaagttcaagtgattctcctgccttagcctcccaagtagctgggattacaggtgcctgccaccatgcttggctaatttttgtatttttagtagagaag

SEQ ID NO: 133012 - DNA, 1063 bp, Homo sapiens
catgccactgcttttatccaaattctagaagatatttcccttctgcctccaatcttcacctattaaaaatgaaccaattcttcaaagccatctcctccttaaagcttccttagttaccctatcaggaagtgattttacttttaattcatagcacttggtttgtactaactgccttgcatagcaattcaatatttgtgtctatatattctgtctcctattagactgactctatattctgagtcttctgtgttgtttagctttggatatgtaggcagtcagtgaatatttgagtgagtaggtgttcccagccttttaattttccatctttcaaatagactttaccaggggcttttcaactgttaccctcaaactggctctctagttccttcttaggctgagccaaccaaacctgcactcagtttctctctgcaaagccagggcttttctcgtctagccgacatggtgctgtgggatagattatggaggcagtaagagatcgtcagtgacacattaaaaacacagttatttaattcaaattgaagtgttacatattttcctgaatttccctttttagtttctaatcaggcttggtgccaggaggtttactttttaggaaaactggaggtgattgcctctcactacttttttctgtttctctcctttgtctcactttattccttagtatattctctctcttgccctctcctgcttttcatattctcttctactcccaacctcttctttccatggatgctttgtttcttaatatttgccctttatttctttagtgtagaaatgttgttagcctttagtaaagttgtagagtatctctgtttagcctagcaaaataaacaaaaagcagactattatttaggagtaataggtcacatgcagggagaaagtaaaacctgtggatttgggttgtgggcttctaactctggctgagctgccctctctggcctcaaaagtgataggattgtctgtcgcagttgcctccttggagactgaatcttgtttctctgggttatgtgctaatacttttcctgccagagtttagtagacc

SEQ ID NO: 133013 - DNA, 1027 bp, Homo sapiens
aactcttttctgtttccgctgtatagatgcaggtccttatctcctgcctgagcaattgtaaaagcctaatcttacggtcttcaggaggtttccactgcccacattgctacaagattatctttttttttttttgagacggagccttgctctgtcgcccaggctggaatgcaatggcatgatcttagctcactgcaacttccaccctctgggttcaagcgattcttccgcctaagcctccctagtagctaggattacaggcatctgccatcatgcccggctaatttttgtatttttatagagatggggttccaccatgttggccaggctggtcttgaactcctgacctcaggtgatccacctgccttggactcccaaagtgctgggattacaggtgggagccaccgcgcctggccccaagataatcttttaaaattactaacatgagttcattttgtgctaaaagtatctccattttgggatggtgaacattccttttcctcattgtaagccaaataggaacttgtcaagaaaggacacgtggaaccctgttaatcatacacataagggtatggtgtcagatacgacttcctctctgtaaaacaggcttcaaagcactcttaggttgagctccctttccaagcacagcgatgatttgtaagtgtggtctttttagttaactttaacaaaaaaactgtagccagtcaggtgctggtctgaaggacaaataattctacgaaattgtagtcactgctgttggataaacttggctgcattgtcagcaagatcccattggcagtgcataagttttttcttctctcagcccatcctctggatgggaattctgagcctagggtgtaggtgcttgacaggaattgttaggaaaagctaacactgcagcagcacagtaagagtgctgctgttctcagctgcatctagagcctttgacttgatttccaggccttggctttgaccttcctgatttccaggaccagcttctgatgttagacctgcttatttggttcaatcc

SEQ ID NO: 133014 - DNA, 1006 bp, Homo sapiens
ttctaatactgaaaattgtaccctttgccatactgaaaagaaacaaaatatggggtacccagttttgtacccctacaaaaatggatttgtggttaagagtggcatgcagcgcattaagttggaaagtcatgattatgatctgtccagttgtttaaggcactgtgaaaagtcatctggctcaaaccagcatgtcactaattttacctcattagatattcttgaagattctactagtagtacttctgatgaacttctgggttcccccatttctgataagcaggaaaatttacagtcaccaacatggcattcatccaatgtccaccatattggagattttcctgaggaatattatgtagcaaattcagcattgccattacaaaggatgaattgtgatgcaaaaacacttggagatctgtctgagtgctctatagaagagataaccccttcctctattgaggagcccaaggaggaccgtattgatacaatggatgagcttcagtgtttggtagaaacggtgtcagaatatttagcagagaaggaagaggagattaatagatttggttcactttcaaaaactaaaaaatcacataaacaaaatagtactcttgatgcagaacagagaacgcctggggatcaaataccacctttaactattgtcaagaatgacaaggacacggccatctctttccctgagttgactggagtacaatgtgctgttggttctttgtttagttcactcacagaaaaagtgggttcaggcacaaagcatctaacaaactctgtggaaaagttggtttccttagttccagaaaaaacagaaactcttaatcaaatagaggcaattaatttgggatctaaacccagagccatggcagtattggggaaggatctttccatgcaatctccattatcctctcaaaaagatgataatgtgaatatagacagacatagaaaaacctctgaaaatgagcacatgggtaataaaactgggagtttatactttcag

SEQ ID NO: 133015 - DNA, 1164 bp, Homo sapiens
aggaaagtttgtcagaacctgtgaaaattcgccaggtggaggaagatggtttagaaaggggctctaagaaagatggtcattccttttcctttagtggaaaactaaatcttccattttttagaagtcttggtcattctgaaaagcaacaggagttaaaagagaaaggaagcatttttcctttgtttaaattttctttcactgacagcaaggttactgttaatgaccagagtttacgtggctcagcagtaaccactgatgaggagagcaaaaaaaattgccatgaagataccaaacatagttcaataaaatctagttctgttccaaatattcatagtgatctaggaaaatttgacagtacagaggaatttaaaaagaatgaccagataaattgtcctgaagatgccaaacttaattcaataaaatctagttcagttccaaatattcatgatgatctagagaagtttgacagtataaaggaatttaataagaatgaccaagtaaattgtcctgaagatgccaaacttagttcaataaaatctggttcagctccaaatactcaggataatctagggaaatttgacagtacagaggaatttaatcagaatgaccaaataaatagtcctgaagatgccaaatttaatataataaagtctgattcagttacaaatattaataatgatctggggaaatttgggaatatagaggaattaaatccaagtgaccacacagcaggacagaattttgaaagggatggcttagccatccctggagttgtgcccaaagaacatataacttcagatcctttaggagaagataagaatcttatacaagcagcatcttcagtagcatcagactcttcattagagtgtatttctaccacttccaaatccactttggttaatgaaattaatgaagatgaggttatagataagacttccaagaaaaatacccaaggaagcttcctttctggcctgtttaataggttttcttctgctgaaaatttgtctagtcaagaattaaatttgaaaaatgatgactcccatcacaagaataataccccaggtttaatctctggaatatttaacctgctatcaaatagcggtatgattgatcataaaccagaggaagcaaagttcatgtctttaggcaacatgaagagtttga

SEQ ID NO: 133016 - DNA, 1028 bp, Homo sapiens
gagataaccatttatccttggatgaggtccctgctacttcatgtgtgacttctgagaacccgaagaaccatgttgaaaaacatgaaacttctagcttcatagaagcctccttattacctaaagaaaacataccattatctgatgctggggatgataatcattattgttcccctacagagaaaaaccagcaaagtgaaaagcatcacccctcctctgagaacattgtacttcactgtgctccaagtgctcagctaggttttttggagaaatctatggctaagaggcaaatgccaaaccatgttcttgaggcaaaactacatgaaaattcaaacaagttaaattcacctgtactaaataccaacattctcaataaatcaaacaactatcaggcttttgaagagatgaacagtcctttctgttttgaatgggactctgacataaaagatttgtctaaaaattccagaaaacttcagccagtttattatatgttaaatcaaaatagatttctatcagccgatgcttgcttgtggcttgactcagaaaactcagtgataaatttttgccaaaaagatcaaaatgcaaacatcttggagtggagaacaaatccaaacagtgtcatttggtgtgacttaccatatgaatcattcaatcagttagcatttaatgaagattacttattaagaggtgatgtgtgggcagctaactcattatatggaaactctggtcctcttccaattaatgaggctaataattcactagaagaattacccattgacttaagttcttcatcagatcatgaaaagactacatgccccgtagttgatcaagaatcattaagaatggatgaaaactttgttttttcaagttttggttatgagtaccaggaatggttgtcatgtcttgaacatggagtgtggtggccatcagaggatggggattatggatattatatgtttcatgatggtcaatatatctattctcttctcactgattctactgggcagtatgcatatttatttatacctgat

SEQ ID NO: 133017 - DNA, 1927 bp, Homo sapiens
ataaaaaccagcctctagctgaagattcatcagttcacctttccagtttccattggcttcagtcttctgttgaagaagttaccactttggttcatcctgaaaatatgactaaaggctcacaacaagcagaagagacatcattagtgaacaaagtggcttcagtattttctgttttgggtgcctcagttggtagtactttgaagtttgataagagtgaatccttagaggctttggccatgcagaaagtgaatcagcagtcagatttagcagagctcacaaatgatggctttcagtcattaatcatgagtaagcaattagagggtaactccccaaatgtggaaaaaagtcttcttaaggattcagaaagacagatagtatccaatgttcagcatccagaattgatcaaaaatataaggcaagaattctctttaaataaaaacaaccatgtgaaaaagcaaagtttgttaaaatctggtttccaggtaagccaaacaactcctcaggctaaatcaggtgtaaaagatgatgaaatcattacaacagactctatttcagtttctcctgcacctcagcatagtggggatgagcgtgagaattatgagcttccccagggccagtcatccaaagagtctgataaaacattatttaaaagttcattgaaactcttcagtcaagaagaatcgtcagttagtatgacagcaaatgaaaaacagtcatctggatttttgaatctttttaagactcaggtgaataaagaaggatcaccaaacttagaaaagattggtgatacaaatgtcaagataccacctcaagaaaagaaagaatcttctggtgtttcaaatttttggggtacccttggggatttctttaaagccaatgtatctcctatacagacaactgaaaatacgtctgtttcttcaatgactattaaggatgaggtcaggtcaagtcctactcctatggagctagctagccagggtgctgggaactttcctgctgcaccaatttcctctaaagggaaggctagagttagaagactgaacaaacagactactatcgatgacagtaggttagaggaatcaactagagggatccagggtaatgatttgactgaaaaagaggtaccattcagagaccatctaatccagcagtcacctaattcatctttttcaacaagtagtctcaaagagtcttccagggagtcttcagtagaaactagtggtgtgactacagtgacagaagtttcaaaaagtaatgaaatatcctttgataccctgagcaagagaaattcaaatgaacaagatcatttttctgacaaagactggagtttctctatggctgcaacatcttcatctcaaccagagttatcaaccaaaaagagtatattttcttttctcactggatctgaaaaatctgagaacagagcctctgctactctaccaagagccaaatctcaggcagaagggctattcacacttccttcatttttttccactgctagctcaagcattaagaaggatgcctctcatagtagttctacttttagtttcttcagcttgtcctttttggatcaaaaaaaggagacctctggggaaaaacaaagcatttcaactgttgttccagtgacctcccagccctgtaagaagacaaatgtttttgtagagagtggtagcacaatgaccagagaaagttccagtggtcatagagatagcatagcccaagaagtagttcatgaacagcaaatggcaccttgtatttccattaacaacaccattgaggttacctcccttgcagatgagctcagtgtagacaaggactgtcaggaaaaactgagttccaatattgtaccagggacatcagtggatttccagatgaatgaattgcaaaaagacattattcctccttcaccagaatttcaggcacaggc

SEQ ID NO: 133018 - DNA, 1034 bp, Homo sapiens
gaggaagaaccctccactgtctctgagatatttcaccagctagaaaaacaagaagaggaggcagtacctgccagtactgactctgatttgaatgtacagcagccagtcactctgaatgacatcaaggagcccatgaccaacaaaaggcctgttcttaactcaagcatcataaatggctttaaggaattgaccatttatgatgcaagtgacttagtggtagattaatcatagcttgctttttatccttcttgtgtctttcctagtacccgagcttcatgttaattaggggttaaataacaagaactcagtgtgtgggtattttcatcctccccttctctctctgccaaatgtaattcatttactggaacaaggagcttcctgcttaaagcaaaagctgggcccccgatatttactcactctggtttgctctgccttgtataatgtgaaatggagaaaggagggcaggaagaggtagtaagtagttggtggtatatattaactacaactacatgataggctaggatgcttccttgggccttaggcacttatatcttgtaggagatggggatagatctattttgctttgttttttcaagtcttctaagatgctttctccagtggcaatgagtgtattaagcaaaatacaaagtgcaaaggatgccttgggatagtctgtattcccatatcctattccatacagatttgcatagtttcttccatggtatcatctctgccttttactaccctcaaggctgatgtctgataaatgctttgagtaaaatctcacaggaactcagagctgtcctttgctgtagttcttcagtctcgagcagtgtacaggatctatctgcagagggtactgttatttcccctaagaagcagtaccatacagtacagattaagaatgctaccttgacctctggcccaaacttgttcaaaggggttggtcagggtcagtgtgtgtgtgtgtgtgtgtgtgtgtgtgtgtgtgtgtgtgtatacttatgtacaagtatatgtgtttgtgtgttgaa

SEQ ID NO: 133019 - DNA, 1110 bp, Homo sapiens
agtgatttctcttctttgaccaagggtaaacacaagccctttagttaaaggcttgactctgtggtaagaaaattcttcaaaagaactgaagcccttagatgacagggccataaaactcaaggaagtaacttctagatactgctcttctttccaccactctgcccttcttgccactgtcacattctctgctataactgctttctctcatgactttctggatatgggaatacaggtgattgagaaaagattggcttgctggtcttcagatatagagatgcatgaatacggctctgacccagatcctggagttggactttgtccactctttccaaaactgagccttgccctgaaagaagctcagttacagatgttcatctttgggacgcttcctatgctgccagggatatcattgtagcatttatgttgatgagaccattcgtttgtgtattctcttggtcctggcctctatcttccaatgggttctattaactcatcttgcagatgaggaaactgagatgataactgaaagaacatgtctgctctcctttgctcatcctaaggtacaggcgtacacatttacaattgtagaggaagaaatgatgacctcaatgtaataagtaatagaaaaagagtggagttcattcattccattttactgtgtggaaattaaagaaagattaatcacagccactggacaagcttctttagaagactgaataaagaattttaggaataagtaacaggccattttaataatttttaatcctactcacaaatagcctattaagataaaatatacttcaaagtcaagtgcagaactgaggttaagtgtcgttggagaacccagcatgttgtgttgttttcctgttgtgttttcgctgaatagagactaattcttctagattatgaagtttggtcctctcttcccaggaacctcctatttgattcttgctactaatgtagtcattatttcctggatgtctcctttcttttgtcctggtccctgattgcatttatttacttatctgtctttctgtcattctcacagccccaccagcagcagtaggtatggctcctcctgtaatgtgagtcaaggaagctctcagctaa

SEQ ID NO: 133020 - DNA, 1048 bp, Homo sapiens
attatatatacacgaaaccaaccaaccaaccaacttagagcttgtctcagtagaagggaagactccctttgtattgtgctccagcagttccacggctggcatgctgtgttccggcttccctctgagactaggagctcctgaaagtataggtctccatctgtgtctgtttatatcctatagcccagatgtgagagaggtggataggggaaaagaaagcagggaggagaagaacgagggaaggaaatggaggaggggagagagtaagatctatatttagcaaaagggagagacacttaccaagggtgtgtgagtgagcttgctggcaagggttgtgtgtgcgtgagtgtgctgggaagggggtgtgtgcgccaggaacgtgtgaggagggctggtgccctatgggaggttgcaggcaggaagcagctggagaggaggaggagcagcagcaggagcaggagctgccctgctttctgcctcagtctcaaagcccagaatcgattgagttagaattccacatccagttgaagtttggctgctgttgccttcagcaggctgatctcagaatcccccttgccagagaggtgtggaccaggttagatttctacgtttgcagccagtgagactcctgccaagcccttcactgaggggtttttttgcagggcattgtttctgtcatcaactttgtgccgtggagccagccagctgggtgcaactgagaatattagctccttgggtctgtttgtcggttgggcaagcagtggtgctttggctcagaaagttcgtcctgtggcttctctgtcaaaccaaggagtgctcctggatggatttcctcttaaagacagcatttgccttctaaaacttgagaattcatggttttaatttttttttttaatttccttaacccttattttggttgcagcagcaaggtaagtggtaccgagtgtgtatgactgactgaacaacaagcagggcaaaaggaaagcatttgtgggtggaatatggagcagctacattaattacgtaattgcttgagtcaacttgctggtga

SEQ ID NO: 133021 - DNA, 1049 bp, Homo sapiens
tgaaaacagtgaagcagagtgtactggatggcacctccaaatggtcagccaagatcaccattactggtgagcaggccacagtttgaggggacaggaaggcctgggctatggggaggagactggggaagaaacatcctgagcgtgagggagcaagggattagggagaaagaaaaaggaaatcactgggaaggaaaggcctctttattaatcacttctccttacctagaccctggtgccggagaggcaagattgctatctgcaaacaacatgaaccataatacaaggatttgctaacaacctaacgctgtagacttggctaacagtttgatattataagaggtggggggagggggaaggggaagggcaggggaccagggagtagctaaccagtggtttgctaactgggtggggctgaagcatgtatatatcagagggtgtaaagatcaatatagagataagtggtcagttagggcttgggtagggagatgggatgcttgggctttaagggaaaggctggtggcccaggacaaagaataaatatggaggaatgggattacggtatctgtgcaaggagcatagactgctctaagatggaaagcatatgagtagtgttgtggggggcttctgaacgactctgaagcctcctatacatgcttgggttgcagtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccatttgtaagtcacagagagctttgtcttacctgggactgtgtgtattgggggagcaggatcacatcctgccattctgggcttgagcttgaagattgggcaaaggcaggggagaaaactcatttctcgcatgcttcgttcagacatcagccattctttctctggttttcttctcatgagctgttgtgtcaggattactgtgcccatgccctgtcttcaccagggctattaaaggggccctagggcac

SEQ ID NO: 133022 - DNA, 1054 bp, Homo sapiens
tttggcagggaaggttttcatagtcctctgttcctttcttacatttgcttgatttgcaacagaataatttccctgctgggagtcctgaacggcttcaggacttaaaatccacagtggatttgctgaccagcattactttcttcagaatgaaggtaagaaatggactggggcttgggtggtgctgggctggagacctggctacaggaacgtgaagaatgagaatcattgggcagagtctgaggctacaggattcatcacctctaagcttacatttctgtgtacctgttccctgggttacttctgagagagcacatagactatggatccatgaggatggggtggaagttttccctgtcaactatcctggcaatttcatcacagggaaaagtctagggacccagacagggatgaaagaatctagagtaggtttggggtagtgctaggagaatatcccacccaggtgagcaggtccttgggcccatatttcttcttttaattggcaggtacaagaactgcaaagccctccaagagccagccaggtggtaaaggattgtgtgaaggcctgtttgaactccacatatgaatatatcttcaacaactgccacgacttatacagccgccagtaccagctggtaagaggttcaggatcaggtggggccagctgtcagtggctctttggagcctcagttttccttcatgatggtggtggaaaagcactcaggacaaagtacttgatgttctcaagggtgagtgagttgtggagtatgaaccatgtggaccatgtgagatatgtggatggaaagagacccctgggcaagatgagacatacctgaattgaacagaaatggcaacaataatgatgttgaagaaagtaaacctaaattcatgcacagttcaggggttgagtaggggaattctcagtccatcccagagtctttttttctccctcaagtttaactttattctgactcttgcagactcttgtaagttctgggcttccttcctctgagatctgaagtggtctctgagctgctggctcctggaagctttactt

SEQ ID NO: 133023 - DNA, 1036 bp, Homo sapiens
aggagttcatgaccagcctggccaacatggtgaaaccccaactctactaaaaatacaaacattagccaggtgtgctggcacatgtctgtaatcccagctactcaggagcctgaggcaggagaattgcttgaacccaggaggcagaggttgcagtgagcagagatagcaccactgcactccaccctgggtgacagagcgagactccatctcaaaaaaaataagaagtttatatagacgttaccagaaccaaagagagattagggggagataccagcaaactgggtagttgaaatcatgaggttggaagagctctccaggaggaaaggagggagttaggtggaagtcaggggcaggaggttatggattggcctttctgacagattaccccacctcaaacaactttactggagcatgactccatgggacttgttagaatagtttaaagtgtgaccggtgtttcagaacttgtcagttagtttttataccagagaagttaatacagaaattagggataggggccagagtgcagataataaattgacagagaaagtgaaaattatatgtagaaacagtaacttgaaggtccctaaaagaaagagttagggagttatggagtgatgggcagtcctgcttgaaaaggaaggaggagggccctcctgatgtttctaggttcttagactggttccagaacagcaggggatgggggtggaggagaggggctctcttttgatgtccctgagggtctctctgatgtccctgattttttcactctctttgttgctcattggtgtctgctctgtcacaagcaaccactgtcattcatatacgaaaagtcctctttctgggtggtaagaacatttagttgtccttttgcctctagtcttacaccttttccctcttctcctgctcactgcttcatagaagagactgcaaatgcaactttaggttgagacagtgctgcctgcagtgccagggaatgaaattcctgggacttgaagccctttgaggcagaatcccgggcttccatttcctcctt

SEQ ID NO: 133024 - DNA, 1049 bp, Homo sapiens
tagagagcaaaagaagagctgtgagtctcacttaagtggacaggtagaacttttacagagctgggtacatgttcaggcatacaccatcaaggaagatctgagttaatccagaaaggctttttagaagcattgagctttaagcttgataaaagatgaggagagcctggaatgagcacacatatgatgagagcagggttggcaactgcgggaagaatccatgtgtatgcgtgtgcattttctacccgttgctttatcatttaagggtctaggaaattaaagcctacagcctgtctcttgtcctgcttgtctcagatacctcctctctgtatttttctactgtttctgcccatgatttggttggtctctgacccatgaagtctaatttggagcattcacacactgactgcagctctttcacttctttctccactctgccccacctctgtgctccctcagaatatgtgtagagctgctttgaatggctgttaactccttagactgctaacggattcttctttctctgttctgctgctgctactacctctgacttgcctgtcctcattcagtgcatgatgggaaaggtattagatttactgctaatgaggacattcgtccggaaaagggtatgttgtacaccgtgcagatatggatctaacatgggctaacactgacccctgggagctagaatgagcaactcgtgctgggggtgggggaacaagctgtcaaggtttaggagctctatctcaagtcttagagatgggtaatgccttcatatagcccaggaaggggttctgttgttgatctctgtcgtattctcagcattctcccacccctccacctcaggacaaagaaggattttctctggggtgtaagattgtggtggtgttttctttttttctttttttttttttttttgagacggagtctcgctctgtcgcccaggctggagtccagtggagcgatctctgcccactgcaagctccgcctcccaggttcacaccattgttctgcctcagcctccctagtagctgggactacaggcgcctgcc

SEQ ID NO: 133025 - DNA, 1068 bp, Homo sapiens
aggcacaagaattgcttgagcctgggaggcagaggttgcagtgagccaagatcgtgccactgaactcctgcctgggtgacagagtgaggctccatctcaaaagaaatgtcactgatacagatatttcttctactgagttatgactccaaggtagaaagagataaagataaatggttgggtttgggatatatatagtcttcaactgaccatgcaccagtagcagccaaccatggttcgagagacatgtaaccaaaatatgtgctgcatacatacagtctccaaattcctatgtgaaatccttagccttaattaatttaatgagtttcatggaaccagaaatgaattatagatccttttttcctcctttagtttaggacctatgctagtttttttaatccactctagtcctgagtcaagatattttttctagccatgctttctagtttataatatgaaaacaatagttgtttttagaatatttaataatgtttatacttctaaaaaatatacactgaacattgagggctctgcacctctttccctttgagtactgttggtctctttgtccaatacttctacacatgtgcttctcaaacttgatggaaaaaaaaatcacccggatcacccctgaaattctgattcagtacatctggcatggggcccaagtatttatctgtgcttaataagttcacacatgaagctgattctgctgatctgcagaccacactttgagtagcatgactcttagatctaaactctgttctcagcctcttacttagtggttctcaaaatgtaaaggctttccccaaaccccaccccctaagaaaaagccctggtgcaccagacccaaaaattgaaagtcaaatagtgccactgtctaagagtgtgggatatatcaccatgggttttcttcctctagagattaggtttataaatctctcactccctcaagattaagggattgtgaagaagagttctaaggaaatacttttagctgtccagactttaacctcgaaaatccttaaactgaagttcctttttatggagaaagattaaaagtgtacattt

SEQ ID NO: 133026 - DNA, 1242 bp, Homo sapiens
cacacctgtaatcccagcactttgagaggctgggatgggaggatcacttgagcctaggagttgagaccagcctgggcaacatggtgaaaccctgtctctacaaaaaatttaaaaattagccaggcattgtggtgtgcacctgtagtcccagctactaaggaggctgggtgggaggatcacttgagcccaggagttcaaggtgcagtgagctatgatcgcatcactgcactgtagcctaagcaacaaagctagactctgtctgtaaaaaataattgtaaaaaaattcccatttctaataaccaccttggtagagggttcaaaaacataggataataggagacagtagtgccatgttgtgcaactatatggttaaggaatatgctggatagttatgggagtgtatttgttcccaggaagtgtctaggaatgtgaaccacaagagcagggaataatgagccttgagaccatgaatggggcagggagatgagggctgggaactggggcaggaggtgggattggcaagtgttatcatagcctggggacagtatgaaagggactgtaggttcatagaatagagaggccggtagacataacctgtgtaaatggaggctgaaatgtgggtctacccaggacaggtaggaagcagatgctctgggagcagagtaattgcaaggactttaggaagagggtgtggccccaatcattttctttggaaggccgttgtagtggaaataattacaaattgggcagacctgggattgaatcccatctcagatgtgtaaatgtggacaaactacttacacactctaagctttggttttctcatctttacaatgggaaggattatgcctacttaaaaatgttacagtacatttagagatgatatatataaattaatggcacataagtgtttaataaatgatcacttatagtattataataggacaagagacacccatttgggacaagggccaggaaaagggctctcatagaaagcttttcctgattttggagagcatgacctcataactttatactggctgagcccaccattccactctacctggtaggcatagctagagggctcatcttctgaaagagctgtcttctactttcttcttattctggatcctctgtttctcccccatcctcatcttccatgtctctccatttagtcagggcagaaaaagtctgaaatgagctcttccagctcactgttttctcttcaccttcattagaggg

SEQ ID NO: 133027 - DNA, 1058 bp, Homo sapiens
agtttttggttcttatggagtccaatttatgttttttcttttgtcacttgtgcctttggtgtcatatctaagaaaccatcacctaatccaagataacaaagatttactcctatgttttcttctgtaacccttaatcttgtagctcagactctcttaatatctgcccttctacatctctacccattagcccattaaacacacaaaggcttggaagttcaacagaggagcctgccttcctctcagaaaggggaggaggaagcaagattgtaaataattgctgcttaaatttaacacaattatattttaataccttgtcccttatacgtatacttattagccatattttttatgcattgtttgttcatgtccttgagcatatgtgacttgcctcagactttaccacattccacatgacgagctatgaccctatggtctacatgagttaaattttaagaaattgattgtgtcaaggattcagttaaatgatgaataagagaaaggcaatgagggatttagactcagggtgagtgaaaaggaaatgataggaataaaaagagaaaggaaatgaatgaattttggaacattacatgtgaggagtcgaagggaatgaagactgttgcgacctgaacgtggaaacacaggagactagaacttgagcaggccacactgccacggtgcagccaagagaccagagaagctcaggatgggttctgtgtccttggcaccaggagaccttgaacaagagagaactttgctttagcctataagaggtaaaactgggaagagaagactttctagtggatcccagtagtgaaggttctaagctaaaactgggcagcatttgggcacttcaggatgtctgtatcctgagctagacgcatgttaagaatgtattatgcctttcacgtttatcttgtgtgatgtgttagaatgatacaaaagacataaaactaggtccccccacccccattgaggaggaagaggttgacatcagtcatacttgcagtcaccctaatgcccaactcagtgtctgcattcaagaagttctagtatagtag

SEQ ID NO: 133028 - DNA, 1312 bp, Homo sapiens
aatgcagaaagcatggttacgtccccacctgcctattgggctgtgtggtcaagctccatcttgactcaagccttttctcttcctgggctcttctccatctgaaaatgatgtagggaagggcatgcccctgacttccagggaggtgacattaggttccctttctttccctctctctccaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaaggg

SEQ ID NO: 133029 - DNA, 1101 bp, Homo sapiens
agcctgggcagacagagtgagattctgtctcaaaaaaaaaaaataaataaatacactgaggagataaaatcagcaggacttagaggctgacatattgggaaatgaaggattcagaagactgattctgaacctggatgatgggaaagatgaggccatggataggggctgtaatcacaggagatttcctggaagaaaagttcaggttcagacctttaggagtttgcagtgcctaaggggcaaccaagggatatgtctaacaacaacaacacacacacactgggcgtcagtgaagtttttttttttttctttttgagacggagtcttgctctttcgcccaggctggagtgcagtggcctccctaggccagctctttccctatttattttgttacattttaaataaatattttataccagtgtgttaaggtggtgctagtgacagagagatgagagggatgactctgttttcaaggattccagctaaggacagaaacagaaaacgtagttgatcattaaaatgcagagatggcagtgttccgtactggccagtgaaaggggtatgtaaatcagactgaaacgtcagggaggaactgctaatgcagttacatttaagcccaatctagaaagatgattaggattgggctttgtgacgacttgtaagaagaatgttctaggctcacaggattgtctgtacaaaaccacaaaggcacagaatagcttgaccctttctaggaactgcatataatttggtgaagccatagtggaacacaggtggaaccactgaaaaattttagagaaatggcttttggcatttgtttgtttttgtttggtttggtttttctgtctgcttaattatatgttttgatttgcatttagaaagatcactggttggttgttccttcaggccttgtttaaaaaaaaagtaattgggctgggcacagtggcttacacctgtaatcccagcactttgggaggccaaggcgggcggatcacctcaggtcaggttttcaagaccagcctggccaacatggtaaaaccccatctctactaataatacaaaaattagctaggcatggtggcgcatgcctgtaatcccagctac

SEQ ID NO: 133030 - DNA, 1160 bp, Homo sapiens
gggagggggaccacacaagcgttcatcctcagagcctcaggcttccacccaaggccttccccagcctctgcttgagttaaaaccttgggccaggcatggtggctcatgcctgtaatcccagcactttgggaggccgaggcacgtgggtcacctgaggtcaagagtttgagactagcctgggcaacatggtgaaaccccgtctctactaaaaattcaaaaattagccggctgtggtggcgcatgcctgtagtcccagctactcgggaggctgaggcacgagaattgcttgaacctgagaggcagaggttgcagtgagccgagatcatgccactgcactccagcttgggcaacagagtgagactcagtctcaaaaaacaaaacaaaaaaccttggagccagcaggatactctagcaatctgggagttagggtggccaggaatccctgcatctcactcctctaaactcagggccaccgcctggggttggagagtttaggcactgcacagctgtgggcagcagcgtttatacttagtacatgcaagttgactagtgcacagcctgcaccgctgtctgcagcagctctgcccagactgtctttcaaagtcccacttgggccaggctctggttctctgtgtggatcagtccctctctcttttcccctagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagc

SEQ ID NO: 133031 - DNA, 1074 bp, Homo sapiens
cagctgctgtccctaggctcccctcggactggctgagcctggacaagtccatgttccaactagtggcgcagacagtgggttcccgccgggagccagagcccaaggagagcctgcaggagccacactccccagccctgccctccagtcctccgtggtaagcctggggaaacggaagggctgaggggggcggggggcttttgagggggtttctctgacctccatgtgctgtttccccagtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaaccattttctctttgtgttcccccaccctcccaccctcccacccacctctctcccttccaaaaggatggctgggataggatgaaaagggaagggaacttgatgtccagtggcctaagccaaga

SEQ ID NO: 133032 - DNA, 1012 bp, Homo sapiens
tatgaatggggggacattggaacagctgctcagctcccctgaacccctgtcctggccggtcaggctccacctggccctggacattgcccgaggcctgcggtacctgcactccaaaggtgtatttcaccgcgacctcacatccaaggtaggctagcagggtgggtggagacatgaaagagggtttgaggctattaggttgtaactggcctgtggatgttggaatatggataacagatatattaggatgttggagtggcaaggcattggagaatattgggggaccagggtgaggggagtgctcggagggactgagtagcaccctgtgtttggagtgttggatgatgttgcaatattgaagtgccttgaaaaactgggagagcagagagggttggagttatgctggagtgacagggctttgggttatacattgggaggccagacagcagaaggtgatgagtgcgtggggatactatgtgtgtgtgtgtcagaactgtctagtccgacgggaagatcgaggcttcaccgctgtcgtgggtgacttcgggctggccgaaaagattcctgtgtataggtgagatgaatgtccctgttccccccaaatctcccagagtgcccctatctgatgtccccagagccccagggatgtttcccttggggaacggagggagttcacctcatccccttttgcctgggggggatgcctgaataggatgcttctgaccactctgcccctgcccctgcagggagggggcaaggaaggagccattggccgtggtgggctccccatactggatggctccagaggtgttacggggtgagctgtatgatgagaaggtgagacatcaacccttcagatccccaaggccttccgagacccttgaggtattctcataaagccccatccatccccaaaacaaccctaccagatcttcaggagtccccaagatccctttgcccctcacaggcacccttctaacacatgaaaactgtcaagatcccccaccctcaacca

SEQ ID NO: 133033 - DNA, 1007 bp, Homo sapiens
agagagagagagagagagagagagagagagagattgccaggtgaggaaggtgatgagctgaaaccaacttggagctatgctgtattatgatgatgaggatttgggttggggggtgttacaggctctaaccagaaatctggaagatgtgataggtggggcctttaaaaaaaaaaaaaaccctaaacatctctttgtaatccatccctcctctgcatccctaccgctactgccgccatcccctctcactcaaatcttgcaatagcctttgaaaggcgccgcctgactccagactgctgaccactagatcagcacagcagccagtggagttagagcctttaactcactgtgttcatccctcgcttaaaactttcagtgactccctttcacctcccctgcaggataaagcccaagctccttggcatgacttatgggcgcagtgtgatctggctctgtctgcccctccagcctcatcttaccattgcccccatctcactctaccctccgctgtgcctaatgcacttctgccaggtcctctgaataagcctctcctttgcctgtggttccctttgccttggagcattttctgtccttcgcttctcctggcagattcctactatgtgtcatgtctctacctagaagtcacttcacctatgagctcccatagaggatcctgtatttctcttattttaataatgcctagcattattgagcatttattgtctaagtgctttacaaatggtaactcattcagcctcacaaccacctttttttgaagtaaacaccgttaatatcctctcaatcttacagattcagaaaccgaggcacagttgcccaagaacacacagctggtaagtggtagacatggaatttgaatgcaggcagtccggctcctgagcccagagtcctaatctctgtgccaactggctgatgtagcatgctatatggggtaggaggctggggttaagaatcagcaggtgatgggtggacaggcaggacaaattagatgg

SEQ ID NO: 133034 - DNA, 1280 bp, Homo sapiens
tgcgcagtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccggccgccccaacgcgcacgcgcacgcgagcaggccggccggctccggggaggccacgcccactccccgtagggcggggccagaccatatttgcataagatagtgtcattctagctttcctgtatttgttcatttcgtgtctattagctattctgctagccacaatgcctctgaaagcctatagtcttagaaagttatgcccgaaaacggtttttttaatctcacgccaccaactttctcaccctaatcataaaacacaatttctttagggctataaaatactactctgtgaagctgaggacgtggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgttttttgttcccgagaccacggctcactgcagcctcgacctccccgggctcacgcgatgcctcacctcaggctcccaagtagttgggaccgcaggcgcacgccatcatgcctggctaatttttgtattttttgtagagacggattttcacctgttgcccaggctggtctcgaacgcctggtgtcaagcgatcagtccacctcgccctcccaaagtgctgggattacaggcgtgacaccgcgcccggtcaacgcggctgcttttcatgcgcgggcagctttacgctgttcttggccttgctatgaagtccttgtgctcattactccaaatatggagcattcctgaaacagcctcctcttctacctccctctccctttggcaaacgccatagtagccaccattcactgtgtagctggtacacaacatatggactctgcttgggctagaatcctgcctcctgtactcaagagcggtgaccttgtgaaacttagttctctctccgtgcct

SEQ ID NO: 133035 - DNA, 1058 bp, Homo sapiens
aggtacggggcggccgggggtaggggtgcccctgcaggtgcgggaccgccgggcgtggggatcccctgagcccgaatctcccatgggggtgccagggtaccaagaacaagacacagcttccctgtctgtaaaataaagacagtagtccgttggccttccaatattatgaggttattttgaggatccagggaggtaacggatgtgaagagcgtgtggtgaactgtaaataatgactatcacatttagttctcctacaatccagtgaggagtagtcacttgctcgaggtcacccagcgctggcaactgctggagctgggatttgaacccagctagcagtgtccatgctacaagagtggggccagccttggcacaggaggttgattgctgcagccagtgtttctagagttccagatatgaagtggtctcatgttctccttgggaggaggccctgaaatgtaagttgacagtacattttgaaaaacagtaccttccagggctgtgtctttagccgtgaccctattacgtacttgcattataaaatagaaccgatggaaccagtttagatatatgaaactagaagagatagctaataatgaccccaggtagatgtgacaggctaggatgaatgactgaatttaatgatgaactttgagaaggatagactagtaaattctgttcttggacctgagtacagtctgggagaaacataatgtagcaggaggtcttatgaaagagagttaggcattccagttgactgagttcactgtgggatgtgacaagccacttcccaaatcagtgctgggaacatggcactgtgcttcacctgccaatcagaatgcccctggagaattgtattctcctcagggcattgctttaagagcactacgtgttcaggaaacaaccagagaaaaccaccgtcaatgagcactgactgtaaagactgacgttaataaaccagaaaaaactcaggaaagtgggtgagggtgtgaccattgccttcaaattcctgaggggctgtcaccttgaggagacattattttggaaggctccagtaagca

SEQ ID NO: 133036 - DNA, 1405 bp, Homo sapiens
aggtgatccacccaccttggcttcccgaagtgctgggattacaggtgtgagccacagcactcagccaccagagcttttttcaaaccggagggagttgctcattcctggaggtgtttcagcaaactgaccatgtgtgggacataggacgtcgcttcatatgctgggtgaggagctagatagactaggattgtgattctctgaggtaaaaacccaatcactgtctccatctcaaattgcactctctcttggctggctctggagactgaggtgatggagcagaaccttgttgcttcagtactgccctttccttcttccacaacaggggaaagatgaaactgcggttctccacgaggaggcaagcaagcagcagccactgcagtcaggtgggtttagcagaagtctgtgctgggtcgggggagtttaggggacagcagaagatacataaccacttctgcccccttttttcccttatccccagagcaacagctggcccagttgacacaacagctggcccagacagagcagcacctgaacaacctgatggcccagctggaccccctttttgagcggtgaggagagcaatgattctgtgaatttttggggaatttgtggcaggagggaggaatggggacataggttgggagccactgagtggacatttcttcagtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgatggagtgctcctgtgtgttttttcgatcctagttggttgtacacacccatactaggtgcctaaggacaactgggccttcttgaagagctgtccttattaggacaaaaagaggctgccttccagtgtgacagcagagaagatagagggagctccagctcttttcctcgtattcctgaggccaccagcatgcccgcgttcagggcccaaaaatcccttttctcatagcaaaactgagacagaagggtctttcccaaaaaaaagaaaaaaaactttactcaaatccagtggaaaaataa

SEQ ID NO: 133037 - DNA, 1590 bp, Homo sapiens
gagcctgtctctgctggtcctgaccctacgctcaccctctccctgcctttcagaggaatgaaggtcatcgaaaaccgggccatgaaggatgaggagaagatggaactgcaggagatgcagctgaaggaggccaagcacatcgctgaggattcagaccgcaaatatgaagaggtgacagccttgcccctctgcctgctcgctgcccagcctgcaacatgcccagtccttctccactgatctaccctctctttctcactccccacaggtggccaggaagctggtgatcctggaaggagagctggagcgctcggaggagagggctgaggtggccgagaggtaaagatacccgggggtgacaagtgagcccattggccctggggccttccacacagtgggaaggtagcatcctaggcttggggctgtagggacaggccctgttctctgacccctgcccgctgcccccagccgagccagacagctggaggaggaacttcgaaccatggaccaggccctcaagtccctgatggcctcagaggaggaggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaatgtggggacctagaggaggagctgaaaattgttaccaacaacttgaaatccctggaggcccaggcggacaaggtagaggggagcagaggggcagtgaggatggggtcccacaggggagggaggtgaggggcccaaggcagggaggggctgggtgttcaacggaggcaagatgaccaggagcctacggggtacaatggagaaatgaaggatctgtggtagcgctgtactgatggcgtgtgtgtgtccccaaaagtattccaccaaagaagataaatatgaagaggagatcaaactgttggaggagaagctgaaggaggtgagagtcctcttccagttcccagtctcccctcaagccaccctaatccttgccagagacggcctgtggcaggacacttgagggttgggatggacaagaagcttgacttaggcagtagtctgtgggagggcctaattctttgccatttctcccatcctgcctttacccccaggctgagacccgagcagagtttgccgagaggtctgtggcaaagttggagaaaaccatcgatgacctagaaggtaaaagaagcctttataagtaggtccacacctgccgtgattatcagtctgtcctgtaccttctcatcccattttatttgccaccaataaactagggttgggccacctaggaccctaccaactccccaactctgtgggccatgtctacaattcaagtaattgtagctgcccacggcgcaacaactccagtgcttctcaaacttcagcatgcatgagaatcactgggagagt

SEQ ID NO: 133038 - DNA, 1035 bp, Homo sapiens
cgggcaggggtcagagaacagggcctgtccctacagccccaagcctaggatgctaccttcccactgtgtggaaggccccagggccaatgggctcacttgtcacccccgggtatctttacctctcggccacctcagccctctcctccgagcgctccagctctccttccaggatcaccagcttcctggccacctgtggggagtgagaaagagagggtagatcagtggagaaggactgggcatgttgcaggctgggcagcgagcaggcagaggggcaaggctgtcacctcttcatatttgcggtctgaatcctcagcgatgtgcttggcctccttcagctgcatctcctgcagttccatcttctcctcatccttcatggcccggttttcgatgaccttcattcctctgaaaggcagggagagggtgagcgtagggtcaggaccagcagagacaggctcccttctccctcccggaccatcctccccgaggcccctgaccacctctcgctctcatcagccgccttctcggcctcctccagcttctgcagggctgtagccaggcgctcctgggcccggtccagctcctcctcaaccagctgaatgcggcggttcagggaggccacatctgcctcagcctgtgggtcagaggtcaggggtcaaaaaggccttgttagccttggataaggatcagagaggctccagaggatggcgagattcttctcagaaagaactgaggcttcctggtttctagacattctatgtgatttttccccaaccaatcatcttctgcccagactgtgctccagtaaaaaatgtgcattcaggccgggcatggtggctcacgcctgtaatccccgcactctgggaggccgaggcgggtggatcacctgaggtgaggagtttgagagcagcctggccaacatggtgaaactctgtctctattaaaaataaaaaattagccaggcatggtggcgcatgcctgtaatcccagctacttgggaggctgaggcacaagaatcacttgaacccaggaggcgga

SEQ ID NO: 133039 - DNA, 1056 bp, Homo sapiens
tgcctgcgctggtcccaactaccctatgcccctgctgtgcatcctcactgaactaagtccccgatctccaccctcagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccggccagtccccacagcctcatcagctctcttcaccgttttttgatactatcttcccccacccccagctacccataggggctgcagagttataagccccaaacaggtcatgctccaataaaaatgattctacctacaacctctgcctggcttcaagggagatacaagttttctcccagggcagtaggagagacagtggggttgaattctgtcacccagcttgatccagcttgaaatgggagaggggaagactggcagtctgcacctgaggtcccttcctccttgcacccggaccctaaagttatccaatggggaagttgtgcctgagaagtcatactcctgttatcctcacctccctggccagcacctaagcctcacaaagtgtcgttctgctgctgctgggacagcagctaccacagttccttgtggctaccaggacattctgttcttcatagctactcagggtatgtcaacaaatccagtccttgaccaaattcaaattttcaaaagaagctttgctaaaaataatatgcctgta

SEQ ID NO: 133040 - DNA, 1239 bp, Homo sapiens
ggctctgaaccgctgtgtcagctgcctacctggccagcgcgatgtggataatgccctgagggcagttggagatgccagcaagcgactcctgagtgactcggtaggaggacggtagggggtgggggaacgtaggagtcaaagaatgccaggcctctccttcctccctctcggttgtcctttgaccctgacttcccagatctgtcccctttcattactcccaggctatgtgcccaccttttcagccctcctttaccagacttctccctgcatcattccccactcttctgtctgacttcccctctcaccttgcagcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccggtatgaagaggcagagggtctggttgaatggttcccactaagggttagataggaggcagttgagtgaccagtcctgacttgctcctggctcccttccctccccagtctctagcactacttgagtgtctgggaaagaagatcccttttagagacagataagaaaggacaggacaatgcattgaccttgtcaccttcaacagagccaggaggaccgagcccaagttgtgtccaacttgaagggcatctccatgtcttcaagcaaacttcttctggctgccaaggccctgtccacggaccctgctgcccctaacctcaagagtcagctggctgcagctgccaggtaagtagttgctgagaagcccagccctggactgtgtgagagagactggggagcaggcagttcatgagagcttcttggcttaggaatggttataggcaaaagataaatacttacataggacccaggaatgatgacctattcaccttttcactcaactttctgtcactcccagggcagtaactgacagcatcaatcagctcatcactatgtgcacccagcaggcacccggccagaaggagtgtgataacgccctgcgggaattggaggtagacacatggcaggctgatggcattgaggttgagggaagtgttctggttttgggcctgagggaggtgtcttggatctcactttgccctccccctacacagacggtccgggaactcctggag

SEQ ID NO: 133041 - DNA, 1075 bp, Homo sapiens
tccattccagtccctgtttctccccacttgtctttagacttcagcccagcaggcactcactggaaccattaactccagcatgcaggccgtgcaggctgcccaggccaccctggatgactttgacactctgccgcctcttggccaggatgctgtaagtatgggatggaggagaggccggtggtactgaagctgagactccaagggatagggatgaggtgaaccaaaccagggcagatcctgaaggcttttcctctctctttcaggcctctaaggcctggcgtaaaaacaagatggatgaatcaaagcatgagatccactctcaggtagatgccatcacagctggtactgcgtctgtggtgaacctgacagcaggtaggccggatgctagcttccgggtgtgtgatggggagagggggtgcaagtgtgcacaggcatgcatgtgactggcttcatgtgtgactgtgccttgactcactgtggaagggactgtgtgtgtgcgtctttctgtggacatgtgtgtgactaactgggtgtgactttgctccctccccagcccttcgtctggcctgccctgtctctcatgttcctctttctccttttccccttaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgaggtcaggggccacaggtttgggttagggtggagacagggttcaagcccaaggagaaggggcagtccaagccacaggatggaagcctgggtcccgtgggcctgtgatatgcacaggcatgtgggcagggattgggcagcttctgactggtgttcactctccacagccccgtcagaacctgctgcaagcagctgggaacgtgggccaggccagtggggagctgttgcaacaaattggggaaagtgatactgacccccactt

SEQ ID NO: 133042 - DNA, 1052 bp, Homo sapiens
ccttaattccttagctgtgatatgaaactctttgctaaattcttccccattttatgcacaggcacacaagaattgtgggcagatgagtgagattgaggccaaggtccgctacgtgaagctagcccgttctctcaagacttacggtgtctccttcttcctggtgaaggtaggttatgggcccttttcactgccctccttgtttcccactcttgcccttttctgtctctgaaagtctctggccttgccctcagtcacatctcccaccattccctaagattcccattctcttccttgctctgacctcatgaaaacctgcctgtcatcagccctacaccaccacttccctccctaccctgcattttcccttgtccgttagccctcccggccacctcaacatcccctatggctgcaagctgatctgatcattcacctctcatttgacctctgacctgtaacaccaacaccaacctctgcctcataggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggtaagtctggggactataacaagaaagtgctttgggagtttcattaaaggggcagctgcagaggtctcttccctctcttggggtaagtatactgagtattactccagaaaaaaaggaggttagagtagatggagaatcttcctctgggagagtgtgaggcttaaatgaaacggatgatggacttattctttaaaatcagcagaacaaaaatctcatcagcaagctgagatcacaggaattcttgtaggtgtggtgaaaggaaaaatgtgataacctccctgtttcagcagcagctatatacagtgaatttttgactttatattatagggttatgaattgaaaactgatatcaacttgataaagtaccctaatgacacaaatacaaattataggaaatgctgttttttcccttttg

SEQ ID NO: 133043 - DNA, 2005 bp, Homo sapiens
tctcccaccagaagagtgtattctaatgccctgatgccatgggtcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcgtgagtctgactcccccggtggctggagtgggagtcttcagtcccttcttgttcccaggctctcggccttgagagttgacccctttgtcccctaagactactcacccctcaggtctgtgttccatggttccctcgttctttaggcccaaggtcatgggagaaatagtcaggggcaacatggtacaagctgttcagccacattggggtcttcataagcctaaagtgatccatcctctcttttagccagcgactttgggctctttctgtcagatgatgaccccaaaaagggtatatggctggaggctgggaaagctttggactactacatgctccgaaatggggtaagtatcctttcatcaaggaccaccacatccccttccatcagcttctccctgttccacctcctgttttcagcacccacatctgttgtctcttagccctccccatgctttcttcctattaacagacagtcataattccctgcttttgaacgaaccaccatagtcttcctttcagtgctccactctctcccctcgggctgtgtaaagaggaaataatacccctagctcagagtaggcccctgtctcttcttcctgccctaacaggacactatggagtacaggaagaaacagagacccctgaagatccgtatgctggatggaactgtgaagacgatcatggtggatgactctaagactgtcactgacatgctcatgaccatctgtgcccgcattggtaaggggccctagtacagttgaaagcctgggccagaaagcctcaactctctcaaaaggcatggatgcagtacctgggaagctaacaagccatctccttcctcaggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagtgtaagcagaactagaaaaaagagggcttttgaaatgggaagggtgggaaggggcttcagcatctgcttctgccaggcactgttttacaccctggggatacatcagtgagaaaacaaagtcctacactcatgggacttacatttaagtgaggggaggtaggaaatgcagaaataaacagagaccagacagcacaggggccatgggggtttggcactgaggggactgtctgtatcccagtgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggtatgcagaggacttggctggggtggggcaggaatagggagggctcggaagcacagtgtgcgtgtccttgcacccacacacaacattcgcctccttgccctgtgctctccaggcacgagatgacatcctgaatggctcccaccctgtctcctttgacaaggcctgtgagtttgctggcttccaatgccagatccagtttgggccccacaatgagcagaagcacaaggctggcttccttgagtgagtgacccacatcctataccctgtcagggcccaggactccctgccattgtgaccccagtgggcctgtctccattccaagcctgccccccactatttcttcttccgaggtaccagggtttgaccaacatagctacccttttagttgccatcatccattgtctcttctctgcctctggaat

SEQ ID NO: 133044 - DNA, 1048 bp, Homo sapiens
taagaggcttaaggatagctctcagacagggcaaggggagaggtctgggttggcctctgaagattctttgtctcctcagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgcctaggtcaccctcaacccccatttactggcacaattgggtggagagaagggaaggggtatgattgtcctgatggctcagggttgcaggaggttcagaggggaaggaggaaaggccaggctggaggctgggctgttagcacttccctcccacagttcagacggctcactctgggctcaggtttgccatggcttcctttggtccaaacataggccctgtccttagtcctgtgccctgtttgacttttggccaggaggcctttttgtgctgctgctgttgcagggctagctgcatggcccatatgctcagtggccgcatgtaggccagtgagcggaacactcgctgctggcagtatgc

SEQ ID NO: 133045 - DNA, 1052 bp, Homo sapiens
taataagtaggccttgtttccatgttagggatccctatccctggggctgaaggggctcctgtcctgaattctcttgtgtttctctcaggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggtgaggggaccaagaaagtgtaaggatccagagtgctggggctctgacctggggcttgtgttcatccttccccttcccaccccaggcggtatacaaggttctttggccaggatggagatgcagcacctgccctcagccactatgcactgtgccgatacgcagagtgggaagagaggatctcagcttggcagagcccggtattggatgacaggtgccagtggggcccatttcttgcctttctcctgggcactcactccaaatgggactcctcgatttactctccacccaccaaagtcagtagacttgcactgggattcatttgatgatcccactctgctgaacccccaaatcctttccatcttgggaggtacatgttccttaaaccatttcctcctcctcgcttcccagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggtacaggatgctggtgggctgggatatggcaggccatccccaagtcaggatgatggatttgcctaccccagggtattggttaggatgagggggtgttgggtgtggactagtaacaatgccccacctctaaatctagaggacaagctacagaggggtttgaaggggaagcaggaattctggcaacagtgtgtctcattcattcctccaggccaggagtaccgcatgtaca

SEQ ID NO: 133046 - DNA, 1134 bp, Homo sapiens
tgctacctccccatccatctatctcccaagctttctctcccttctccactacggtggtgttagcacctcacttaagcccaatctcctgctttttctgtggcccttttcatctgggtagcagagtgatctttctcacaggcaaatcaagatatgtcagtccttggttaggatgtttcagtgactccccatggccctcaggctaaagtctcaactcttgcctggctttcaaggcccttcttgagctggcctctccctgcccatcagactcatcacctgttcaagcacctatagtctgttcatataaaaacactcactgttccttgagcacactacattctctcctccatgcctgtgctcatgcttgttcgctatctggtgaaacctctcatccttcaaagcctaggtcaaaagccatctcttcctcctctacttcttccagcagtgagtcattatgtgtgcccccctccccttctattctagcatttggtgtattatgttataatgtattgactgaccattctgtgtccctgactgctgtatggattcttctgagggtagggacattttttaattcactgatgcacccttcttcagagttggcatgtatgtggagggaatgagcgaaatctgcagcaccgtccctttttccacagtatactatccacccctctccttttagcactgatgtggtctcacagtctccatttcccctaagtcttattttctcaaaaaaagttttagctcttggagggtaggagctatgagggattaatatccctttccctggttcaaactatgtcaaatatttttattgtatacagtgggctctccatatctgtgagttccacatcagtggattcaaccaaccaaatctaaaatatgtggaaaaaaagttgtgtctgtaccgaatatgtacacactttatttactgtacggcacaacaagggtttatgtaacaatgtatgaggtattataagtaatctacagatgatttaaagtatataggaggatgtgcaatggttatttgcaaatactataagccatttcaaatcaaagacttgagcatcctcggatagcaggtcctgggcccaaccccccatggatactgagggacaactgtataaaataattttt

SEQ ID NO: 133047 - DNA, 1047 bp, Homo sapiens
tacctttagccatctcatgttagaatctaaaaccctaacctctactctcatctccgttccctctcagcattacctctccactcattctttctctaggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccgtgagaattctttcagaattgtcctaccccatccttcccctcattgttttcccatctcagagacagtctcctaaccaccacacacttctgtggatccactgatacctgacacctccaattttaaagaaaagccccatcttttggcctgtggtgcccagtcctagacgttatccagtatgtagactccaggcttatagtgtcctattctccccagatctatacaatatcagtgatggccgagggaaagttgggacgtttggcatcttcaaatctgtgtacagacttggcgaggacgtggtggggaccttaaacttaggggaaggaaccgtagcttgtttgcaggtaagaagggagcagagcttcttacctgctggggtgctggggttgaagggctagggtggaaggcctgtataaagaggggtggcatgtagaaggggatagtggggtcatccagggtccctttgtaaaacagcttgaggttgggctgtcctctcacctacagacagcacttcctgttagcacacacctgtctcttgctcccagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattggtgagaccctcactgttactggagaagggagagggggacagtaaaatgctgtgctaagggagggtgtaatg

SEQ ID NO: 133048 - DNA, 1023 bp, Homo sapiens
agtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatca

SEQ ID NO: 133049 - DNA, 1006 bp, Homo sapiens
gggttcagtcggggcagaaccaaaactactagatgagggatttgttttctctgctggcactgcatcctggctgggtggtaggctggggagaaaagcagcgaaacagctggggtctggggaggaggctggtgggagcaggcctgtgggcccagctttttgcttccttacagcctgcagcccactactcgggagctgagaagcagatttggtggacgggacggcctattccctgggtgaagggggctcctccctcggacaatcccccctgtgcctttgacttggacgacccatcctgtgataaaagtgggtgtgtgcagggactgggagcagctttcctccctttgctttccattcatggcctccaccctcactgaccctccactcttaactgtgcttctgcctttacgtctgcatccctccctcctcatttcttcctactcccaaggagtctgtctatgcacctatgcaccccgttctccattctgccaagtccgcacacagtcttcctcagggtctctatttccccttcagctccactttcaaccctggcaattgtggctctgggcacaggaatcaccttcatcatgtttggtgtttccagcttcctaattttccggtgagttctgggtttcttgctgacctactccctgcccccattgccacacaacctctggctgaagccaggtggtccctataatgtgggatagggtagtaggtttcttaatttgctggttgtctcttagatccaacagcgtcttcctctctagcctttctctttagttgtcgcttagcctaggtgtttgttccacttttggtcctagactggatatactaactagtgtttttcagtggggttaagatcaaaggtgaattttccattggtcttcttttaggaaagaactttcacccccagtctctgtgtttgttagtgagcatagggcatgtgccagatatgccgagaatgcagccttatcttccagccctgtctctcaggtgtaacagttgc

SEQ ID NO: 133050 - DNA, 1346 bp, Homo sapiens
cagtcgcctcacactgtcgctggtgagcccttgtctcagctgttcctctgcctccctctgagttcctgtcccttcttaccctggatctctcccagcacattggcttgtaatgatagcccctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccgactctctgtgcccagctgagctcctgggtgcttccactgctctctagcatttccttgtacccagaacttctgatattcactttcctttcccctttcactcccaccatcagggaaatgttgtcgccatcaaacatgtgaataagaagcgcattgagctgacccggcaggttctgtttgaactcaaacatgtatgtaacagaggatggactctaacatgtatgtaatggaggagtggggaaaactatgaaatagtaaaattggctagatgggcaaggggttgatttataaatgattttaaaatcgtagatacaactaagagaaaggtcctcttatgtagtggtaagtttctgtatctaatttttaactctttcaattttcttatccttcccattgtttttttctgccagatgagagatgttcagttcaaccatctcactcgcttcattggcgcctgcatagaccctcccaacatttgcattgtcactgaatactgtcctcgtgggagtttacaggtgagggataggtgtaggagattatggcaggggtgggaaggatagacccaaagttatactgactctatgctgggtgatagctggtgggaccaggacagacagtctattccatgtcacttaccaggatattctagaaaatgacagcatcaacttggactggatgtttcgttattcactcattaatgaccttgttaaggtgagtcttccccactccttaaaagttcatccactttaaatcacttccactgttctttgattgtggtttttctccttctagtcctctgaagtcctgttctctcatctccccttattcccatggtctggtaataatgggtaaacaaggagtctggggcttataactgggacagtgagttttacctgccacaaggagtcctgtgcctgtagagagtttctatctttctgtcttaaatatctcaggtctctttccatcatctcttttacctctaagaactcataaaa

SEQ ID NO: 133051 - DNA, 1047 bp, Homo sapiens
cagccatgccctctatgccagtgaggcccacccccacaacccactttttatattgctcctctttccacctagggatggtgggagagggaggtggagtgacagtaatatagggatgagcccaggtgggcttgggggtgccccatttcgggggacctggccagccggtttcctcttttcagagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaaggtaagagtcaatccactacccacagcctcttcttcctgggggaactctgttcttcatccaaacctttgatcaccctcagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaagtgagagggcattatggggcaggggcttcccagggatagaagactcattagtcctagtgcatgaagtggggcaggtgggaccagagggtgggttggataggaagtcctgggaatcttcagaatcttagagcaagtgccttatcctggcctccctctagggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccagtgagactttgtcccccttcctgtattttcttttgggattctgctctgttgggctctgcctcatcaggcacctgagaactcgcctccccaccctcagaaccctgctggccacagggagcacccctgcttatagattatttgctgtcattctgtctccac

SEQ ID NO: 133052 - DNA, 1066 bp, Homo sapiens
ggtgaggtcgaactggtggctccggagaacgagctggtgctgattcccgccctgcgcaggccggggcgccgaggtcgggacagggtcagtgcagcggctgccgccttctttccactgcctgcagcccagctggcccgatgccccctgcaggaaatgagctttctcttcttggagccagtgctctgccctcctcaggcttctggcctcctaatgagcactagtgttaacctctcttctgcacttgccagaagcggctcggaggtcagagaattcattccgtcccgttctcccccaacgtgatgcaatgacatcagccttctctgaatcccttacccgaagttccctggggctaggggagcagaggtcacttagctgaactcttacctccactcattcaagggacaagagttaaaattcacagagtcacatgtgacacccagatgaggggtcaactagtgtcaaacagggcgattgcattaaaacttaaataaaacaggcgacaaggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggat

SEQ ID NO: 133053 - DNA, 1050 bp, Homo sapiens
agaagaataaccccaggaagtaccttcgcagtgtaggagatggagagactgtggagtttgatgttgttgaaggagaaaagggtgcggaggcagcaaatgttacagggcctggtggtgttccagttcaaggcagtacatatgcagcagaccgtaaccattatagacgctatccacgtcgtagggtcctccacgcaattaccagcaaaattaccagaatagtgagagtggggaaaagaacgagggatcggagagtgctcccgcaggccaagcccaacaacgccggccctaccgcaggcgaaggttcccaccttactacatgcggagaccctatgggcgtcgaccacagtattccaaccctcctgtgcagggtgaagtgatggagggtgctgacaaccagggtgcaggagaacaaggtagaccagtgaggcagaatacgtatcggggatatagaccacgattccgcaggggccctccacgccaaagacagcctagagaggacggcaatgatgaagataaagaaaatcaaggagatgagacccaaggtcagcagccacctcaacgtcggtaccgccgcaacttcaattgccgacgcagacacccagaaaaccctaaaccacaagatggcaaagagacaaaagcagccgatccaccagctgagaattcgtccactcctgaggctgagcggggcaggactgagtaaatgccagcttaccatctctaccatcatccggtttagtcatccaacaggaagaaatatgaaattccagctataagaaatgaacaaaagattggagctgaagaccttaagtgcttgctttttgcccgttgaccagataaatagaactatctgcattatctatgcagcatgggatttttattatttttacctaaagacgtctctttttggtaataacaaacgtgttttttaaaaaagcctggtttttttcaatacgcctttaaaggtttttaaattgtttcatatctggtcaagttgagatttttaagaacttcatttttaatttgtaataaaagtttacaacttgatttttt

SEQ ID NO: 133054 - DNA, 1898 bp, Homo sapiens
atatgaaacaatttaaaaacctttaaaggcgtattgaaaaaaaccaggcttttttaaaaaacacgtttgttattaccaaaaagagacgtctttaggtaaaaataataaaaatcccatgctgcatagataatgcagatagttctatttatctggtcaacgggcaaaaagcaagcacttaaggtcttcagctccaatcttttgttcatttcttatagctggaatttcatatttcttcctgttggatgactaaaccggatgatggtagagatggtaagctggcatttactcagtcctgccccgctcagcctcaggagtggacgaattctcagctggtggatcggctgcttttgtctctttgccatcttgtggtttagggttttctgggtgtctgcgtcggcaattgaagttgcggcggtaccgacgttgaggtggctgctgaccttgggtctcatctccttgattttctttatcttcatcattgccgtcctctctaggctgtctttggcgtggagggcccctgcggaatcgtggtctatatccccgatacgtattctgcctcactggtctaccttgttctcctgcaccctggttgtcagcaccctccatcacttcaccctgcacaggagggttggaatactgtggtcgacgcccatagggtctccgcatgtagtaaggtgggaaccttcgcctgcggtagggccggcgttgttgggcttggcctgcgggagcactctccgatccctcgttcttttccccactctcactattctggtaattttgctggtaattgcgtggaggaccctacgacgtggatagcgtctataatggttacggtctgctgcatatgtactgccttgaactggaacaccaccaggccctgtaacatttgctgcctccgcacccttttctccttcaacaacatcaaactccacagtctctccatctcctacactgcgaaggtacttcctggggttattcttctttctggcagtctggtgtacaaatacatcttccttggtgtcattcctgttgatgaaaccatatccgttccttacactgaaccattttactgttcccaaaaccttcgttgcgatgaccttcttgtccccgccggcaggcgccgccgatgtgaggccgcccgggccaccgcttcctgcgccgctgcctgcagtgctggggtgggtgtcggcggcgctgagggcgggggcggcgtgggggagcggcgggcggctgctgggtctcggcctcgctgctcatagttgcggtgatggtgactggggccggctgcggcagctgcggcttctcccggggtgtgatggtaactaggccggcggcggaggtggggctgcccagggctctctggggtcagctctccgctcccgctaccgattgaactctccttgtagaggtcttttacatcctcagttaaatttatttctaggtatttttggcgtgactattgtaaataaaattgcattcttgatttctttttcagctagtttgttattggtttatagaaacactacttattttgtgtattaatttttgtgtcctgctactttactgatttcattttttggttctaagtggcatccttgtcttgttccagttctttgagaaaaagcattcaactttttctcacttaatatgatgttagctgtgggtttgtcatatgtggcctttattgtgttgaggtacatttcttctatacctgttttgttgagaatttttatcatgaaagaatgttaaattttatcaaatcatttttctgcatctattgagaggatcctatggtatttttccttcattctgttgatgtgataatcacatttattaatttgcgtatgttgaaccatccttgcaagcatccctgacataaatcctacttgatcatggtg

SEQ ID NO: 133055 - DNA, 1488 bp, Homo sapiens
aaggattcctgtggtaaaacaaacaaacaaacaacaaaaaaaaaaacaagaaacttttttgctgggggaatggcagtgattgctaatgagtatgaagtttcttttgggagtaatgaaaatgttctaaaattagatagtggtgatggctacacaactctgtgaatatactaaaaacaactgaattgtacatattaaaagggttaatttcatggtatacaaattgtagctcaataaagttgttaaagaaagaaacttgtttgctcataaaattctttttttcttcataacacctaaagcgcacttcagaaaatgctgggttagttgatttctaaaggcccttctaagctctaaaagttcatgacaacatatagtttgcattgtttgataaaaaaaaaaaattccaagtttgatctaaaagtgagacatgttccttatactaaattctaggaagcatgtattgcctggttccttactaaaggacattgagtaatataatggacaaaggcttccactgtgaattgtagaaagtatagaaaatgcttttcaatcctaaacagaattaagaacacaatataaaattgtatttcagtgaaggctttgcttgtattcctgctcagtcttccttcccttcttaaccgcatccaagattgggtacttctgtctgctctggtataaggctttgcaggttattgaccccctctattatacaactttgcaaatcttattaccttgattattcctattcctgggggatggaggtgtgaaagtgaaatgacttgctcaatggttttctctttggaggatgagaagggaccctatcctgcagtatcagcatcgtgtgtcatggcacctgataatggctccgtttttatttaagttgctttgtaatagtacaaaagagggaaggatataaccttaagggccaggtttcagtaagttgacatttaaggaattaggtaatagtaaacctagaatccagaagaagaaagtaatgaattttaagttagaaaaagcaaacgcctatctggagcaaagtaataagaagcagattctcttaccaaagaagtatcttggcccacactgtagaaagagctaggattggtgatagaccagatatgacagtttattctggtatgcagctgaaagtttctgtctggcatccataaatttaagcaatctttcattaataatacttttcactgtgtgccacttgtagaagaaaatgggaagaggtcaaggaggttatttttatatattataaatgtggtttttaaaagaacaaaagagatattatgaggtttgtttatccaaaaaatactatatgagtacttattatacgtcaggcactgttctaggtgcagagctgctgctccaaggagcttacattctgagaggtgatagacaataaatagataaatatgtaacaaaatgatttctaggtatgataaggatgccatgaaggaactaaaccaaatggctaacacagag

SEQ ID NO: 133056 - DNA, 1035 bp, Homo sapiens
tcctactctcactagaatagtagggtcttaaataacaaaaacatcaacatggcctagagttgttggagaagaaaggcttactaagaattaagatgatagttaagccttgcaatatgtttggagtcagcaggaagtgggcatcaagcatttcaggcagaggactgcattctaggtaagtgtagattttctttgctaaaagtaatagaagtttagggaagggaaggctagagaaagactttgaaattttagaattggaatagcaggaagccattgtaggaccttgattagaagagggatgtcatgaaaggtctgttaaaaaaagtaatctggcagtcatattggtactacaattgacttaatataattggctgctgcagcagtgcaatatgaggcaagcagtggagaaggatgtatgtaacttgcaaatgattcgggaaaaaaacaaaatatgtatctatccatacatacatacagatagatatggcagtatgacaagatgttagcagtgttgaattgaggtggtgagtatgtgggtaatcctctcactatttggcgcttccttggctgactgtatactttatgcagatatacccacgtgtatatttttaaagggttaaatgtgacaatttcatgaatgtatttataagttaaagttgcagttctcatttaaatgttttttaagtgattgtcattttccaagttgttttgaaaattaaaatttgattaaaaataagattttacattaaaaaacagatttttaaattaattttttaaatttgaatgatctttttccagtatcaactcagatttagtttttttctcctgaagtgtgtaatacacactcaatgcacgtgcacacacacacatctatgtatgtatatgtgtgtgtatatatatatttatacacatacacactgttttagttgttctttagggagacattaattagagggaatcttttttttttttttttaggaaacaagaattgcttttcattaaccaactgaattatagcttttgtgagacatctgtggc

SEQ ID NO: 133057 - DNA, 1049 bp, Homo sapiens
gtgacggagcagaggtcccctgtcctgttcgtggagagtggcaatgccctcaagagaagacatatgctgttacagaagaacatttggttgggaggaggaaagaagttattaccagaagactttaggcttccctctttcatcccattttgtcagaagtatcaaaaagtcttttggaaagactagaaggaatatatgccaaaatgtcaacagatgttgtggcaggacagtggaaatataatttttctttttcttcttgttttccaaatttttgaggttttttaaatgaaaaaaagaattattttaaaaatttaactttgagggatactcccctatagatttgaccttcaccatttaattggaaaaaaaggcttttatagttatatttttagtaagacctctgttagtggagttttaattataacacattttgtgtttctgtttgaaatagacctttgctccaagaaattgtttttcaaaaatccctaggtccaaatcagactcctgtctgcctgattgtttactttttgctgagcctttttctgtttattgggaccatatgttatcttgaattacctttgcttacgaccagcaggattttctgccctcacatgaactttgtgttagaggctagtagtagaaagtgccaacttctagagctcttcaaaagagcacatcagtgtcactcaggagagccttttttcctgactatcctcccagtctaatgagggtagggacatagcagagtcttaggagatggatgtagtttcgtgtggcattgcagaggagttgttataagaaagcgtcggccaggtgtggtggctcatacctgtaatcccagcactttgggaggccagggtgggcggatcacttgaggccaggagttcaagaccagcctagacaatatggcaaaaccccatctctactaaaaatacaattagccgggcatggtggtgcatgcctgtaatcccagctattaatacttgggaggctgaagcacaagaatcacttgaaggtggaggttgtagtgagccaagactgcaccactccac

SEQ ID NO: 133058 - DNA, 1049 bp, Homo sapiens
actgagaaggaaaatattataattgcataatttgaattatgaagaagtagtcgggcaaacccagtttgaggaatattcctcaaaacatcagcgcctgtactctttaaaaatgtcagtgttataaaaacaaagaaaggctaagaaactgttacagattaaaggaaactaaagagatgtgacaacaaaatgcaatttgtgatcctggattggatcctggaatgaaagaaaattgctataaaggacattatcaggataaattggtaaaatttgaatatagactggatattaaatagtagtattataccaatactgtgatcctgaatttggtgattatattgtggttgggtgtgatggtgtccttgttcttaggagatacatactaggatttaggaatgaatgaacataatgtctataacaaatgctaacatagtccttcaaaataatagtatgtaataatagtttgtgtatatatacagagaattaaagcaaatgttgcaaagtgtttaggatgggtgcatcttgatgaagaccatgtaggtattcactgtgctattcttaaaagttgtctgtaggtttgaatttttctggttgaacctgtttatgaaagttccactgaagcactacccattcataaagccctacctttctttcaggcttggtcatgtatgtctagccttagcactcgagaaacaatagtctcaatcatcttttagaggagtcttcaagtaataacctggatcttgttatttttaaaactgagagaactacttaactgggactataacttctcataagcaataataatgtagacgtagaaagattttgcaagatacggtctgattataagacatgacactgattcagctcatctaaatggctaccggagaattcagtgacatgtcaaatcactattgcaaattaagtttgctgcacatttactgccagaagaatagctttttaaagcaaaaatggccccttgatgatatcataaggaagcttttaaagtagttctgctactttgggaaacatgacttacctgacttttcact

SEQ ID NO: 133059 - DNA, 1017 bp, Homo sapiens
attccttcccagaactgttaactaatcagctctgagaaggtgactctcaaatctaaatcattgtttgtaacttctagatatctttgtagacatctctacctggatctctgcatccaggtgccatctgaagcacaaatccaaaatcaaactcataactgcacctcttgtgaatgatactagactggaaacccccaagttatattttactccttgttctttctagttccattgactctccccttgcaaaattacacctgtcctgtctatttctagttcaagtctttattcttacactcgtgggatagaatattataataaccttataactgatgtttcaacacattatatctttctttcctatcctcttcaaaaataatttatcaggggatattcactcccatcagaataaaacccaaactctctagcctgacactcatgatctcccaggattacagcctatttgccagccctggatagagctaatttcttaaaaaaaaaagagtataccttatgtatctctgaattctagaggctatcgcactgtttaaagtttgtatttcaaactggttgcctttctgaaattgcccacctccttgcctgtctcctagttatgcttgtacccagcatccttagtatcctgtaattttctacacacacacacacacacacacacacacacacacacacacacacagttgctaacaaactgtaatctcccaaataggataaatcatatattttatttattccataatttcatagcccacataacacctaacagagtgccttgtacatagtaggaccttagtaaatataaatgctttttggataatttagtatgttctaagaggccactggatacctggaaacagcagcatacttcattatgatataacaagtcacagagtttatgacctatgttgattccatttaaaattctttccaacatgtgaggaacctgaatagcaagcagcaaagatttagaagaaactatactaggcaatgaggctagatgtg

SEQ ID NO: 133060 - DNA, 1207 bp, Homo sapiens
aggcaggggtatagcggaagtattttacaccatacaaatatgtgcagaagattgtgcctgatatgaaaaaacctcctcattggggctactttgttcattttctagaactctgttcttaaatgtgacaatattacagtttttgtagtgtaaggctatgtaattaaggatacttaagtgcatatatctcatgcaccatttttatatacaaacattgggattcctattgctgtgttttcttggagaaggtagaataactctcttaactacttctaggttatagtttttattttttttcttttctcaaagcctgtatctcttatttttaaacttgacagtcttatttatcttttgttcctttgtactgtttgctaagttgtatctattcctctgaagacaaatttccaaattatagctctcctccgttcttattgaaaggagccctgctacagagaagtaaaagatctttattttcttatctctctatctttgaaataaccagttttagtttctcttgaacaaagtggctaactgtgataattccttcttttctcctacatgatgtctgacactgtccatcttccatagcctgtcctccgttattttagtgtgcttccttctcttgtctggatttctgcattgccctaggaagtctgccagtatgtgttgatgaaggacaagacaggaaaggtaagagagacaaactgtcctatgatagaaatactaagaatagtttacttttcccagtctatcttccctaatttggcctagaattaagcaaccattttccaaaaatctgtatggcaaaaggatccttttgtttttatattaaaagttgatcccacaaattcttcaatataagactcaatttgatttcttacatgttatttagaaacgaaaatagagataagagtactttaatgcaggaagggttctgcattataaacctcacataacagtcactgtcatgattgttgaagtctagtctagacataaaagctatttgttataaagtgaattgggtaaatttggtgtaatatagcctattttaagtggactggttgtttatcaacatcagaataatttatgaaccaggcttttagtatcttttccttaatactggaatgatccctgggatgaacttgtagatgtatgagccatttctataggcttgcaattttaagggtagcatttaccctggagagtagtt

SEQ ID NO: 133061 - DNA, 1055 bp, Homo sapiens
tcaagggaagcaactgtgccgttttcctttttcttcaggtattgggagactttttctgtaaggggccagacagcaaatattttaggcttggagatcattcactctctgtttattcaactttgccatagaagtgtgcttagcgtgaggtagccatataaaatatctaaataagccggcatgcacccatagtcgcaggtacttgggaggcagcagagtggaggccaacctgggcaacatagcaaaaccctgtgtcttaaaaaaaattttttaatttaaaaaagtaggtaaatgaaaaaaataattaaaattttaaaagtatgtaactgaatgggcatgtctgtcttccaataaaaactttatttccaaaaacaggtggcaggcaagatttggcttgtgtgccatagtttgccagcccctgttgtgagtaaaagctattgtccataagtatttcccctttctaggccttggcctctgacttctattaaataaggaagttggactagatgatttctcacatttcgcaggttttatctcctttagtagtacctctccctgaagctaagtgatccacaggctgaaccacagtgacatttatttgtaaagtcagttttttaaacatccaggttgaacaaatgtataagtctctagagcagagtttatcagtcttggcaccactggcattttggtctggataatcttttgcgggagggagactgtcctgtgcagtgtaggatgcttagcagtgtgcctggcctctactcaccagatgccagtagcactccccacccctcagttgtgataaccaaaaatgtctccaggcgctgccaaatgtaccatgggaagcaaaatcacccctagttgaaaaccacttctgtggaaagttcaaaaataactagaaaaatatcaaatactagaaaatcaggccatgcaacccaagatagccaccaagttatcaaacatatttattcaggtacaaggtcaaaaaaagccaaaccaaagggaacaaagatcttattagaaggaaaagagcaatgagaattgcattcatccagtca

SEQ ID NO: 133062 - DNA, 1607 bp, Homo sapiens
tttattttattttattttattatttgtttgtttgtttatttgtttatttatttatttattttgagacagagtttcgctcttgtttcccaggctggagtgtagtggcatgatctcggctcactgcaacctccgcctcccaggttcaagtgattctcttgcctcagcctcctgagtagctaggattacaggcatgcaccaccacgcccggctaattttgtattttcagtagagacagggtttctccatgtttttcaggctggtctcgaactcccgacctcaggtgatcctcccacctcggcctcccaaagtgctgggattacaggtgtgagccacctcgcccagctggtagctgactactttttaatattgatttagatcattttaaaagtgttcctgagtccagtgaatccatttaaatagagagttatctataatgcataactgaaaagtcacactaaaagaaggaaacatgaatgaagagagatataaacaagatcattgttaatgaacactaagaatatttactttttcactcctgttatattgcttgatggagtctctagcagaaagaattcatactgggtgaattgaggaacccttatctatgaggcccagggttttctgttttattttgctttaaattgttaaatcaagtgtggcatattcctacaatggaatattatttagcagagaaaatgaatgaatacagcttcacacagctacatagagggatctttgaagctaggttttaaatgccaatagctgatcctttaacaaatccccatcacctagccagcttgcaatatggctgcaattaaaagccaaaatcgtctcgtttcaacaataagggtgtgcttgatttccttctgcctgtaatttatgcccatattatttcttttaggaagtaattatcctcccattgtgattgattattattcatagctgacaagccctaaatatccaaatggctttgtataagtttttcatttttgtcttgttttgggttttattttctttacattgactttaatacagggtggtgttttctgaacaataatctaagcactctagagacactaattatagtctcaaactcgcttttgactttttctattacctggggcgggtctcttttaccctgctgaggaaacagtttcttcatctgtaaaatgatagattcccaaactctggtcccaggatggctataaaaaaactgtatttcaagtcttgtttaaaatttagatttctgtgcctcacccctagattctgaatctgtagtctagggtaaggtctaggaaactcagatgattccagtgtacagccatgtttgagaacaagtagagataatgtctaaaatcctttcaaatctaaaatgcagtggttacatgaaatatatatttccctagatgtcatttattagattattttctggaaagtttttatatcctgcaaggaataattaagattaatacattgtagcccctcccacacacttacagctttacataaacttggtttgctataactggtcagcttatggctccaagtagtcatcttgatcctgatatatgttggaagatggtttccctttttaccagaatatcatt

SEQ ID NO: 133063 - DNA, 1012 bp, Homo sapiens
taatgctagtgtctacactgaatcttcatacaatcgaagctgatatcctttcatgggttgtatgtgctttcttaagaaaaccagatttttctgatgcattagtatgtcaggattttacttgttgcttctctctagaaaataattgcctcttgattctttctggccttttttctctttaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaagtaagtttctttcatcctaacgattctccagctttagttcagaccctccgtgatctctagccagagcctctccatagaattttctctcttaccacttcctttgcctatcacccccgtatgtcaaatgctttcccactttttcctcctctagttgaaatactgctcccctcatcaccacctactggctgtccttgtctcctctgaaataccagacattcctgtagtcttcccagatttctccagctgaaagtaatttatccttactacagattcctatagacctttatttgtacttctcttatggaacttagttcatgaaacatttattaaatacctctgatgcacaattctatttttatatgttaatttatggacttgtcttatattctgttagactttgctcttcttcttctttttttgttttgttttgtgttttttttttgagatggagtctcactctgtcgccaggctggagtgcagtggcatgacctcagctcactgcaacctccacctcccaggttcaagcaattctcctgcctcagcctcccgagtagctgggactacacgcccagctaatgtttgtattcttagtagagatggggttttaccatgttggccag

SEQ ID NO: 133064 - DNA, 1242 bp, Homo sapiens
gaaagagttgcactctgtctcccaagctggagtgcagtgatgtgatctcggcccactgcaacatctgcctcccgggttcaagcaattctcctgcctcagcctcctgagtagctaggattacaggcacctgccaccatgcccagctaatttttatattttagtagaaacagggtttcaccatgttggccaggctggtctcaaactcctggcctccggtgatccgcccgcctcagcctcccaaagtgctgggattacaggcgtaagccactgtgcccagctcatacatagtgtatttattgtctgtttctctactagatgtaaactctatgttagagacttgtctattttgttcatcactgtatctccagcacctagaaccttgcctggaatattgtagatcccaataaatttaaaaaaagaatgaatgtatgtttatgtgaaattcatcatttcacaaatgaaagaatctcggtgttttaatagcttggtagaatcaggccttactttacactcatgagctcttcatttattccagccataattaattcagataatttacagttttctcttactcttttaggttggttaaactaatctgttttggttttttcagggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggtaagaggtaggtgggtgtgagaagaggatggataggtgctgctagtgtttctttataggagctatctttctttttttcaatcctgctccttctgtaatataggggttatcttcggagtgagattatgagggacttcatgttctatattatgtttttctataatgttttgagattttctcattaaacatgtattattgatgtaagcaggaaaagacagacacttgtaatcctccattgttatttaaattgtaaactaataataacagtctaaaacttgactctcgtgagttgcagggttctagactatgaaagaaaagaagctcagaccagctttttgtactttctcttctatgttgtaatgtttgaaaaaaaatactctacattgttcatgttttttctttcctttcctttagtatatagagaaatagcatattcaatagaatgtatagctatctccataaagattaatgttatgttgaaatatata

SEQ ID NO: 133065 - DNA, 1139 bp, Homo sapiens
tgtagtcccagctacttggaaggctgaggcagaagaatcacttgaacccgagaggcagaagttgcactgagccaagatcgtgccactacactccagcctgggcaacagagcaagactccgtctcaaaaaaaaaaaaaaaaaaatactgttagtttccctattctattttttaaaatatctgtgattttaaaatattttttactagcccctacaaataaaaagttacatatcttacagcactgttatactgaatgataggtcactttggggtacagatctgtaatcaccaccatcctccagaatgtggaattttaatttgagaggtatgtttttggccaatgaaccaaagcaattccttaatttggtgaaagttctattacataatctttaatagtgatttagtacctataagacttttatcaagtgtatatctaatgttataaaacaatgtcatagaacagtaccatctctctcagctaatttttgcttgtacaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtgagtcttaagctctgattttgtttttaatatgagattagttatttttactttgtaggaagaatactggatagattctgaccacagagtaaggtctgcatatcagatactccagggcagtatttttcaaactatacagagcactaggacttctaaggaagtctttagaagtcccctcaataaggggctaatggctaataataattaatatttattgaattctaatcatgtgctaaacacaaagctaagtcttgccttacattatctcattaaatcctccaagttacactttgatataggtaataataatacctgtattacccttactgcatagatgaggaagctgatgcttaaagagttcacccagctagtaaatgaccaaagctggattctgctccaggtctagttgactccaaatcccttacgcttcacaggccaaggacacaggtaatctt

SEQ ID NO: 133066 - DNA, 1042 bp, Homo sapiens
tcgctgtgtgggcctccaagaccatcagtttgagtttggatcatgcatgtcaaaggatccatgtaatcctaatccctgccaaaaaaaccaaaggtaagtcaaatggcttcttattttattcaactgaagactagtacttacaaagcatctaccatataccagacagtgaaaacagaaaggtaaattaagaaatcgctgctgccctgaagagtttggagtctggagggaaagagagccatgtaaagctgcttgataaggtgctgcgattgggagcccagaagtagggcagttaatgcagcctggggaaggccctgggggagcctctagagattgtgatacctagctgaatctagaaagatgagtaagagattgcaggcaaggtttgcagtagagaaaaagaagtggtagtgaaggcagactaacaagagtcatggctgctggaaatgttatctccgtaacattgttatctccataacatggtgtctgttgggcactaaagcagttctgtaagactgaaacagaaaaggtaacataaggagaggtagcagaagagacaagagaaaagggtgtattcttattagtagctgtcacctgatagtcaggggaaattttcttctagttatatgcaactgttttagaaattggacatgagaaatctctggaaatgcaacttcactactatttgaaattacttgttttgagctcctttctctgctgtttcctcacttgagctcagaagacagttgccccagccttaatgatggatttctgtatggggcagccaccacggcaggcatcttgctgacccttaggttacagccttctggaagcagagtgtttattggattgcctgaatgacctgaacaatacacattccaatgccacagtgctttcctaagcaattgctgcttctccatcctgaaaaccctggtgtaatatggagggagggggagactctctcatgtgttaaaataaatggcaaagaattagtcatccatctgccaaattttatacaatgaaactaatccaagaaagtttctat

SEQ ID NO: 133067 - DNA, 1090 bp, Homo sapiens
tagagatggggtttctccatgttggtcaggctggtctcgactcccgacctcaggtgatccacccgcctcggccttccaaagtgctagcattacaggcgtgaggcaccgtgcccagctgaggccttttcttaaggtagactcatattagccaagctgaaagttaagcccgtggaagtgtttcatttgttactgaatgcaagggcctccagcctcaggctccagcctatctcttggcctcatatcatggcccttctgctataggtctgtctgtgcctgcttggctcctgccctctggatcacctgccatttccccagcaccacattccttgagcatcacacctgtgttcatggctgctctctcagcctggcaagcccatgctgccccctttgcccccccagcctccagctagaacactgcctcctccccatgctttcttcaggctccccagacgagaatgactcatccccgcaagctttgtgcacatcttttctactttttagcctactgtatatacaggcttgactctcccactctacataagctctttggagacaggactgtcctgattcatctcttgctctctcttcagcctcctatccctcatctagtgctttgctagccccaccacagtccctccctacattggctcatggtgctgcattcgtctttttcaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccaggtacagtgctttggctgacaaaacaaagtacactacggataaaattggtttatgatattttacagatgaatcaacagtaagaccagccgagggtcttctgtgaatcctgtcaaatctatagcacccagtcctccactaaaaaggaagactggctccttctcctaactctggaagctatcttgctagtgtgtgtacctttgcacatctggtgtacaagcaaga

SEQ ID NO: 133068 - DNA, 1043 bp, Homo sapiens
tgttggctccagagtctgtctaccccactgctcccccaactcctccctctccttatcccatacccagcatgaaatgataagacctctgcatttgcatgaagattgatctggtcatcttaaagaggcgcttctgggatactaacagaagtctgagcagagcagagagaggtagcaggaaagaagatttttatctcttatcagttcacatggaataagcacccagatcccagagaggctgagaaaagtaatctttcagctcatctggagacacccatattgctgcccacgccaccaccacccccagcatttagcccacctcaggaacttaagaggtcctcataatttatacctgtgtcttttttccttcctgaaaatagggaggcatgctgtgtactcttggttgggaaaggtacaacatagacatttccaggctaaatgtgatttgtttgccctcagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtaggctggcagtatcggggtggacaggggaggactgagaagatttgcttatccacctccagagagtgagtcattgagaagagagctcatttacgtttttcagaaagtcttgaagagattcttatgctgatcatactcactactttgggttgaccttaaaaaactagggcttgccttcgatatcatctggtgtcctgctattttaaaacaatacagcagccttttctcaagctaaatcttacaccagacaccaatatataaacagataaagcagtattcaattatgaaaattagggttattaaatgcataatgtttacttattacaaagttaacaaataacgaattactaattaatgaataattaaagtagttttg

SEQ ID NO: 133069 - DNA, 1033 bp, Homo sapiens
gccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatgatcatgcatgcttctaagcaatgttgacattcaaaaaggaaaccactgatcacccttaggtgagctgtgtcctttgctcggggataagaagtcatggaaattagccgggtatggtggcacatgtctgtggtcccatctacttgggaggctgaggctggagaatcgcttgaacctgggaggtggaggttacagtgagctgagatcacaccactgtaccccaacctgtctcatacctgagacagagtgagaccctgtctcaaaaaaaaaaaaaagaagtcatggagtgctattatcccaagccaagggccctgggagaacaggccagctaggacacagttggtcagaccagagggcaggcagtgacagagagtcaaatacaaagaccccagctttcagccttaaggacagagagagcttcaggccttccaagactgcatactaggcagttctccccactgtgctggtcctgatgttccagttccagggtacacctggggcagggagaccatgggaatatggagatggagggct

SEQ ID NO: 133070 - DNA, 1036 bp, Homo sapiens
gcgcggagccggccatgggcaagtcaggtgagcccgcgggctcgcccgctgcggaatggttcggaaccccgcgctcccggacctcgccgtctccctcgtccgccgcaagccaggtcctggggagtgcgggagcccggggtgcgggtggagggcgcgcgggcggagcgccccggcgcggtttccggggaacccggggggaaggcgagcccgagggaggcccccgccggagagccggggatcgcgccaagttgggcttcccgaccctgaggggctgcgcgccgcggcccgccaaggcgtggcttctgctttgtttcaggaggccagacttagagttggaaaagtcaccaaagtgtgacaacagctctcgctgcgaagcagtttgccccgctcggctgtcccgaggacagccctgagcatccccctcatccatttgttgttccttctctcctgagcgcccgcgccgtgccgggctccccctgtgctaggctcggtctggctccctttctcctggggcaccccatcctctctactgtggctgtcgggatgaactttctgcagcgcagctctcctcctgtcgctccctaacaccttcctcaccattgtcctcagagtgaaaggacacactccagtcctgccttcgggcccctgggagtgggtccctagcccttacctccgccctacactagagctgtccagaagctggtgcacaggtcccttcccctaggtttccttgccgggccttcaccaccccaactctcagcctgaaaatcccatccctctaggctcagctcctgggctggagcccatctgtgattccccccgggagggagcgcccaacctggtgttttcctcgctgcagcccttcctgtagtgggccggggacaagagttcagccatagacctgtttcccaccgggtcctcacccctggctgccaggggccgtgtttatctcagcattgcttctgcctcacaggaggctcttagagaacagctgttgaacaggattcagaagtcctgcttcatccggattgtccac

SEQ ID NO: 133071 - DNA, 1088 bp, Homo sapiens
taataatcccgggagggggcgcaagagcaggattcttgtttctattttacgaatgaggaaactgaggttcagaaagcctaagtggcatgcctcttcagtaatcggccaatcgtcgctgccctaacttcacctcacctcccagtgcagcactagagtcccctcaggggtggccgtccctggtcagtccagctccagcagacggggtgggtaggacgctccctatcaggcagcacttccgcctcccggggcccgcgcagctcacctccctcacctcccgccctaccccagtcacgagttgttttagggggaccgcccctccacttgctgattgggtagctcctgaaccattgttgtcctctgattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccgggtgagagtgcgggcgcgtttggggcgagaggacttgtctggaaactcggtccacagtgggtccgagagcttctgtgtgactcgtgctccttgctgaattaggaggttagggagcagtgcaaacaggaaacgagaccctggcccggtctttcagaaacctaggctcgagaagcctgttcggttctcagcatgtttgagtgcttctgggcgcgggcggagcgagaaagcaagtgtagggtggcaggctccggagccggaagaagcccgttcaattcagcaacttttcattaagcatttgctgtgcctttagtc

SEQ ID NO: 133072 - DNA, 1123 bp, Homo sapiens
tgagtttttgactgcaccatgttgcttcctaaacaaatcagtcccccaataagaacttagtgggaacatgtaatatgcccgaatatgcaactttatagcgggtaggttggactaaactaggctgtgattgtgagatgaagttggccttaagtgattaggggatattttcattgggtggtctctaacatttgtctgagaattttaaaattgacttcttagacccttagtttaaccttcctcatttaatagaagagaagcaatcctagagagaaacgacttgcttaaaaaagcacgagttaatagctgagccccaagtctacccactcttagaatataccacattctgttgcagtgtttagttgttttagcaggggtgtagtgcgataacagacaggcagctgtggctgtcccaggtggaacagatttgggagaagcagaacccaagatctgtagttggaagattgtcctgattcaaggacagtgttacccttactgttttatctccactgcctagcagtgtgtctgacatgtagtagatgctcacgtttgacaaagaaatgggcaaaaatgtcagatccaagggtcctatgtagaactgacagatcttggtgacgggcagttagggaaggtaaaagggagagaatagagttggatgctcggtcctttgtgcatcaagccttcggcaaagggaaggaaagaaatggttgctgacttagttcctaggagggactttcttagtgaactaagcatttggtgacttaaagccagattcctgacagtgtaattgaagttggtaatatgcagtggtcagcatttcctttggagtttagagaactgattggacactttttctctcttagttttctttttccttctttttttttttttttaaagatatgctctagtggttaagattctatgctatcctaaactgcttgagtgtgagtttagctttgtgatctcagacaatgtatataactaccaccactgcccggcctcagttttctcctttgtaaaagttgcataatataatttataatgctatgtggcatctttaggattacattaaagagtgtctataaagtgcttacagttatattaagtatctagtgaattccagcta

SEQ ID NO: 133073 - DNA, 1169 bp, Homo sapiens
ctcaaagatgaagctgcaggtctctgctcactatgggtgattccaggccacacttttttttttccctcatgcagaattttcatagagaaacactgttctctttctgctagtcttccatttgttaccactgtaaaatagaaaacagaaaataaaatcaaaagcttttggacttgggagcttaaggacagatgtgtacacattttggtgaaatttgtatataagcacatcttggttttatttgttgtatatagcacctaccacagggatagcatttagtagctcaaggttcatacagcatatgatgctgtattctactgtacaaccctttggcccagtgtttgaccagtccttattgatagaccaaaatcttatgtcttgcagatgctgttgatggagtaatgaatggtgaatactaccaggtacagagtactctgattctgttcattgatagtgattgagaatcttcctttcctgtgattttaattgactgacctagaaagaaaccccagtcctttgactttcctgaatgtattactggctggtgtgttatctaccaaagtggaaagatttaaagagaggtagcattgataaaaagagaactgtttaaaaatgttatttacctgcccctagtgttatcacctttattctaaagaaatcaccattcaaatgatactgtgttgagtgcagtaagttaatactaatactttaaataattctccttccatctttgtttatagtctgattaggttaacctggtaatattaatattccttagttcagtgagtggcatatggaataattttgtaaagattaacatttatttgagtctttttttttttttttttttttgagacagtctcactgtcgcccaggctagagtgcagtggcacgatcttgtctcattgcaacctccaccttctgggttcaagcgattcatccacttcagcctcctgagtagctggaattacaggcgcatgccaccacgcccggctaattttttgtatttttagtagagatggggtttcgccatgttggccaggcaggtcttgaactcctgggctcaagtgaccatcccgccttggcctcccaaagtgctgggattacaggcgtgagccaccgcaccccgccagagccaccgcaaccttggctcactgcagaacccgtttcta

SEQ ID NO: 133074 - DNA, 1069 bp, Homo sapiens
tcaggttaacttcaagtgtcagctgcctcagtagctatgacatgtatttcttttttttttttttcttttttgagacagagtctcactttgttgcctaggctggagtgcagtggtgcgatctcagctcactgcaacctctgcctcccagattcaagcgattctcctgcctcagcctccccagtaatccccagtagctgggattataggcatgcaccaccacatccagctaattttttgtatttttagtagagacgggattttaccatgttggccaggctggtctcgaactcctaacctcagatgatccacctgcctcggcctcccaaagtgttgggattacaggcgtgagccaccacaagcagccggcatgtatttctttatctctcactatctactgatgtatgtctcttcagcttagtgtcttagagaaaaccatatttagtcctcagaaacttcatgtttcatgtttgagaatccaatctagcaaacctgctaggtatgcattttcttgctgtcatttctagaacctttaggttaactgttagcaatgatcccatacctctaccccctgcacttctctccagtggagtttcttttgtagctctgccctggctctgccacaaacacactgcagaccaagtaggagtagatgctttgtggtcctctctagtgctaatattctgtgttctatcattctctggttcctgaatcatctctacctttggtaattgtcctaatagcaccctgcctcacagaagtgcttctaccatatttagttatgagagtgccaccttgtgttccacaaaaccattgtcaaacctggaatatggactagtttgggagaagaggtaaaagattaagatgaataccctactatgaactaatattggcagcattggtaaagaatcatctataattgtttctcccccaattggtgcccagaaggcttttttcctattaataatagaagtcagtatttccacatacacccttctcttttgctctgcccaaaacaagacaaaacaaaactaatgacccactaagatgtcagtggactgggataagacca

SEQ ID NO: 133075 - DNA, 1042 bp, Homo sapiens
ctcccccaacaggcacacagacatggacctgcacccaccacaagttcagcaagaccaaaataaactgatgaacttcagtttgcactttgcctcaattgtattgtctttctcttctctcccttcaaagatgccaattctcggaagcaagaagcagagtggaaagaaaaggcaataaaggagctagaagaatggtatgcaagacaggacgagcagctacagaaaacaaaagcaaacaacaggtcagtccgtggtggttgtagcacactttgttttccaaaattgaatcaaatccattctcagcatccagtctcggtttttggcttctgcctcctttagtgtgaaatgtctgcagtttttaaagaaagtgcttgaaacaggttgcaagtctctcgggtcttgtgagcataattcaccctattgtttagccatcccaattgtagtgagcttagctctctgagagtttggttaatatgcataacctgtaatggtgtgattcagccaagggaaaagttactttccatggaaccctgaaacgaaagctgggtgtcatgaatacacccagatctagttactttggatatgattatagacttggtcatgttgagtctcctcaatatagccctgccccctgaaagccacttcatgaaggggtccgttggcaggaatatgtgctttgtaattaggcagccaaggatgttccaacatgattattttagaattgagggttctgtgggtacttatttgtgccttaaaaagtcttgaattgacttcttaaaaatgttctgtttgaaatagattttatttagttactgatggttaaggagttgtgaggagaaaaacgctttcattctcatatcactactcaccagcagctgggctttaatgccctacacttagagcccttcttggaagcagcaaagagaggatatgtggtgttgcttccctcagggcaggcaggttcagagcccaactttcactgaatagtcaatccattcacttcagtgtataaacgggccagaccgagcctggggatatttttaat

SEQ ID NO: 133076 - DNA, 1043 bp, Homo sapiens
ataacttaacacaagttttcaaacttagataatgaatatgttggtaacagcctttctgttgcagaaatttttttcaaggaagttttgctgaactgtcaagaaagggatattctctgtatacagaatccgttgttctcagagggagtaatgacacctgttttttttttttttttttttttgagatggagtcttgctctgttgcccaggctggagtgcggtggtgcgatctcggctcactgcaagctccacctcctggattcacgccattctcctgcctcagcctcccgagtagctgggactacaggtgcccgccaccatgcccagctaatttttttctgtttttagtagaaacaaggtttcactgtgttagccaggatggtctcgatctcctgacctcgtgatctgccttccttggcctcccaaagtgctgggattacaggcgtgagccaccgcgcctggccatgacacctgtttttaggagctcagtcttaaaagtttagtccctccaggcattgaatttgggccttggtacctttctgtacttggaactgtagaatgctgggtaagctggtctcacagatgaacctcttaagttccagagagaaggaacttccccactgctcactgagaatgtagagctgcttaggaagcaggtcacttgccttgtgggaaccttgcagcacagggctgactcttgagagcataacgctagtggcacactagccattgtcaccagggctctaggacagaagagatggtttttacagtttattccagtgattcttcactggttggaggtgggatccatttgagagtcactttgggggacttcttccaagggtctacaccctcccctggagatttttatattgctgactactccccctctccatccatgtttgactctaaactttagagttcaaaggaataggtcccatttagatgtataaagtaattcatccttgttatctgtctatgggtaaagagtgaatatttttagaaaagaaaatgggggccggacaccgtgactcaacatctgtaat

SEQ ID NO: 133077 - DNA, 1035 bp, Homo sapiens
ggattgaatcaacataatgtatgtgaaagggcttagtccatgattgggtgcttaataaatgcccgtgttgctggggtgagccaaagggatgaagttggcagtgcttgctctgtcgtggagcagtccccacgtgggaaggccagcgggaaaccaggcctgctgaagtctccagcgctggaagcctcacgggggttaggaaggagccttgggagcagctcctcagagcacagttgtacctcaattgtggattttagatgtttctgcttctcaatgttctctcttttttcctgcctgcttgcctgccttttggacctcttgctgtctagggtggcagatgaagctttctacaaacaacccttcgctgacgtgattggttatgtgtatgttgcaaaactaattcctttttctacatctgattctttctacttttgtttagagttaatgctccttttatgtcacaagttgctttgctttttaaattatttcaaattggcactttgggggctgcctaagaattgataagcggggtatgatctgttgatgaatcttccagatttgtgactccctgcatcctctgatggccatttttcatatttggggttttggagggaagaaagctaactcgctttcaaaatgtgtcatttgcgatcttatctgggaacggtttgaggctcgggggaactctgctctcttgctcttggctgccatcactgctgccatgccctgttgcctgcctgcctcaggtgggaaggaggtttccccacctgggagcaggtggcagtcccaggaggttaggagccagtgagcagcagcaccttgcattgccaaaatcagagctgtggggcagcattttccatacttggttcattcaaacaatgtggggtcgtttgcctctccctcaggcagaagagtccagagcagagggggttgtctccagtgggtgtctataattgttcctctgtggtcttgcatgtcagaaattgctatttagtggtcagcttctgatgtcctgtctcctagcacagggaagccccc

SEQ ID NO: 133078 - DNA, 1509 bp, Homo sapiens
catcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtattatgtgaagcttctttattgacctcaagatgtgttgtagtttggagtgaggttggaaggaatttccaggaggaatttccttgaaatttctagggctgaggaggcacagccactgggcacacagccctgccttgaactaagatagcaccgggatctagagtgggatcctgtggacattttcatttgagaagggagtttagtggctgaaggttaaccccctcattatctacctaagacacagctgtgaatcctctcaccaacctagtcgttttctcccagatgggctcttgcttgccagtgtccctcagtttagggtcttggatagtatatttcggcaggagtctgtggggcacgtagactctagtaagaccttgactcctttggatccggcc

SEQ ID NO: 133079 - DNA, 1056 bp, Homo sapiens
cttagaactaccatactctaaagtactgactgaagggattctacattaggcccagaaaataaaagactagcattcatatattcatgaaacattcaaccacattctctcttaaacacagccatgaaagaccataattaaaaaccacttaggctgggcgcggtggctcacgcctgtaatcccagcactttgggaggccgaggtgggcggatcacgaggtcaggagattgagaccatcctggctaacaaagtgaaaccccgtctctactaaaaaatacaaaaaattagccgggcttggtggctgacgcctgtagtcccagctacttgggagcctgaggcaggagaatggcgtgaacctgggaggcggagcttgcagtgagccgagatcacgctactgcaccccagcctgggcgacagagcgagactccatctcaaaaaaaaaaaaagaaagaaccacttagtgctaattgatattacaaagacaataaaatgtaagtagagatctaaaatatttggtaatcactgtgtgctatttatcgactatagattttaggcttcaactggttattaacctcattcactcacttgttcacaaaatatatgctcagtactgatatatgcataccttataacaactcacgtatgtataaagcctagtcagttgaagtatgagcaaaggtaaatacctgtttctcttccaatctgacgtgttcccaggttgatcacaggtgttccaaaagctccaacttctcgaaccccacagctgctgttcccaatcatacagccagcatgggcaaccaactgtataaactggtcaaatgggacgtgtttaactgcacgaaagttgggatgatgctcaatgcccttcttccgcatcactcgaaccatctctttgctccctatgaaaatgaaaagaaccaattggtaaatggtttgtgagataaagaaaccattttcattggcaagtatagcccacgtaaagaaatctccctaaaaaaacctcacatcagttattagggaaatagtaattttaactactggctttttcatgaatgatgg

SEQ ID NO: 133080 - DNA, 1046 bp, Homo sapiens
ggctcgcgctctgcctgcttcgtggcgcttggttcgtccctcgcccgaggagcgcggtggcggcgtgggagggagcctctgacggcgtctggtgagagccgcgcggcggcgtgggactccgggagagcatcctgcccacccccagggccgcctcccccggcctcctgccccaggcctcccctccccggccgctttccaccccaccgcgccccgaggcccacactggacccggctctcgcccaatgtcctgcaggcctcaccatagggcacctctttggcccaattcagggctccgccgtgtggctcggggtgggccctgatgagcaggggaggggatgtagagggaggcccaggttgacttgtcccctggaacagtgctgtccaatcaggggggatgctgactgtcccgttaggagcggggcggggcgagagagggtggagaactgcctggcaggcgagctgtcctggcgtgaaaaggctgggctaaaaggtcccctccctgctctgagtctacattctgagtctgggcttccttgtatatttgagaaacgttaattccccgccctcaccccaatttttttttttttttttttttttttttttttttttgagactgagtctcgctctgtcgcccaggctggagtgcagtggcgcgatctcggctcactgcaagctccgcctcccaggttcacgccattctcctgcctcagcctcccgagtagctgggactacaggcgcccaccaccacgcccggctaattttttgtatttttagtagagacggggtttcaccatgttagccaggatggtctcgatctcctgacctcgtgatccgcccacctcggcctcccaaagtgctgggattacaggcgtgagccaccgcgcccggcccctccccccagttttacgcttgtaaaattgttagaacacaagaacgtattttttactactctggtaggaggggtggggtacagtttcgcagtataggtaactcgttaacccaactgtaggagcgccgcagttgaagccaaaccgaattatagcgtc

SEQ ID NO: 133081 - DNA, 1105 bp, Homo sapiens
cagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatctgttgtgtttcatgtcactgtgttagggatggggaagggttgtatatgcatggggatggagagatagatagcagcaggaagatagagctgggttgaattactggctgccagattctgtattt

SEQ ID NO: 133082 - DNA, 2372 bp, Homo sapiens
tggtgggcacctgtaatctcagctgctcgggaggctgagacgggagaatcgcttgaacccaggaggcagtggttgcagtgagttgagatcgtgccattgcactccagcctgggcaacaagagcgaaactccatctcaaaaaaaaaattcctgggctaattcggaggtttatgggttaaaaaaaggcaaaaattgctttgtacctcttcagaggaagaaagaatgtaaaaactgtgggaagtaaaagtagttccattgctttgaatgtgtttcattgtatgtgtcacaatttaaacaagttttcctttttgttttgtaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggata

SEQ ID NO: 133083 - DNA, 1050 bp, Homo sapiens
aagtgttgggattatatactgcacctggctatttaatgtttaaaaaaaaaagtttacaaaagctgcttttttactcttcatagtttcatagtctcaaattgtgatacagtaaaatgtgatacagtaaaagaattttaataggctgggtgcagtggctccatgactatataaaaaaaatatagtcaaatttatgttattttttaaattaagtgttccggtttggataaaactagataaccttactatttggtgaggaagataaagtcagttctgagggagcacagttccagagatctagtttagcccaaactcaatcctgaagacaaagagtcttaaattattttaaaaggaaagcattatatgtgtaaatccctgacacgtgcggacagagaatcagaaaaccacaagttccgtgtggctgatagttggaatgtgaggaagagtgggaaaagaaaaggtgttcagagataaaatcaatgagcggcttgttgtgaagccactctgaagcgtaaaggagtttagtgtgatcctgaaagcatttgggaagtatataacagactgttttatagaaggatttctggccactgttctaataaaagaggtaatttctgagagacagggagatagaataaagacatggtgggccagagaatggatagtagcaactagatgaaaagagggactgatttgagaattactgtaatgcagaaataagattatgtgctgaataatggggttgtaggaagtaggagagcaggtgatgcttatgtgtctggcattagcaactccacaaattatggtcccatttgttgaaatggagaaagcaaatttaggagccagggaacaggtgagtaagtagagctatcagtatagagtcagtcacctattttacaatcaagctttcctcggtaccactaaatgttttctgtgacttcattccattaagaatagccaaggggccaggaatggtgactcaggcatgtaatcccaacattttgggaggcaaaggcaggaggatcatttgaggcctggagtttgagaccagcctgg

SEQ ID NO: 133084 - DNA, 1006 bp, Homo sapiens
tttcttgttaattcttgtgcttttaatgtcatctccaagaaaccattgtctaatccaaggtcatgaaaatttactgtgttttcttctaagaggttaatagatcagctcttaacacttaagcttttgatccatttgagtcagtttttatatatggtatgaggtaggggtccacctttattcttttgtatgtggacatccagttctaataccatttttttttaaatagtatagaatctttggtattaagattgacttgatgttaactagaaattttcttgctaatctgtcagcaaagcaaaactcttactgccttaacatcacaattttttcagggtattggttgataattttgtttaaaaatttaagtgacgttttgataacagaataaattatcttgtaggtttcagtagtcataacaatagaaaaccatctggttttgtggttaaatgatctttttgctttttttaggtgtgtagtatgcatgtgtgattttgagtcaaggcagctacttagagtcttaccctgtaaccacgagttccatgccaagtgtgttgacaaatggcttaaggtaaagtgatgacatctttaaaggaaatgacattgaattttctattttattgaccatggattagagtaagttcatagctcagtggacaggaaggaagacaaaatggaaacacagctttcagtatgatctctgcaaatgagaaaaggccagtaaaaattaactgcagtcaacaacataggagtgactatacaaaatccaaaatggatgacctcttgacaatcagtatgtcctttttcatggtatatagggacaaggcccgaacttgctaggccacagtttgagagtttagaaggctacctaattatagctctattttcagaggttagcatggagaaaaatacatctagtgtttttatttaattctgaccattttctcctttgtatatatgaacaaaagcacaaaggacacaaatcctaagagtggctatgccagagtga

SEQ ID NO: 133085 - DNA, 3011 bp, Homo sapiens
cagaggttgcagtgagccaagatggcgccactgcactccagcctgggcaagaagagcaagactctgtctcaaaaaataaataaataaataatggaaagctgatggcttggggaaatggggattgactgataatgggtatacagtttctttttgggctgatgaaaatgttctggaactagatagtggtgatggttacataactgttaatataccaaaaatccattcagttgaattccttttatcatatgtcagttatatctcaatgaactgttctttgttttcttgtggcttttgtttttgtttttgtttgagacagagcctccctcttgtttcccagtgttaactacacacttttgaagtaggctctgagcatgccggttttatagatgacaatactgaggttcagattaagtaatttatctgaaagttaacatggctgattggtgacagtaccaagattctaatgtccagaagcccataatctttctgcacagcataatgcctctgtaccatatctcatttagccctgtttctgatttataaatgcacatcctgttttgtttcatctgtgaaaggttaaatgtctgaaaatcctttaggtcagggtgctatgactgaaaaagtaattttaattttgctataattggcttattcgatgactttttgccttctcattttaagagaaggttcaaatagtaaaataaatagagggtaatggaaatgtttgataacatgttttaaaccttgttgaaatcaaagttaggaagattttactgtagcctatatgtttacttgtatgaattttagattcatgtgaatatcaagagatgcatggccttaaagacattttgggattttaaatttgtgattattataaagcataatctatctaaacacaggaagtatatatatatatacatatatgtgtttttttttccccctcctcagcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtagtaagttttcacagagtactatgttaattacttgctttggcaacttacttgttctgagttatgttttagtataattcaccatatttagaattatatgtattctcgacagcattcagttggaaagttatatttagaaatacacctgagtgtatggtttaaaatggttgctgcatccattaataagttagtatttaaggaatattaaaactttgaacaataaagaactttactgtttaagtctttttttaattagatactttatttgacaggctatttgtaaacgtagagtgattctaaatcttaacatttttccccttgcagccttatcctccatttatgcctcggaggcttacaggacgtagtagataccgatcccagcagccaataccacctcccccttatcatcccagcttactgccatatgtgttgtaagttctttcttatcttaatgatttctgaattttgaaactcttgagattctctttcctttgtgaatgtctttgtgtctatagcttttggtgtgttagttatttgtctttacttaatgttaaagggtggggtgggaggagccagttaaggctgaaagaaagaacagtaacataggagaaatggggaaggaagaaatctgtgagccaaaaaataggtttaacagatcaagaagcagaaaaggttaagattttctgcctcttttacaactgataacacttaccaccagtcttgattattcagcttttagtgctgtttttcttagggagaaaggagaaaaatttatttatttctatgtcttagaactactctatttggattaagttggtctgtaacagaaattcccatgggtaggtttgttgttttttttttttaatttgagatggagtctcgctcttaagtctgtgctggagtgcagtggcaccacctcggctcggctcactgcaagctctgcctcccaggttccagcgattttcctgcctcggcctcccaagtagctgggattacaggcatggaccaccatgcccagctaatttttgtacttttagtagaaacagggtttcgccatgttggccaggctgctcacgaactcctgacctcaggtgatccgcccatcttaccctcccaaagtgctgggattacaggtgtgagccactgcgccctgccagtaattatttatttctgtctcacataataaagtctagaagtaggcagctcaacgatgatttcgttagccctgtgactatgaacaatgttaatggcttcctgtataagatctaaggtggcctctcaggctctagtcatatgacattccacctagcaaaaataaaaatagattcctctgcctacctgctcctctcaaggatatgtcccagaagtggcacgtataacccctgcctctgtatcacattggccagaacttagtcacatgtctataattactttctgggaatgctaggaaatacagtttttataccagaaggccacgtgcttacgttaccacactgtggtcatagtttttccttccttccttcctctctctccccgttttctctatttatctttctatcttaatgtcagatatagtatgtctcccaatttggtcttaaaatgtttcagtttaaggtcttttgcatttccttataaatttttaaatcagcatgtgagtttttacttaagtgcttgctgcaatcttggtaggtattgcatggaatttatagattattttaaggagaaagtgacatctgaatgatattgagtcttctaatcttcttatgtggtatatttctgtttattcacctttaagttatcctagcaatctatttgcagtttttattgtacagttcttgcatatgttttgttaaatttgtcagattaacactaaccattcttcatccttatagcactggcctctg

SEQ ID NO: 133086 - DNA, 1053 bp, Homo sapiens
acaggtgtgagccactgtgcctgaccacaggaaaacttatttaaatgagagatttgactcgaaagatcccgttttttttaaggctcttagttcttaaaagcggcacataatagaattagtataatcccaaataaattttcagtagatttttggtgtaacttgagaagatgattctgtcatttttagtgacaatttaaaagacctgaaattgtctacagccatagaaagtgaactactgatagttgtttctgtaaagttttattggaacacaaccacacctatttgttcatctgtattgtctttggttactttgtgcagagaccatggcccacaaacctaaaacattcactttctagctctttaagaaataattggcccactgacaccctggtcttaaggtctagaccaattatttctcaagagtattagctgaatcagctgagcagcagcagcatcacctagatatttgttagaactgcagattcgcagactgtacactagacttactgaatcaggatctgtgggtgtgggactcagcaatctagtttaccatgccctccaggtgattctaatgcacattgtaattagagaaccactgttctagtcatgaaagaacaggtgggcaaagtagcttctccagttactaggaattattataaaactatggtaataaagacatttatgccagcatagccaaataagctaatgaaatagaatataaaatctagaagccaacacattttctgtgaatatggtcatatgctacataataacgtttgaccaacagaccacatatacaacagtggtctcgtaagtttataataccatatttttactatatcttttttgtgtttagatacacaaatacaggggttagaggtaccaaccctctacactgttgaaaatacacatataatggttgactccctcaaaaactaatagactaatgttgaccaataacatagttaatacatatttagtatattatatactgtattcttataatgtaagctagagaaagtgtgattaaaaaaatcataaaatacattaagt

SEQ ID NO: 133087 - DNA, 1415 bp, Homo sapiens
tcaatcatattcatcgcgtgtttacccagtttctatttgcggttgtcagcaaattatatgttctttggttatttcatgttttctcattttttaaaagtgtcattttggccacataggaactatgtcttatgtatgtgttagctaaatagacaaaaaggtgcctattaggtatatgaggaacactgacaaggtatctacagattaaagttcgttttattataatatttaaaaagggagaaaatggtaggttaaattatatgaaattgttgctattagactatttttcacttataaaaagggcaatttcatatgattcaagaaaaaattgtagctgttgatttctaaatactttcagagatgaataccaatactgtttgctttcattattgtataaaacatataccttgtatttaaatttgtaagtttttagagctgatggggaattttagcagttatttaataatgaagcttaccttagcatatactattgatagatatcaaagaaagacaatacagaatcctgatggatcacaataagcataatgactttctttttgatatttatcacagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcaggtacaataacagaatgtcttggaaatacagaagctgaaattttgtggcagtttgagattttttttttttggctttttgttgcaaatttcttttagtttttacctaaaatgaagttatttaagttcctcattccttttaagaattgagatttaaattctacacagcttccatagaagaaagttgaacttaaaaaattagtatcggcccagcacggtggctcatgcctgtaatcccagcactttgggaggctgaggcaggcacatcacttgagcttaggcattcgagacaagcctaacacagtgaaaccccgtctctactaaaagtacgaaaattagctggatgtggtggtacatgtttatgatcccagttgatgcagaagaatcacttgaactcaggaggtggaggttgcagtgagtcaagatcgcaccactgcactgggtggcagaacgagacttcgtctcaaaaaattaaaaaaaaggatcaaggttatgaaagcttagaatgaattcatgtatgcttgatttgaaattattgatttaagattagtaggaaatagcagacaactgatggtttgagtacatattcctgtttcctagtttcttctggaataattcaataagcaagacagttg

SEQ ID NO: 133088 - DNA, 1012 bp, Homo sapiens
taaatgtaggattgagtgaatgaatgaggcaatgaaactctaaaaagaagaccatgttaaagtatgtaacttttagtgtaggtacaagaagggaccacgagccttaaccccccaagaagaattcactgtcacagcacagtggaacacattatgttcatgattttttttttaatgttacagagtaagtatatttacatatgaatttaagaggattaacccataatcaagtcaaacatttatttttgttttttaatttttgtagataactggggcgatcctcccaccttggcataccaaagtgctgggattacaggtgtgaccactgcattggccaaatcaagcattggaaatgtggcagtcatttacttttgtgcttatgattgtgtcctttattccttaggaaggtctttaggtttgtgttgaatagagctgagatttctgcagtcaaacatatgtttgctatagaaaatttgccacaaatattgttaaatctgtcattttcctttgcatgattatttggaaggttaactaaaaaacagaatgagaaaaagtattaatcttggtccaggcaaacacttaacctttctgtacttaagatatgtaattttaccttgggttttcttagcatgaagtctgtcctttaggatttcggaattaacaccagcagaaaaagttaccaataggtatttgggaaacaggaaggacgtggtgttcttgggctgtgctgttttgcctccaacagtttttgtaagagagatccattgccagaggcaacctttgccatctttatgttttgatgtttaaaattaatttttaatttctttcctgtcttcgctagcagaatcatcaaatacctagaaaatccagactatccttcataggcgtgattctccacattggtgcagctagccatgaactatccttttcttcctctttttcccagatatctcccggggccaattcagcatctctacctggccatcctaacaaggtgatttgtgaaagggtgaga

SEQ ID NO: 133089 - DNA, 1049 bp, Homo sapiens
agttgcaagtctgctgtattctgtttggccttgattgcgagtgttgttatacttgaaaatttaccgtaaatttttttcaatagcaaacaaaccttgtatgtaggctttaaaaaaaattcccttttatagggacagttggaatcgaagtaaaattgttcctatcttcagggaacaccgtctaatggaagaaatagaacttttgtagagataatacgaaaccacatacatatagatgtcagatcaggtgtgggaagctgggacacacttggaataaaaagatgaaatttctgactggaagtttacctgggaattgtgtcacttcagatactcctttctctggggtttataaatatatatttataatatatttatttataatatggtattatataatatattatatatatttataatatggtatatttcaccttttgcaaacctgctaatcatacattgttcattcaattttaagttgatttttatgatatttctgtaagacttatttctaagagatttgaaggccttagcgcctatagttgaataagttctgccacagactcgtcatgtgggcctcaggctctcatctgtaaaatataaaaaaagttggacttaaataatctgtgggttttccacctctgacttcgtctgtgattctagaaggtagttcgtatttccatacttgttgggctttatatgcccatcttgtttttatagttaaattgtcaagtattactctgggtgaatattgaggagaattttctctactaaaataacctaatttttgatgaagagtaaacaagatggcatagtcagacataactgactgttagcatcataatgtagagtgtagatctgttgtctctctgccaacagcattggatgaggcttttaattcatgttacattcctaggctgtttctgtttgtgctcactttctttttttgaggctgtgagtggaaagtgtgggtgagaaattcttatgataaaagtttctgaaatgattaggtacttgctcagtatggaaagattattggtcaagattatgtcttc

SEQ ID NO: 133090 - DNA, 1045 bp, Homo sapiens
aatatttacatatcattaacagaactatttattaagcacatggtatgtgctaaccccttgccagatttggtaagacttagtccttggcttcaagaagtttactatttattgggcagaagtgtcaagtaaatacaaagttggaaggcagaatgattaatgctattttagaacacacaggagaggccactaactcggcaatagagattgaggttgttggagtgagattatagtagggatacttggatgtggatgtgatggcagaacagtactgacagtgttaaccaatgaggaactgccttctcattagtagaggtccagaacttccagcaggtaagccattctttaccccagcacctcctttgacatttccttccatgtgaatggttcttcagcatttggacaagtggttctttacctgtagctgttgaatcatgcctttcaatgccttaaaataggagatggtcctctttccatttttgtgcattttccgtcatccattcttccccccaacatcggtgtcagtgatatacaaacaaagcagaactgagacttgaggagcttacagtttaacaggaggaaacagatatttgataaacgctgtaaggtgttatgatacaagtgtgtagagggataaggaggacagcctgtaacctcatagtcaacttttttgtaaaaagatccttcagataaccattattttagatattccttgatgtctagaaatgcaaaactggtcacaaaaataaactgtatatttaccatttgacagactattaactagcacttatttaaatttgtttatgattattgtttagtgtgttttaaaatgtatttgtagcaacggtacccttcaaattcacaagattgggaaatggttttctagaagcagatagtgaatttcagaatgagatctttcttatatatatatcctaagattacagttgttttgccttagttagaaataaagaaaaaacaggacatctaaggaaatttaactccaagtccagttagccaaccagcaaattttcccaaacatttaaagaag

SEQ ID NO: 133091 - DNA, 1038 bp, Homo sapiens
ggtgctgtctgttctccggaacagaacaagcaagagtgtggcttcaaagagtataggttacagcaggccatctagtggaggcctgttgcctcagggtcagctcctgcctggttaccctgttctagaggttgaatatgctgtgatgtgcagtgtatgctttatttgtgcccttgggtctccacttctgattggtataggtctctgtttttctgcttctgacttggctgtcctaggcacttaggtttcttcatttgaactccttcctggccgatgccttttcactgtccacctgctttagccccttcacaccttcactaccatgagcttgccctctgtcattccagctaccatggttcagtccaagtcatctctcacctgcactgtggaaacagccacctgactaactcttcacctcaaagctggataagtggctatataatatgggaggctttcagtggacttcgatttgggtgagcctttgctgccctcttctggtctctagctgctatagccggcagctgctactaattaactttttctactttgatttgtgttaacatttctgggtgaaactgcttatgctgattgttttgcagtagtagatcaagttgtagcatgcttgtagatactgcgtaggctaaatgctgttcagccaatatgccttttccctcagtgcagctttatcttttgttttttgggttttttttgtatttttggtggagatggggtttcatcatgctgtccaggctaatctcaaactcctgagctcaaatgatctgcccgccttggcctctcaaagtgctgggattacaggcgtgagccaccgcgcccggcccagtgcagctttatgttattcagtccttttagctggttttggaggaagaaaggaaacttagggatgacagcaaagctagcttcagggaagattttgaaatttattttttctgcatcccttttcctctcttttcactgcccgctttctgttgttcctgtgcttcatttctccttgggaatttaccaagcgagaaacgtagaatc

SEQ ID NO: 133092 - DNA, 1049 bp, Homo sapiens
ctggaagtgccttaaaaaagcacatcgttgtgttaggctgagtcaagctggaatgagcagtgagacagtacaattcttaggcataaatatgtacgtagttcacctgtagatttgctggaagagccgacatgtttgcagtaccacagaccagagaagtctcagtggaggaaaatgagagagaagcaaagggagagatggagttaggggccttcgggttcagattttgaaataaaatctatgagtctttgagggaggcagcaggaagttaaaggtggaatactggaaatagttttccttcctccatgctgtatggagatgggggctgctgcatggaagtgggggctagatgttggtgaaggtgtccttgttcgagcagagaaggtaaggtatatccccttggttggtttgttttaaggtgacagattcctgctacaatattagcaatacaaacaaaggttagacaatcttgttaattttattatgcctggggttaaaattgaaattcccttattttaaaagaaaaatagcttataacataacagtgacatctaagcggaataaatttccatggcagtttaatggtagttgtgtgctttctgtcacacacacaacatactcttgtctaactagggcatgcagtgctgtttttcccacaggattggtaagtgatagattcatattcaaagagagaaaaaccactgctctttcagtgggcctcccctacttcccattcccagaaaccactcagacactgtgtggatgggtgcgaagcattatggattggggcttatggtttgtggccctgaggtagaccagggggatcttgttaaaatgccgatttctggcaaggcatcaggtgatggtgaagaaagttttgagtaccaggaggtagagtagtggttcttagactttaaaagctggacacccccaccagtgcttttgattcacctcactgggtggggcctgcagatttcattttaaacaggttcctaggtgatgctaatgcacatgaagggcagggtgtgttctgagagccactgtggtggagt

SEQ ID NO: 133093 - DNA, 1400 bp, Homo sapiens
tctctcagagtgctgggattacagatatgagccaccgtacccagccctggattctctataaatcaggcatatttaagttacttcttagaaaagatcccatgctctgtgattctcaacattagatcttaactgagtgcttgtttgggcacttaaacagatgaagaaaaacttcttggctgggcttggtagttcagtatctcatctgtattgtgggcttaataggtattggtgggccatcctgggaacgtaccatttagaaaatgatctatggcaaaatgggcttctaaggtcaaagccagattatatgaacttttggaataaggcctgttttttctttgagtgctgctaactgctggccagggatgtccaatcttttgtcttctctgggccatgttgaaagaattgtcttggaccacacatgaaatacacttgaagaaatttatgaatttgtgttgggctgcattgaaagccatcctgggctatgggttagagaagcttggtttatggatacctaggaaggaaaaatgaattctctgcctttcataattactaaactgtggaattcataggaggaagacattgattctatacaggcaggataaaagctgattaatccagataattgaagagtttctacacactcactgttcttagtttttaaaataaccttaggtttagaccatatctagagattgatatgtttggtggctcttaagacattgttgactgtctttgctaatggcaggaatgtaagtcaagaactcttgtaatcgaattatctaatatttttattaaaactgcatatatagttgaaaacaaattgttattttaaaattgtttttttaaaattgatattttaaagcttcaagtaaaagctaccattatttgctaaaaaaaagaaacattcctcttccccaaacaaatccaagaagcaaagcaagaagtgaaaagatttgactttttaaagtgaatttgtaaattggatgcggtggctcacctgtaatcccagctacttgggaggctgaggtgggaggatgacttgaggccagatgtttgagaccatcccaggcaacatagcaagactccatttctaaaaagaagtaaagtaaatttatgtgcaactcataaattctgtgttgagataaaaactgaagttacaatttgactctggaatgtttagttagtactatacatcttttgagtctaattgacagggtgagttttgttttgttattttgagataagagtcactattttgcccaggctggcctggaactcctgggctcaggcgatcacttcagtctctggagtagctgggattaccgcttcagaagtgattttgacaagttattctggaactgtgttggagaagtttaaaaaaggttggggtgggagtcgaa

SEQ ID NO: 133094 - DNA, 1608 bp, Homo sapiens
gtgctcacttgaaggggtaaatgcagttatttttctcttcctatttccccctgcactagcattcctgaagacctgaggctttttagctaattttgaaaatatttacccatttgtattttccattaagtggttgtttacgcttcctgctgtttcattttttcttggagagagaggaggggggagtacaaaccaaggacaagaccggacttcctactgcttttggaaataatggcagagtttttcaggacagttgtcgtggatgaatgctgttctgggggctcaagggaaagatacatttgaagtggtttctgttgtcttttttattattatttttaaacatgattgagggtggtgggataggaagtttcaatttgcttatgctgctgtcttggagtaattttttgaaagaaattatatgttaaaaaactaaagatgtttaacaaaagtggtcttttgcccacagaagggaaataaacaattcttacctgcaggccttacccagactggtttcagtttttttcctgttctacttaaatggatattagcgctgttcttgggactgctgagaacagttaactgcagtgatgttggacaggtggaagagtagaatgatgggagtatattggggtttatcaatagttacgctatcaaaagctatcactagctggtgtggtggctcatgcctgtaatcccagcactttgggaggtcgaggcgggtggatcacctgagctcaggagtttgagaccagcctgaccaacatggtgaaaccctgcctctactaaaaatacaaaaattagctgggcgtggtggcacgcacgtgtaatctcagctacttgagaggctgaagcaggagaatcgcttgaacccaggaggcggaggttgcaatgagccgagattgcaccattgcactccagcctgggtgacagagcaagactctgtctcaaaaaaaaaaaaaaaagaaagagaagaaaaaaagctatcactgcattttctgcttttgtggtaaaatatgtatagaaataagagagtgagatattgtgagttttggtgtatatactgatcctttgactttgttgagaaatgtagggaagtagtagtaagaggaccaaatatatacatggaaggggccgggcgtggcggctcacccctgtaatcccagcactttgggaggccaaggcgggtggataacttgagctcgagtttgagaccagcctgggcaacatggtgaaaccctgtctttactaaaaatacaaaaattagctgggtgtggtggcacttgcctgtaatttcagctgcttgagaggctgaggcacgagaatcgcttgagcctgggaggcggagattgcagtgagttgagatggtgccactgccctccagcctggggaacagagtgagaccctgtctcaaaaaaaaaaaaaaaaaaaaagaaaaagaaaaaaactgtatacatagaatagcaagcagttaggtagtaggacaatttgtagtgcttttgggatgttcttggagttgaaaagttggctgtccattctgcttctgcaccttggattttagtggctgcagatgctgcatgctgaccttctgttgaaatttgttttattgtcaga

SEQ ID NO: 133095 - DNA, 1800 bp, Homo sapiens
tgtgtaaaatctgaaaacatgaaaaataatattgtttgtggctatgcccatatgtggtgatagtattaaattatgcatattaagtgtaatgattgtctttgggaagagaagatgaggaatgggattacacaagggtacccaaaagggctttatttatacctttaatgtcctattacttaaaaaaaatctgaatcaggtaatcgtaaattaagatttggtaatgttgggtgtagggtatagagatatttagtatactctaaatatttttcagatgtttgaaatatttctcacacaaaaattttgtttatagaacacagtttttgtttcataataatggacctctcctacaggctccagcctagcgcagcctgttagacatgcaggctggtgatcctttttcgcccctttctgacctgctaaacctagttttgcagtggatgacttttattttggaactgctgatagttgcggtagatttctcattatttctaaactttctattggacctgtgtcagcagtttgagctttgttgaaatagatgtgctccaggacattctgatatatcaggtgtagggagggacccagacatctgattctgagaaaactccccagtagattgggatgcccactaaagtttgagaaccactatcttgggtttgccccagcctagtcctcatcttttccttaggctgcccctctgttcccactcctggatgactgggatggaattttgacccacgtgatactttacctcttttgtggagcataaaagaatgatagggttggatgccatacccctcttaatctaggttgtccattcctctgattttcatggagttagctaaggggcccactacctaccagggttgtttatcaggttttacagattttaacacatgtgtcaactgtatgtggtttcaaagtaagggcaaaaagggtctagcagagaaggaaaatttggagaaagtaaaacccccaaaggtaaacatgtcattatgtcttaagagaaagatgatccatccctctgcagatgctagtgattgttttagcttgtgaccaacatttgaggttcagccgtctgaacctatggtcagagattaaggtctttaggagacaactgattatccctcaagatggaagagtgtcctttctccaaaatttgctagttttccttctctactagacctttcttccttagtcctgatgtgtttatgaatgaatttatgttaacaaatctgaggctttctgatagtgaaatttgtgaagtgcctgtttgtctttgttaaggttcctctatctggaaacccactttggaggtgcagcattgcccaggtacgcttttctttttttttgagacagagtttcgctcttgttgcccaggctggagtgcagtggcgcaatctcggctcactgcagcctccacctcccaggttcaagcgattctcctgcctcagcctctcgagtagctgggattacaggtgcctgccaccatgcccggataattttcatatttttagtagagacggggtttcaccatgttggccaggctggtctcaaactcctgacctctgtgatcagcctgcctcggccttccaaagtgttgggattacacgcgtgaacagccgtgcctggccggtacacttcttaacggtgctgctgtgtaggaccatagagattgcacccagcaaaaggatacctgtttcaggtggcaagtgagggtggaaatctattctgtactccacttaccaagatgagtacctggtgtggaactgtgtgcactcagagaaggggcaccttttc

SEQ ID NO: 133096 - DNA, 1552 bp, Homo sapiens
tcagctttgtccggccccggagcccctgcgagccctgcgcctcagccgcgccgagcgctcacaaagcgttttcccacccggtgggtagccccctcccccagggtgtgcagggcaggacctctctaggtctctgctcggcggaggaggaaaccgaggcttagagggggaagtgacttgcccaaggtcacatagccaatgagagccgtagcttggctgggacccagggccaccctgggccggcgcgggccccgagcagagggggctgggaagaggtcgatcccccggcccccaggagccgagggagacagatctcgggggagggggtcaggccctggaccctggcacacccacccagccctttttgggctggtttgggagtaatgatctcttacggggtgggacggaagagcagggggccgacttgggagcttggtggtgccctggggagccgcagcgggaaagacttctgtgcggggtgtgctctcggggagagggctttcttgagtgagtggggcagagcttcggaaacttcttatcgtggggaccgtttggtctctgccaggccaccttccccaccactgcactgactaaaccaattcagctggaattactgggagggaggcctgcccgcttttgtggaggcgcccgtaaggtgtcttttttcagtaaatggcccgaatttcgttcatgccgaaaccagaaatgcatacatggccttggtaaagacgtttacggcacagaaggccatgtgagttttttccaggtggtttggacctaccacacttggagaactccccgagaaagaacagctatcccaggcttgaagggggaaggaagctgggaggattgggaccgagtcacccgcctgcctggcatgtaatacatgggatttccgtttttatttggggtggatgatgaggtgggttgttttgactgcggatgtcccttggaaggggaaaggacttgcagttctagagggaagggagagagcaacgtgttacaggcagggacgagggtcccgtggagctagaaaatagaatggggaaaaaggagagggtattcagtcattgtgggggaagggagatgaaagggttgctgaagggcgggggacggtgtctagtctggagaaaaagattgggatgtttcaaagaaggtgccaaacgtgatgagtttgaaaggagtctgttggaggtggatggtagcttacaaggttgagtgtgaattggtctgcagtcacttattttcttttagtaaggacagctatacttttatagaaacgttctagcttgagcaccccctccccctcattctcgctcttgttctaaggatgcagacccacagggcctggagtattgtcttggaagtaaggcttgacaaaagagggaagggaaagactaattaacaaatgcattaattaaggccctttgtccaagatgattccttgtttaagtcagctgttttcttgctgccctcttgcaccttagctttcctgctgtggtggctgttggcagggtgctttgggaaggactgccccaattcagacaagatgggt

SEQ ID NO: 133097 - DNA, 1056 bp, Homo sapiens
catttatggttttctttttttgatggtgtctttggttgtatagaagtgcttagttttatttttattttttttatagatgtggtcttgctatgttgcccaggctggcctcgaactcctgggctcaagctgtcctcccaagtggctgacaacacacgcaccactgtgcccagctgaagttcttaattttaatgttgtttaatatattaatttttttcattattattattagtactttatttaagtgatcctctcctatcctgaaataatgacaatattctttaaaaagttttaaaggtttatgtttcatactttttaagtctatctggaattcatttttatgtatggtgtgagataagaatcctttttttcatatggccaataatcagttttttcagtatcatgtaaatgcataagacttatttagatttgcagttacaagaatggaggagatgatccggtattatttcctttattgattatgtactctctgtcttctaggttctttttctaattccaaataaacttgcaagaggactatgaaagattatgatgaacttctcaaatattatgaattacatgaaactattgggacaggtaattgttatttttttttggaggcagtggatagatcaactatttgagagtatagattatttgggtaggtgtgagctttttcgtctaacccacacagttttaaaattcttctacctacttcagtaagaaaaagtggagcaagcagagaggagaatagtaggagaagccctgtaggttattgcaaggactttgacttttattctaaataatttattctaaatatttcttttatttctttttttttttgagacggagtctcactctgtcgcccaggctggatggagtgcagtggcgcgatcttggctcactgcaagctctgcctcccgggttcacgccattctcctgcctcagcctcccaagtagctgggactacaggcgctcgccatgcctggctaattttttgtatttttagtagagacggggtttcaccgtgttaatcaggatggtctcgatctcctgacc

SEQ ID NO: 133098 - DNA, 1041 bp, Homo sapiens
gttgaacagtttttggggggctttttgatagcttttgctacttagtattttttttttttgaaacagagtcttgctctgttgcccaggcgggagtgcagtggcgcaatctcggctcactccaagctccgcctcccggattcacgccattctcctgcctcagcctgctgagtagctgggactacaggctcctgccaccacgcccggctaatttttttgtagttttagtgagacagggtttcatcgtgttagccaggatggtctcgatttcctgacctcatgatccgcccgcctcggcctcccaaagtgcgggattacaggtgtgagccaccgtgcccggccagctacttagtattaaagctgttagtattggagcttggaacaccacctgaataagtttattgctcattccatatgatgttttgtcacagagtgatttgccccggatcaaaacggagattgaggccttgaagaacctgagacatcagcatatatgtcaactctaccatgtgctagagacagccaacaaaatattcatggttcttgaggttagtagtatgttccagatacctgaaaacatttgatcactttatcaatagtaaaagagaaaagtacatttcacctgaaagattagaagagatgttaagcgacttacctgttttgttccatttgtaacaatttagattaaatagatgtatataataagttggagattcaatgtaaatgtcatttttctaatacacccctaatggggtagtatggtttactagatagaatatgttagaattttctcctagagggaaggactcattctagtttttttttttttttttttgagacggaatttcgctctgtcgctcaggctgaagtgcagtgatgccatctctgctcactgcaccctccacctcccgagttcacgccattctcctgcctcagcctcctgagtagctgggactacaggcgcccaccaccatgcccggctaattttttatatttttagtagagacggggtttcacgtgttagccaggatggtctcaatctcc

SEQ ID NO: 133099 - DNA, 1021 bp, Homo sapiens
gaacacctgggctcaaataatcctctctcatctgccttcagagtgctgggattacaggcatgagctgccacacctggccttaagtcatttttagaaatggctagaggtgggatgtgatataaggaagtcagtatacagttatcaaaatatctttgttttcccaggaaaatttgctgtttgatgaatatcataaattaaagctgattgactttggtctctgtgcaaaacccaaggtaagtgcagaaataagatgcatctatgttctttgtaaatgcatttatttcttagtgtgtgattttgtcctgacttccacttattctttattgagcttggttgcatccattgagaagaatgttaaatttcatcccaggtatgggtagtttttgtaagttctctagatgatcataacatgcaatcaagattgagagtcactgccctagttctaggattggtcctgctgaagactccatgggtatgctgtgagaatttgcagtgcagaggtgacttgaggctattacagcaagaatgctgacttgaccagtgcttgcagtttgagtatattgccactagatgatgcctttgtttgtttagataaaagttgagaatttagtgcaaatctgttatccaaatggttctataactaacaattagttacattttgagaaacaatccgctttccttttaaaagaaggaaaaagcccatatgcacttctaaatttataactgttatatatttccttaatttgcattccatggttatgtattggtgttctccagcataacttctctttgaggtgactttgaactttctggctctgctgtctgcagcagatctcctgtgtggctgcctgttggaagcttcctctggagttctctaatcatggtactcacaatctctaaaatgagctgtctacactcattaagaatgttgaaattgcagacttgtctcgggctttggtaatcccataactgtttcctgccctgatcagaattagctaggtgcaaagggaagcagattttg

SEQ ID NO: 133100 - DNA, 1035 bp, Homo sapiens
tgacagaccctgtgagccttcatttatggctgccacggattacacacatagacaccatctaaggaaagtggggttgcctgggagaggattgcctcagccttcttccaaggagcacactcctgggcatgttgtttcagttgtaaatgacatctcacaattcacaaatcctttgccagctgtaagaactctatacagctgttggactgtagctttattttcattatgtcttggtatttctgtgggagggcagaggaggatgagcagattactcattttaacagaactggaagctaagggagtgatttataactgcatctagaaaacagactttcaaggcactgttctatgtaacatattgcttttttccctctaagaaaatagagctcttctgtatttgtgaagatttcatactggagataaggtccagtaaataaatttttccccccgggatacttggggatggaaagacgtggatgcttggatatatgctgggcttatttatgtatgtgggtatttagggaagtatgaacctgatttgactgagctaaggggaaaggatttgttcatgccaggttgtagtggtgttgggaatccagagaagcagagaccacacgtgcatgcacacatgtatacagagtattgtgttggctgcagaaatcctttattatgtggggtggtttttcatctagcttctctttgcttgtgctcaaataatttttatcggccaggcgtggtggctcattgcctgtaatcccggcactttgggaggccgaggcgggtggatcacctgaagtctggagttcaagactagcccagccaacatggcaaaaccccgtctataccaaaaatacaaaaattagttgggcatggtggcacgctgcgtgcctgtaatcccagctactctggaggctgaggcaggagaatcacttgaacccaggaggcagaggttgcagtgagccgagattgcgccattgcactccagcctgggtgacagagtgagactccgtctcaaaaaaaaaaaaaaaaaaaaaaaag

SEQ ID NO: 133101 - DNA, 1064 bp, Homo sapiens
tctcatcttcttatcatgtccaatccagcccagcctactggaaattattttctgttaagtgttagagtccagctggaggagagtgcattaaattggaagtcaggaggtcttcctgggtggcctccaattgactgggtgactttaggcaagcctccttagcttcaggttctctgactatagaataagcaggttgaaatggttgatatctgagttcttttttagctttgcgacaattctgtgattggatcaagagtcctaccattctgaaatatgtttgaatttttgtttcagtaatttttctttttccctctttctctcaggcagatgtttggagcatgggcatactgttatatgttcttatgtgtggatttctaccatttgatgatgataatgtaatggctttatacaagaagattatggtgagtattacaaggcatagaatttcaatgtagaacttttctataccgaatagtatatgctttcattcataaatgtacaaaaacaggcataaaagttattctctgctgttagaagtcaaaatcttagttattctttgggagtggttaaggagtgggcttctgttctgtttcttaatctgggagttggctacacttgtatacagtagtttccccttgtcagcagttttgctttctgcggtcttagttgcccatggtcaactgcggtctgaaaattggtgagtttgtgtaatacagtaagatattttgagagaaagaggcacattcaggccgggcgcggtggctcacgcctgtaatcccagcactttgggaggctgagactggcagatcacgaggtcaggagatcgagaccatcctggctaacgtggtgaaaccccgtctctactaaaaatacaaaaaattagccgggcatggtggcgggtgcctgtagtcccagctactcgggaggctgaggcaggagaatggggtgaacccaggaggtggagcttgcagagccgagattacgccactgcactccagcctgggcgacagagcaagactctgtctcaaaaaaaaaaaaaaaaaaaaaaaaaaggcacattcacataa

SEQ ID NO: 133102 - DNA, 1046 bp, Homo sapiens
tgttttctacttttatttatttgaatgcactagtagatcctagattaatcctttgagggagagagcttaccttaaaataataaaaaagtatatcctaatagtatatgtgagattcaagttctgatatttttgaaaaatcaaatatctttgcagtggaatgaatatggtagaaaatgtctaattcttgttcagtggagatttggccttcctaattaatagtatttactaatacttgtatattctttgtttctcctactctgaatttcattttttagtttttcatgtatttgcaagttgaaaattgattcaaattaggacttttatgcattattgtggaatttaatttcacacattatagattttgaaatttattgtaatcttggctcagaactattgttccgagtcgcagtgtaatacagtctgctggttgaatctaattaaggtgtcgtatcacttgcatgcagtatgtatctttgcctagaatgttctaaaattcctcacttgggaataacactttcctcagttcttggtttgattgaaaaacccagcaatatttgacgcaccgtatgtaactcttgtttaaaaggcagacttcgtttatcttttgcatttgttgactattttaaccaaaatgctcaactgcactttctagcatgattactaatggcttgagtattaatcttattaatgttacctatattcatttgtcatcactgcattcaaagacaagcacgagtgtactccagctgtggtatacaaatattagggaagtataaataatttagcaattgaaaattgagtagtttgaaaataaaattgctgcctaacaattacaatttataattttaaggaaaatgagcaagttgtctctttatgaaattatatttttacaattacggagtttactacagcattatgattatgtattggtgagatggcctgcctctcttagaacagtgtgaaaaacaatttcaagccactggaattcccaggattattttgcttagtccatagatcttttctccctctcttcacttggattctcc

SEQ ID NO: 133103 - DNA, 1032 bp, Homo sapiens
cctgttatcttagcatcattaaacaatgtgatttctgctgtgagaaactgttgtattgcttcctctgaattgggaaagaggatgtgtgtggtaagtgtgtaaagagatattctatcatgtattagcatttagccaagtccctgatcttttctttgatgacttggtggccataatttctgagtatactaggttgtatacatttgccttcttagtctcttttagtcctaaaagaggtatttaccttagaaagtggctttcactagttttcctcaaagattgtgaattctgttttgtggatgacctgtttttaaccatagcctatgtactgtcaccaaatatgcttttctgctgcttcattttgtcaactgataattgctctgaaattataaactaataattgtttcagcagtataaaaatagactacagtgtatacttactgtccatttaatactacagattccaaagctgtatgacatttttgttttctactgttatgttctttgtgctctagcccttctctgatatgtggataatttagaggcaatgatagtatttaatatgcccgattttttctttaaggcaagaaattgtttttttttttttttttttgtgatggagtctcgctctgtcacccaggttggagtgcagtggcacgatctcggctcactgcaacctccgtctcctgggttcaagtgattctcctgcctcagcctcctgagtagctgggattacaggtgcctgccaccacgactgactaatttttgtatttttagtagagacagtgtttcaccacgttggccaggctggtcttgaactcctgatctcaggtgatctgcccgctttgacctcccaaagtgctgggacttcaggtgtgagccaccacgcccagccaagaaattgattttttttagttaataatgtttaccaagtattgtagttgggtgaagtcttcaagcttaaaagtaaacctccagcatgttattacctaaggaatttgtgtcaaggctgattgaacctgaatctcttaaatg

SEQ ID NO: 133104 - DNA, 1012 bp, Homo sapiens
ttacctagtgcagtggttctcaaacttcagcagatatcaaaattaccccgggcttgttaaaatacagattgctggcctccagccccagagtgtgtaattcaatagatctgaggcaggactgaaattttgcatttctaacaagctcccagaagatgctgatgctgcaggtcttggggccacactttgagaaccacagatttattggaatgagcctctgagggtgaaagataggagtgctgaagcctaggtaagcactctaccaattaatcaatgtatcacctaatctgatctataaaatgggggttctgagcctggcctcactgctatgtagtgttataaggacaaaatgagattgataggaaacactttgaaaatatgagtatcttcttagtgcaatttttttttcattatgtattcagaatatcttctggttttttcatctattaagtcatctccatcttttattcaaaatttacctcaggctcactcaccttgattaagtagggccagaccaccaaatctccgtaatgagattgaaaatgccttactctttcttctagactccaaaataacgttaatctttgttgattaatttttctctccttacatttgaaaattacaaatggaaaggtgtgcttttcaacttgttctgtgtgattgtaagctcattggaggtagagattgcatattcagtatgaatgccctgcattgtggctgcttgaatgtttaattggtgaatatttcccgtgaataggttttccagcaaaagactattacatcatacaatagattgaacttcacgaataatgtccataccaatgaagttcatgtttgttaaacatttatcttctaagcctgtgttggttgctatagttttcttgcctctgttgcctttttaaaagaatttcttccaaggccattttaaagtctttgacagcatttttgtgatgataaagtttacatctgttctgatgcatttttagttttcaggaggaaaggtgttctatgttct

SEQ ID NO: 133105 - DNA, 1058 bp, Homo sapiens
tctcctgaccttgttatccgcctgcctcggcctcccaaagtgctgggattacaggcatgagccactgcacccggccagcaactagatttcaaaagaagaaagaggataagccctagtgctctagcatttttcaagcttctgcttgcattgtacttactaatgttccactggccaaagcaagccatgtgacaaagcccagagccactatggaaggtgtatctttcaaggttgtacaattcttattccctatttatagataagggaacggaaaaatgaaaagcaactatttaagatataaatgtagtgagaagagtggcattgctttacatctttgccaatttctttgaagtctgtcttattagaagacaactcatgtgcttctgcattcagcctgttttgataacatcgttttgattgaaacaaatgaagaaaatacagcctcacacagatatgtaattagaaaaaatagaagtattttaatagtgtttccagataattggggatattctctgatatgtcaccaaaacttttgcagtggactaggacatgtgcatgaatcaacacaacagcttagaggtgtgtctcagatatgccacagcatagaattggtagagctgtggggtatttgctttctggaataatcacaccaatgtaaatatccttcccagtagccagctcgtcttggaaagatagactatacttgctccaagccctttctcactgttctgcccactattaatgggccatgtggcctgagctgaaatcactcctgattctcctatgactgtcaactcctaaaacttctgttatctaaattcccccagccctacatgacatctttaatatctattgagcaaatataacataattctaacagcaaccacaccaagatcctaagaaaagcagaatgtgcaagtgtctgagcagtgtagcagcagaaccagggaagctgtgatgtgccccttgtgaggtggagagagtgggtggtgcaaatgcctgtgttcagccattgggggtcatcatttctccatgtgcggagggctttgcacatcttctca

SEQ ID NO: 133106 - DNA, 1103 bp, Homo sapiens
aagttatgagtgttccaaaagagtatacagtttcccttacatcttttttttgtttgtttttttgaaatggagtttcgttcttgttgcccaggctggagtgcagtggtgtgatctcggctcaccgcagcctcttcctcctgggttcaagcgattttcctgccttagccttccgagtagctgggattacaggcatgcgccaccacgcccagctaattttgtatttttagtagagacggggtttatccatgttggtcaggctggtctttaactcccgacctcaggtgatcggccgacctcagcctcccaaagttctggtgttacagatgtgagccaccatgcccagcctcccttacatcttaatttaataattgctactatttactgagcacgtagagtagaatagtgtactattttagtaagggctctctgtatattatactgtggtaaaatataggtagaactgttaggatagtacctttaagagtcaggcactatcctatgggctttatgttgtgttaactcctttaatccatttaatctgtacgccaatcctccgaagaaggtactattattgcccctttttgcagatgaggcaactgagacacagaatcattaagtaacttgcccatggtcaaacaacgagtaagtgtagaaccaggatttaaacgcacaccgaagggttctggaatggaatggatctgataggctagctgattcaagctcagggcccacgtcctgtgtatttgcagcctttgtggcgagcattgcttatctggtgtctgttgaagtagctactggagcagagtgatggagaggtggcattgtgttatggtaggaaaacctggggctaggaatgaaaaatgccagtcttaggcagatcacagtaacttttctgagtcttcattttatcacctctaatatgggtattctaatgtcaatctgtgtatgtttgggtcatgttttgccatttatagagtaactttacatgttgtatcattaatctcttttgcctgccttgcagagctgttacaggatcaaatgaattatatacaggagaggcataatgaattgttgttgctttttaaaggatttgcttttctctt

SEQ ID NO: 133107 - DNA, 1131 bp, Homo sapiens
aaccttgaactcttgggctcaagtgatcctcccacctcagcctcctgagtagctaggactacgcatgtgagccatcgcacctggctaatttttgaatatttttttgtagtaatggagtcttgctgtattgcccaggccagtctccaactcctggcttcaagtgatcctcccaccttagcttcccaaagccctgggattacaggcatgagccattgtactttggcctggggcctcttttataagtgtaataaccccatttatgagggcagagcccacttgtgacctactcacctcccaaagacccaacctcctaatactattacactagtgattaggtttcagcgtatgaattgaggggaaaaatttgtctttactgtttcttttcatgatggcagcctttctcttgagcttgttgttacaagtgtgatgttcaaaacaagggaagctcatgatattgccctgccttgtgctgggcagacctctctttcttgttatgtttggttctgaatacttcactttgatgtgtagtatcaacctggagtgtgatctaaagaaagggccagaatagtaaggggagttaatcattaaagtggaggttggcggaactagaaaacggaagacttgcagaggaaaggttgcttataataggaatacgcaaatttctgaaaggctcttttagcacagaggaaatagaattatgactgttggtgaaaataaccagtttttgagggcctactctgttgagatgttgtactaggcgcttgctctatgttgcatatattgcagggcacataccatctctctctagcagatgatgaaactgagactcagaggtgtggtcatgttcaaggccgcatggttattaagtcctgttgcaattaaaactaaggtctgtctaattcccaagcctgttagccatcagtttgtaccaattcccagtggacagagatcacagggagacagacctcaggcagcaggagggagatgctaaccattccagctgttctgtgtaccctggagaggaggcctttaagcagaacataaagcatccctcactcgggctgccataaagagagatttttttttttttttttttttggagatggagtttcactgttgttgcccagcctg

SEQ ID NO: 133108 - DNA, 1065 bp, Homo sapiens
cttccctattcaactttgagaacgctgaaaccaggatttgtatcctatttgcagtgatggtggggaaaatattggaagatttatctccagggaaaagctaagataaatatcctactatattagtggttgggagttcaagttcctgtccgttcatcttagagaggagccttcaaggtattgagcagccccatcatacacatagaacctctcatcagctgtgtaacgtaattcttcacttttaagtagaaacagacaaccaaaaatcactagaaatttgaggaaaacttctaacatgaaagtcggagatcaaaacaaatggagtaaggtggggagaggaaagaagaaaaagtagatactgagaaaaaaaaaccccagatatgcagggagcgggagaaaatggctaaaaactgctaattaatattctcagataagagaagtgattttcattcttgacataggaataagatgaataaaaatgaacattccaagagatagctcttgaaaatctaaaatgtgaccacagaaattaaaagctcagtaaaagtgtttgaaaatgaaattcatttgaaatcttttaaaagtagaacctggtgggctaggtgcggcggctcacacctgtaatcccagcactttgggaggccagcgcgggcagatcatgaggtcaggagatcgagaccatcctggctagcacggtgaaaccctgtctctactaaaaatacaaaaaaaatagccgggtgtggtggcgggcgcctgtagtcccagctactcgggagtctgaggcaggagaagggcgtgaacctgggaggcagagcttgcagtgacccaagatcgcgccactgcactccagcctgggcgacagagcaaagtagaacagctaggcacggtggcttacgcctgtaaacccagcactttgggaggctgaggcggcaggtggatcatttgagaccaggagttcgagaccagcctggacaacatggtgaaacctcatctctactaaaaatacaaaaattagccaggcgtggtggcatgtgcctgtaatcccgggtactcgggaccctgaggcga

SEQ ID NO: 133109 - DNA, 1032 bp, Homo sapiens
aaacatatagcaggtcagaaatgactagcattgctttcaggaatttctaggagaagtgaagctgttttttatcatgtcatttgcattagttaaaatgaaagcatatttgtcaatttcaatttattctcaaatgataccaagtttttcctctttttcacgtttataaaattgaatcatagcatcctaggatatcaaagctgaaaggcaagttagagctcatttaatccaactccctttttcacagctaagaaacctgagactcagaaggagtgaagtgatttgcccaaggtcatatacccaggtttagacctttcatgcccatttaccccgacttatgactcaagctgacgcctccgctgagcctttacttatctggatctccagttgtggtgtctggtcctgttctgccctatggtattactgcctgtcctcagcaggcagggtgaatccatgatgcccttccagatatctgtctttgtccagttatcacaacttcctcatttcccttggtttcctcttcaatttagtcatgagcagttatttaaaccatttcctttatgatacttcactgttttggttgctggcctcatctggacacattctatttgatcagactgcctcttagaatacagtgcctagaactaaactgagttttctagactaggtctcactagggtagagtggtaagtgtcatgacagtagagactctctgccttgtttattgcagcatggcatggtctgtagtaggggccatacctgtctggtacatagtacacagtactagacctgatgcctagtacataataggggccatatttatgtaatgaattaataaattagagcccaaaggaattttatttacagtgatcctgtttatgtcactttaaaaaatgttacctaaactttattagcctttttccccccaccaattgtgaccttctcaagtttcaagattctaacaaacctaaactctggagcattgccatgtgaactgctgggaaaccacatcctgccattgtgcttctagtgtac

SEQ ID NO: 133110 - DNA, 1008 bp, Homo sapiens
tataataaaattaaaagcatggcctaaatttgcagtgaagaaaaaaaagaagagccacacatacaaagcaaaatgattttgtttttattataaatcacatggaaacatttcttgaaagaattagagccttcgacatcacaggtcaagtgattatactgtttctgagtcaatgaataatgtgatacctgcattattattaataatagaaatttcagaaccatagtatgtgctgcatatggattgtgtttgttctgtttctaatagctagaaaccagtgcctgaaagaaactccaattaaaataccagtaaattcaacaggaacagacaagttaatgacaggtgtcattagccctgagaggcggtaagtgtttggtttttttagactctaatctttagtatatgtaaccagatttcctttttcatgtattaatagacctgattaaggtaaatcatcacatagattctgttggagagtaggaatatctgtttatgtgtggatgacctgtggccattcctggacctgtagccactgccttcctcatggggtagaatcatgaaactgatcagcagtaggacggcaccttaagtacaacaggctgggaagacagtggtcctcaccccagccaactagttacctctctgaggcccatcttacccttctcttctgccagtaaaatacagatatcctctaacagattgtagtcctcccaaatcgtaaagatactgttgtttcaaagaaaatcctctgtatgaaaagttctgcagcataggtaactcttcaagttgctattcttttatagcaatttcttaaaggcattgtctattttcaagacaattggagaattagaatgtggacagggtattagatgatattatggaattattattaatttattgatgaagaaactgaggagatcaggaataaaatgatttatcaaagctatatagtacaaagctggagccagaacccaggtcttctcattcctaatcttatggtttttctcccac

SEQ ID NO: 133111 - DNA, 1086 bp, Homo sapiens
gatatatacattgatgtatatatatcagtgtatatctatatacatatgtacattaatatattatctatatccaaatagaaagcaaatgtggcaaaatatgaacaattgttgaatctaggaggatataccggtgttcattgtactcttctttgaacttttctatatatatgaaaaaaggatatatatatccttttttaaaaaggaaggggataaatagttttgctgagtggcagttgcctggtagaagtgtgacagctcctgtccagggggagatggctttggtgcttcctgaggaagagagaggtgatctggccctggcatacctgagtgaggcatcctaatgtgtatgaagggacaaaagttcacccttgtggaccccacaggccggaggcccagctctacttgtgccttgttttatgttttgtttcaggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaaggtaagcaggctggaattctttcatatggagcagaagctgactgctaatggactgccttttttttttaaggtgctgaatgaattgattagtgttttttatttgagtatttattcacttagttaatatatgttttttgagcaactaaaatctgcatgttactgtgcagtcagtaaatagatacagtcactcccttcaaggagcaaacagctatcattcaaatattcaagaacaggtggagggattagtcacaggggcaacatggaggtgaggaagcagggggcacagatggagagctgagagctgccttaaggagggggacttgagctcagttgtgtccctgattcatggatactttgtaggccctcatgaaatatttgaatgcatgggaagataattggaactttgagtgtggtgtgtgtcaggaaaatagtgagtgacaagcggggaaggtaggccggaagggcctcaaggcctggctaagaaggtg

SEQ ID NO: 133112 - DNA, 1031 bp, Homo sapiens
aatcacttgaacctgggtggaggctgcaatgagctgagatcacaccactgcactccagcataggtaacagagcgagactctgtctcaaaaaaaagagaaaatagaagttgatctcctcacccctgtgctttagaaaaaatgtatttctcccacctcattcccaaaagcttttgaggtagtgttattgcttataatttattctcttttgtttggttcaagctataaaagttttagaagcacagatattgtcccactttatttcaaaataggaaaattcaaaattcttctggctttcttgtagatcctctattttcctttgattgtctgctttacaataatatttataaattataatctaaatttgtgagacatttcaaatgaatcagggatttatacagaatccttctcttcatgactggctgttttacagggctgggttttcagtgctttaggaagttttttcaccttacctctctcccgctgttgaaggaactgccatcaaagcctccttggttatgatctcctggtctcaatagccaggcctcttctggtcacccaagatggccgtatttctaagcatttccattcaattatttccctttaaaatttctttattaaagcaaccagaagagacatgcatggatttaaacatgtaaatagaatagtcaatatagagtaagatttgaagaaacaatcttgtgcagatataatttttagtttttagttatctgtaaatgttggcaagcattccttctgtgaaccctggcattcctctcaggcttcattagaacacatctctcccactctgatctcttcttcatgcttggggctatgagcctctgggcatacctctgtcacaggtctctcaatgatctattatctaacatgtgactaaattgttctatgcctcatcttcttgtcaagaatcttaacttcagggtgctccttttggcatttttgatgttgactgcttatttttgagagatcaagcctctttcccaaaacacatgactaagttagtaagaaaaaga

SEQ ID NO: 133113 - DNA, 1727 bp, Homo sapiens
agctttgcaggatcatacgtatgtcttaagatgtgtttcaggcttcattttgactgggcctttccattctcagagtagataatgcggcagttctatctataaatgccgtacgtttcagttatgggaatataccatttccttgggctttttcttctgcttttctttctgccataaagtgatgtgatgatcgtcataagaggttatctctcattactaattagaaaaacctcaaaaacacacgtgcctttctgacaggttactggcttcagctttatttatatgaaagacaagtttctgacaaggctcacacacatgaaatattatctttcttgcgctttcctttgttgtgaatgttgtggaaatgcccaatgtttgcggattacacgttgaaaggattgcataaagaatgccagatttcttgagcatgaatggcatgtatagctatgaaacaggggcttttctttggagcaagggagacttgtaataaagccttttcatgcttattcttaggatcctagttcagtttctgggaaaacaccagtcatactctattactaaagcatagctaggtcatttggaaactgtaaacagtaatacattgcttaatatgaaataatggttcatttcctccactggcctcctagaggcttagaaaactcttatacagaatatggttctcctactaactagcttcttatcttgtttttcacagttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatatagcaggcttctcttttttgtatttgattttgatccaaataaaacctcaaatggcttcctgactattaagtagagactatttggagtatgttttatctgttatcaaatatgccttgggcagaaaaacagataagaattcatttgcataattttttcctgtctgatttaagtaggatttattgagatcgttaactgtcacagctgtggttaccagagttaaacaacacatttaatatgttgaataaaagagtattgactttaagtatgtttggtcaacaaatgataagtatccgaactatgaaccccccctgaaatgttactttatggtaatttccctaagtctcaatgttggccccaaatttgtatttttatttcattttattggtctccaaaggctagaactcaagttatattggtatggatttcaccaattaaactagttggagaaaaaatagcactccttctggtcagtagtgaagggaatgttttgtcat

SEQ ID NO: 133114 - DNA, 1061 bp, Homo sapiens
acattctgcttcggaaaagtagctgaggaatctcccagacagttttctttgagttctttgatctggaaaagagctgctgatactgcatcggtcccagagaaatggaggcaggaaaccaggacatctccccaaagtgtgctcctcttggagaggggcctcagggggagcctgcagcacaaccagcccagtgagactcctcgtaaagatactaaagaaggagggatgagcaggaggctggggcccaagggcagcatcctccatcttgaggacagctctgagcgcacctgccagggtcacccagggcagagaggatgctctgccataggtctaagatgtccggtgatgcaccaagagtgcgagatgcatcatgggtggagcagtcttctcagtcggaccttcaggcccacagaaaagcaagaaggtatttacatgggtgctgctgaagcaacaaaagcaagctctccttcccaggctggggtggttatgatggatggatagtcagacagctggaggacaggcaggctgggctggggctgcggttatttgcaggacagtctattggtttgcagagacccagtggccatcgggagaagctcatagattggcttttagaaatagacaagcatccagaagtccaacggccccaccaaagggccccagagtccctggaggaagagaggaagaggggagcttcaggcaagtgggggatgctgggggacggtctcatgggctctctggctatcttcaggagggctgggtggctgtcaccctcaataggtgccatcagtgtttggtgcccgcctggctccaagggtcagtgacggtcataggcagtggcggctgcaggtggggcggctcctcgggcggcagcgctataatagtagggggagcctggaagagacgggagagagcaccgaggtcagatccggggtcccctttccaccagtctcctccacttctgtcctttcctcccctcactcagtccgggccaccatcctctctcaccaagatctctgtcccagtctgttccccagatggcaagtcccatcagggccacaacc

SEQ ID NO: 133115 - DNA, 1025 bp, Homo sapiens
tgggtcaactcaaatagtccatttaagaaaaaaacattaggtaagcggatatcttggttcgatacttagaactaattttgaccaaaaccaaaaaaggagtctgagaagagatcaatctgcagattctgcccctcttggagaccacagataataagaagctaggagtcttctgcaaggcttgcaatctccttgcacagggacctgcagcactaatgggaattgtttcttattgaatccccaagtcatgcatgacacaccaaaatcctttggacagcccaaggtcccaagagcatggaatggtagtagcaagagagaagtggtttccatactgtgtgtctgtcctagccaccaaatcaggtttgggaaggggtcaaggctgagattacatggcctttttcacagacctatggtttggcaacttgagtttgaagacaccaggttatggcttttctgatgaagcctgtttctcagtcccaaaataattaaggatccaaggaattaaaaggttcttccttaaggaggccttgttaagctgggcagataaacctgggtggtctcagagggcccttccatgtctgaccttttactgctcgaagtagaaaattcttagctgactgctgggggagggctccatgttgctatctgcaggctgattggctggctccacctcccagatggtgagtgacatctttgagcccatgcctctacttcatgtcccagaacctttagctccaactggcactcactagctggtttcatgtaaggtcagtccaacaaaacagagggctccccttggccttttgaaagctgagttagacttgcatggtctttgcggtggcccaaatcttgatgatgttcacagatcagactgccaccagtcacggacaatctgccaatccaaggcttgggcagagggtgggcaccagctgagccctaaatggcatgctttgtcagacctccagccacaggcaaccaggttctaacagagccggctctggtgatgtccatgcagacatcactaatca

SEQ ID NO: 133116 - DNA, 1021 bp, Homo sapiens
aagtacagcagccacccaaccaaccagtcccagcttccagtcacagcataggtaagaggaacttttaaaaaaaatttaaaaatctaatgggctccaaatattctaaagaacttttaatcattcttatggacagataattctgcataaaacacttcagcacacgtactaatgcgccttctttgtcattctccaagggctgaacctggtaaatgaattttataaatactgctaaaaggttttgaattttactgattattatgataaatagctttcaccatgagacagaaaattgaaatctaagccaaaaaaaaatccactaatgggggtctatagaatgtcagataattaaagtaataaatcaagaaagggatacttattcataacattttctgcatcattagtcagtaagtagttttgaatgtgtttttttcttctatcaaccagcccttctacaattctttgtgcacttgcagtcttgagtgaagatgtggcaaaagttcccaaacttactttctctctctctcttgcttcgatctcatgaactctatgaactgtcaagggctgccagtggggtttccagtgctcgcaggtgacgtctgagagtggctgtgacccgacagagtgggagtcatacttcctagtgctcaagagttcagaaatgtcctttgtcttcccttcaaagattgtgaaatgacatgtgtctatttaaggtgtattatttctccacttgggatacaggaaacaccgctggttagctgggggaaaagttattgtactatataagaaagtgggcaatgatttagcaagtctctgacacttctggttgccacagtcaatcctgcagaatcacacctcagattgtgtaacatttccacacttttgttattccttctttaactgagaacttgaactcacacggtgatggggaatgggcagagtcctggcctccagttccaactttgtcattacctcacccagtaaaatgtaaaagttctctcacctccctgagcctcagtttcct

SEQ ID NO: 133117 - DNA, 1014 bp, Homo sapiens
ctaaataagagagcacgttatgcccagcacaattttcaagtacagacggtacaaaatcctcttaaaggccataggggctaaattgttaaattcatttttctacatttcagggaaagagataaatcctttgacccaaggaagtcagtttttattatggttctgtagtttatttttggcatacattcacaggtgtgcctatggctctattcttaatccctttcctttgggatggctgcaagagtagtacaaacttgtaactttgtaatttggctttttaattttttctgtgctgcactggaattatgttttgtcttaagtccacactggatcctcaggatggatccagtgaggattttgaaagaagcataattcctttgacttcttttagaattaatttacctattaaataaaaaggaaaggattcatcttttattcgaattcctctgaggctaacaattcaatataaactgatgaatgctgtgagcattattcagacaatcacattcaatttgtgtgacagtaacagcatagccacctgaaggacagtgcaacaagggcacaggtatatgataccctttagaagaaaagcattacaggtgggtttatttgtttctggaaaacaaacaactccagtaggaatgtagtacatttttggctcttgtccatttggtttttgggattaaggtggttctattaccagaactaccaccacaacaccctggtatttttgggcagaaatttgggacactaagaaaacaactattttttattttatgtgtatagctgttagtggaagaaagaataaataggcatcattattgctctttaggctgtccctgattttggacacacacttattttttcagggctctcattttaatcagtagtccatcagtacctaatggaaacatctactgtgtagagttttggttgctgatgctagaatttaagactttggagtagtcgaaagacaacagagaaattcatctcataatttttgtattttaagcacat

SEQ ID NO: 133118 - DNA, 3878 bp, Homo sapiens
gttacatgctgtattggtttgtatcctaggagcaatagaccataccatgtagcctagttgtgtagttgactacaccatctagtttgtgaaaatcatcctatgaagtttgcacgatgaaatcacagaacaaagcatttcttagagtgttgactgtgtttccatcaataactataactcaatttgtcagtagtaattctcgttggggagtggtgggacttacaggagtgggtcctaacaggacttagaaatccttggaaaaaaaggtattttaatatgtctgagaatagtgatggccttcatattagcagttgtcactgacaggtgatattgttacttaaactggcatgatctgaacttttaaagtatattctgtgtacaactttctcttttgcagcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggttagtatcatattggccattttgaaagtagtatcatctttcataaggaggactgcttttcctagagaaaagaccaatagggtctactccgtttaattcctcactttttggtcttgttttttggtttgtttctcatgcgactctcttaccagtggctactctaatggtggtttgtctgaacgtcagaaagagtatgtcagaataccaaagacactctgcttctgctgtaagcagattcatagctgcttcttcctgtttggctagagccagttctggacctgaaatcttacttcccccctctctctctgcttggtaccacaggtgagtactccatccacctctggcattagccctgtgcactcattcagccaactctgttgggactgtctcttcctatgggatttgcttacccaggagttagatggcaagcatagggaatgtctggcacacagaatatatggaattagtgttaggattaggattttaggtactccacagtcagaaagacaggaaaatatgaagagctgtaagtctagggcaggttataggggagaatgcaaattttgatagctacatcatcaaggattaaaattttggtgttagttatgtctctgtgacatgtagtcatctagtcttaatgcttatgccttcaagaagttccttttcatttccctccctttatgcctaatgctcagtctcttgcactagtttcctaagtagtcttcttttatatctaccctgtacactgttgttaaaactggtattgaaatgctcttttactcatagtactttattgctgctccaaaatttttaatggcagcctgcttccctagaaatgatgacattgaatgtagattgtgcttggagcccctgggattggcaaatgtttttttaagaagccagatagaaaatattttaggattccaagccatgtgatatcttaactactcaacttggcccttgtgggaaagcagccttaaataatacctatagaaatgggggtggctgttctcagtaaagccctacttacaaaaacaggtggccggctcaggctgtagtttgcaaaccctgagaacttgacagcaaaacgaaaagagagaatagtagttaggacagaacagaatcgcgtaaagttttttccatataggtgagctctgataatgtttgtaggtagaaagaaagaaacttgtgaaggagagactaaacctgtttgatggattgggttgggggccaggttagagataggatcaggtgtatgtgttgttgaattattcctaaaaaggaagagagacactagtaattgctaaatcatcaaatatttgtagaggtagaggagaaagaataaattcagatggattgaggcagatgagagaacatatggggatgtgtttgattttcttaggaaaatgaaagcagaagtgggagagggcgggggataattggaagcttagaatgtggaagggatgtttaagtgctgtggggaatactttgaggcagtggttaccagtattttgaagatgacaacctgtgtaactttgaaacaatttgtggaccacccatggttgtagttatgattttagtattcaattgagaaaatgcatattagaaagaagctactactcttacatgactttgtgttttattaatcacaacattgatatgtgagaaatagtgtttataatgcgttgctctaggtacccattaaggtaactaattctgcagtttcccaggaggctgaaggctcttaagttggaaatcattgcacttgagtgaatcaacagtaagagaataaaggattgtttagaagtagtattcagtcaaaattaaaatgatgtgaacttgtagtgaactcactttgaaggattccataactttatccagtaatacttgtcagcttggagcaagatgacagaaacaaaatgatcttgggttaggcgtaacactatagaaggccaaaataagcatttagcttattctttctctaaattaccttttcctgagatcacacctagtttcattaatcacttctgtatttatggtcatcaaattgtcatctccttaaccattttgttgatttcaaattctctgtgtacatctacagaatatttccatttgggtatcttactgtctcacatttgacatactgaaaagaaagcttgataacttgaaaaaaaagcttattatctttcctttgaaacaactccctgctgctttctgtttgcactagagaatctacagacatgctaaagttgatggcacaatgtggataggttgggaaaaacatgaattaggtgctggatttagtgaagaaatcgaactgtgccatatttggcaaatgatggtgatgagaaagtagagagaaccttggatttgttttctgttttagccaaatagaattaaattctgaatttttggaaattaatttacttgactcttataaactcttacaaatactcaaatatatattctccattttatttccttgatccactaatgctgtaatcctatttccaattaataaacaacatatttagtactgatgcccatttaagtgtgttgttactctgtaatcactatccctctcataaaactatctggggatagattggttcatataatctttagagagaagatttttctcatttctgtaaaagtgtagagaaaatctcaagtactttagaaatgcctattgttaaacagtatccataattattttgtgttctgtttccttgacctcactcaagaaaaaaacaaaatatctcccagaattatggcatactgaaaactgcagtatgacataaaagaaaagactacaggctccttgaggttgggtcttttccatactcataaacc

SEQ ID NO: 133119 - DNA, 5980 bp, Homo sapiens
tttttttagaatggaaaagcataaaattagatgggcaacattttcttccttgtcagaagagcttgaatcctgatgtctttttaagtgaagagtgtttatatataattttcttgtagcttttgtttattataaaaataattattgcatatagtgatcacttatctaagaagataagtatgatttatatagacagtatatttttatggtcagaaagtaaatttgatgtgagctacatatgattagacagtaaaacttttttccaaagaaatatagaatggagaacatttaatcattatttccccttcttagagtagaggctgttcagataattcatattctgtaagtaggagatcctgtttttaagactttactaaatttaatttcaaagtaataatctcttataaatgcttccttggtggttaagacttattaatgaagcaaaagtatggacttcatggaagttttcagcctaacgttttaaatctcttcattattatttatctttgttttgttataaattaaagatactggcatggttaacttttggcattttgagttacttgccagatatttgttgattgtgcaaatagttaagaaataaatattttaattgggcatccaccatgtattatgtcacattttctttttaaatcatatgcttaagaatacttaaaggagtatgacttgctttttagtttgaatcttgatctaacagcattggttctggatggagatgtaattctagagataaaaattatttctgttgtgtagatttggattctaaatgtaataattattttaaagtggatcttgtctgctaaatgtatagcttttatttctataacaaattcttaccttagaattccaacttttgtcagttttgaaaattagtttattgtggacttgagagcatctgttcttaatctcgtgttttgcaaacacgttttaagggaagacagcataaatctgtgatagtgaaaatcatttgtacttcccctccctcgcttttgcttaaatatacaattaacttataaccacctcagtgtgaaagaatggatgttaagtagcttaagaggtatttattaagggaaaatatttttattggcagttcccttaagtcatatttgttttgtaactaaatagtgcttgcaacagaattatctatcatagggagggaaagctccaactcttgaaaacttttcaatactttttctatattggtagttaatgagaattcttaagataggaaatagactggttatgactggtaatatgatattgctaatgtaatacaaattatgctttaaaaaagccaggtgaggaattcaggatttggaagaatatgacatacatatacatttaactaaagaaaggagattttctttaaagagaagatgtgcaaccacaatcaatcctgtaagttagtccttaatcctgtactagccagtttttagtattaaatggtctgatttaacacaaatgaacttttgtcaatggttttatttagaaatagcattacttcctacttttaaggaggattttaatagctaataaaaattcgttgttctgataagaacttgaaagacatccttactcccatataattgagtattttgctcttcattcaacacctcagcccttttggtttgcttaaaaaatgatacaaattttgtgggagaataaatataacttaaatattgctgtaaatgtgttgtataatcatattttagcctggtattattggttcttctgtgtatgaaatacttttaaacattcaaaatattcaatttaaaagtttctggataggtgagtggtagagatccatcaggtacttacttggttgtggaatatttgtgttcttgatgccatgacattttaaagttgtattaatccctttatttttctgtttgagatgattcagtttgggaggttttattatcagatctaacagaagaaacgtaagtgttgtaccacaggtcatctaattttcaaaccatgttggttagttaaactgactttggtgtataattatgtacccggtagtcagaggagttcaagtcgattgcaattcaactctgtgattgtgccaccagttaggttaacatcagcagtgaagggccttcattgtgttaaatttttaaattccgttaagattatttaaacatagaaggagataggtttgtgaagcaaatttctaaagcagtattaagcaaagagaatcttttcttcctcttcttttagatatatcacatacatgtgtattttgattaaaaggaaaaaaatttaatgcttatagtataatgcgcatacttatttcttatttttagaatttattaaaactaataaaatttgtttggaaatctcaaaagatctttagtagtatacctgcaacctcagcagtccctttttatccatacagattctctgcctattgtggccgtttgctctaatttaaatttcccatggctttcggttgcagacttggttttctgcaagagtgcccatgcttacatggtcatatattcttggtgacttttccactttttcttttttgttattttgttgattgctaaagaaaaaggggaatttttttttttaaatttgtttctttgttttgatctttcttccttagcccatctatttgtgtgttctttgttttgcagattggaaagaattattgtgtggtacttagatccatggggactagcaggggaaaactaattttgttcttggttttgttttcttaataacagaagcaatttaatttttgagccattgagaagctgaaaagatatgttagtgttatgcatgaaattgatgggaaattattaatcctgaaaatttgtattcatggtcactttactgttggaataaaaatgttattttatagtgtaaccaagttaatactagaaatactaattaacagtaagtggtactgttataaatctttaatttaaatattattgtatattaagtagttgtttacaagaaatctgttgtaatctgataatgtgatttctcttacattcaattttgtggtccacagtgtgtatatattcaaataagcatatgaacatgcctttgacggtggacacatttttactttgaccagatcttaagagtttgctttttcttggcaaaacttgcatactttcaaatgtgaggaattttgttttataacataactttgtactgctgaatttaagtccttgaagtgctatggcaatttagttattgttagaagtcaaaagtagaggtctctgttcccaacatctccccaaaatattttttcattaatattcacaggctttaaaatatcaaattattgtgatcaaagctacttctgttttacagttgttttgtgaggctggtgtcatacagtaacatttaactgaattttgtatttgctaaattaacataaaataataaagagatcctttttaccatttaaaaaattctaataatttcctaatcaggaaaaatgatgttatgatatactgtaaataggctaaaaaaaaccttgtaatgttgatacatagggaaaagagtaattttgataattaataattttagatttttttcctttgattgtacctcatggttgtgaggtgtctaaaatgctctttctgcatatctgttaaggactttgggaattggggtaagggcaagccttctttctgtgtctgttaattacaggttttttcttgtggatgtagtgctcttagaatatgaaactgatttatagaatttgtaattaccaagaaataaatagcatcattgaattttgttttctttatttttgctattattttctagttactgtgcttcacattttgatttctatcaaatgacttctcaaaaagcaatttcttttaaatcagtgagtttcaaactaagaagaaaatgtatcctgatagtctaattagctgttgtttgtccatgccaattaaaataatcttttgaatttctagtctttgattatagttatataggcttcatgagtttgtaaaactattcctccttttaaagtattttaaaaggtgtattgtaattttataattgatattcatatgtaattattgagaaacttgaataacctaaaatatatttctagtattcagcacatcaaatcaaggtataacctgtgatataaaagtggtccaacagaagtatacagctttaaaaataacaaggaattaattctgttagcatgttttactagcaaatgttcgtggaaaatgttattaattcttaaagctcagtgcctgggttttattgtgtgtggccttactaggagaacactgtagagccgaacttgaaatttattaaggaaagaagaaactggtgaagtgcttttatgctgttaaaaaaacttcacagacaattgtcagacaattttttttttaaaggtcatgattgcttgatgccttttccagtctttatttgaaactctcgttttgtaggatttcttttttgttcttcctcttccttttttcttttggcagtgggtggaagattcttttaaaactgaatggctaaacctgtatggtaactattgaagtatgatcgaaatacttttattcatgatttttttaggccaaaaaatgctatgaaggtaagccaatgatggtaaaattacattgtgttgcgtggaaactgttttagctttagcgttttctgttcagaaaagtaggctctgcattagagttttaaattgggatttgtttgtgaaatattttgtaattctcatattgctgattgcctttatgtctcggtgttctagtagatagttcgtagttcctgaaaaataatattctgtgtatgaaagaaaataggaggtgagaacagaatgagaattgggaaagaaaaccccctacccaaaatgccgccacctaacaggtggaaatatctatgccattacagattttcaaaacgtagagtgcttgaactctttttttctaagagattacttcaaatttgacagatttcacaaaattttgttatgataaatattaaaattttaactcttatttttatcctaaatttaagcccttacaaattaagaaaagagtgcctcgaggctgattgctaatgttcaattaagttatgtgttcagtgaagtaattttttgattatgatattttgattttattaatatgtaaactaaaaattataaaaggattatgagtacagaaattaaattatgtgaaattaattttgatattttgcggcagacagtttagaattaaaatatccttggtgtgtaataattttatttcttgtaaggacatctgttggctttcagtattcagaaaatttagactttttaattttaaatgttgacgtaaattaacgggagccatactttaaattgaaagaacttaagggaaatacataaaatatgctagtgattggcttacttacattttcagtgattagactttgtgaaataagagtaaggcctagcattttattttatttaagaaaatatacttaatttaaaagtactaatacaagaatgagagaaatctggtcaagtatagtaaatccatatccataattattttcaatcactagttacagaggaaggtgtgaatgctaatatcttctttgttgaaaatcataagttgtattttgaaaagggatgaaagggaacaagtaactgctttcaggcagatttatatcatcctaacatcatatgttatttgtgggttcatgtcacaaaagcttgcaaaacttcacaaaataatttaatgtattttaatttagtaagcttgctgaaaactcttttgtgataaatctagaaaaatttatacatgatatttttcttttttaaagtttagtgatccatcttggtactttgtctcaatttcagtcttgttgatttagataatattcttattgttttataaatttcctttcaggaatgtgttactgccttgatacgttctcacctttccagttatatatgatccatcta

SEQ ID NO: 133120 - DNA, 1104 bp, Homo sapiens
ctgtagttttttggtacctagaataatttattatggaattgaatattaaaaatttgacgatcccaatagttatgaagcttacagattctgtatgtaggcttttttcctcctttggtttcaggcataatgaatggatggcccttgctttctgatatttgtgtatccaattttctgaggaaacacttttctacaaagtctgcatgtttgattgttctacatttttctttcattataatttgaaaaggacttagatcctccaaatgaaaaatggctgtcttggccatatggtaaattaggcctgctttattattgtctaataattaagcctccctttacttatcccaccctcgttttaaaaactaaaaacgtgtggtagctgtattagttagaacattttcaagtaacaggaagtaattcagtggtaacttcctcatgtggtttactgtttatcaaaaaggaaagtagtttcttttgagagaataatgcagtttttgctgctcaacattttctcaagctctttggaaaataagagagaagtctttaatgtgcttgtaatatgataaggacagatttaaaaattttgtttctcttctcattacttggtgtttgacttcagtggaagctgaaagaagtaaatagatgttaagttgaaaatctgcctcagtgtcagatgctcatataatttaaataatttaaaatttgtgggtacttatattgattgaccttatattttaaaaacatagggaataacatcaactatttgtatcttctctcttaacttaaagttgaattaattaactttagctatctaatagagtaggtccagaaattaacattcaaataacagtagtaagtataggtgaagaccaggctatcccaaagataattcattaggacttctgtttctatagtatctttcatatgatagtaactgttgtaaacaattgaattatatatatcaatttaataaataattgcaatattaaaaagttagccccgataatttctacccaaacacctccaaattatgctacttcaaaaacagttgaagggaagtttaggaatataatatagtttcattttaagaccactaggataatagac

SEQ ID NO: 133121 - DNA, 3028 bp, Homo sapiens
gcactggtgataatgatgtctattcctgtattttttgctgacttttacctggtatcctgtcagtaattgttttttcatgttgaggaagaaaaaagaatctatacttgcatctgtcagtattattgttgttttaactttataggtatattgtagacattgaattgaaagatttgtaagcttttggttttctgtgatactgattgggaacaaaggcatagataatcagagacagcaaataatagccaaaaatatatatttgatatgtattcatttagccaacaataactagggccttttgtgaatcactgtgcaagatgtgctggtacttacaaagatgaatcaggtatagaccctgaccccacggatcctatggcttaatagaagaggtaagaggtgagtggcataatagagtcatggggtgcaggagaggaaagatactgctttcatgaggggtagaggtgtgtgtcaggggagataaggatatatcatgtttagaggaacaacagacttttaaaattctattttgaattaggtcggtttttcttagactgagttcctcattctcctagggtccatttgtagggaaaggttttttagttcttaaattatttcttaaatttgtatttttattttgatgttaaaaagtgatcgtacctgttataaaggtaacactttgcagtgataactcatagatgaaagacatttgttataggatgagacttcagtttcttaagtcagtgtttctcattgggatttttggacagatatgatgttcaagagaactttttttttaaggggtttatatattttctaagtttgagaaacaaaggcttaggctcatttcatgttactttgcactgtctaaactacattctaattggtggcagaaagtaggtggcctagaaatgtaagtagcaaatttttttcaggaggtaaggcaattcagcaaggtagtggagagttcactgtcagttaccactatttaggagttaagttggtggcagtgctgctgaatgggcacagtttgtttgattttaaatggtaatgaactgtgagtttattaaatagagggtaaaagttctaaatacattctgaacataaactagacccgttaaagtggtttgtgttacaacctactctatagtgtcctatacagtagtcaaagcttttgtgtaattgattacttctgtggtcccaatgttaatttctgcttatagttttgtaatagcttaatttcattaaagttaattaaacatagattatcttgtacagtatggtatagaattttgttccataaattgggagaaactcataaggaataaataagtactctttaatttatagttcggtgtttccaaagaaatttgggcttcacattgggtgaattcatcacgatagatttaagaatatctgtattgaatatcccaaacattgtacacttttgggggaacatcactgaacaatattttcctttcccacttatttttttttagcagaaaaaaatacccccctgtccccaacaaacaaaactgatcaaagtaagaattagatcatggctttcaattccttagacattttttgaagtctctccaggcttttaagatgaggaattcctaggaattactattcttactggggaaaaagactattttgattacagagagaaaattaggtgacatttgctcacattatacatagaatagaatgattctagttcatctgtagattcttattatagtgtttcgcatgtaatatatgctactttaggataatattttattactgtttgaggttcttaatagttcatgtgtcagcttgcctttatataaaagtctatgtaagttgctttgacagactttaaataaaaatgggaaacacataaatgcagtgttgccatgttctcttttgttttgagcaattacaagcatttctcatttcctgtgcacagaaattccctgaaaaatcaagacgctgctaaaagagtcaaactctgaaagaaatcccaaagatacatcactgcttgacgcaaacatttttaagaagtcactgattataatgaacacagcctttaatggcagtttttcatctccttttcacaagaatgtgacagagtgtcattaaggttttagaaatgaatgctcctaaggaaaggaggatcactaggactacaatgatgctcagtatgtggccatgggattctctgttgggctctttttaggtttttaatcaggttggagaagggagttagagaggaaaggaataggaacagacaagagctttaggacacctgtacaccacagtattttactttctcattgatcttctagatgttgaatccgtaaggtttaatatagaaagtcaaacaaggttccaaatattttgaggaccagtaaacaaaatcagctctaactatatatatgtggaagcacataatttttgcatttaacttaaagtgtttggatatattaaatctgaaatttcatttaaatagtaattccagttctgctctaaggatattgttttaacccattgttcttttctatggtgacagtgattgcccttgatgtattctgcaggtcagtcagattgtatcacagaagagggcacataataaatgtgagccagaaacagctatgtctcagtacaggaacagaaaagcatatttttgcatcacacattaaaataacacccagaaggcattgcatcacatataaatgtaaatcttttctagaggggtgtagcatggaaagaagggttcagccaaaatgtcctcttaagttttttaacaataacaaacactataaagctcatatttaatgagtaataattaatgtctatgaagtttgttttatgagtttttaaaattacagaatattgtaataaataatgtaaaatattacaaaatatgctgtgcttgagaagatatttttccaggttagaaagttacagtttttctgagcaggtgttttctgtgaatctctgtagcattggaatttatagagatataacttttctatttctgtggggt

SEQ ID NO: 133122 - DNA, 2388 bp, Homo sapiens
cgtaatgagaccctgtctctaaaaaaagaaaattatccaggtgtggtgcttgcctgtagtcccagctacttggggaaactgaggcaggcagattcccttgagcccaggaggtcaaggctatagtgagccatgattgtgccactgcactgcagcctgggtgacagagtgagaccttgtctcaaaaaaaagaagttaacctacagaatgagagaaaatatttataacccacgtatctgataggggactaatatctaaaatgtataaggaactcataatacatatttgtagcaaaccaagtaacccaattaaaaaatggggtaatggacctgaacaggcatttttccaaaggcatacaaataactaacagatatgtgaaaaggtgctcaatatcacttttcagggaaatgcaaatcaaaccacaatgaggtatcacctcacacctgttgttagaatggctattatcaaaaagtaaaatgataacaaatagtggtgaagatgtggagattgggaacctgtgtacactgttggtgggattgcaaattgctatagctgttacaggaaacagtatggaggttcctcaaaaaactaaaactagaactactgtctgatccagcagttctgcttctgcctgtatattcaaaggaaatgcaactactgtcttgaggagatatttgcactgccatgttacgttagagtatatacagaatatacttggtaaggatgtacttcaactggttgaagcagaagtgaatgggtgaacttgagtgtggcctgccactcttgattatttaatatcctgtagcatcggtatgttttataaaacaaattgagagcattagtcatttttagtcagtgggttatgtagagatttgttaagagagcatttattgtgacagtttgagtctgtacaacatccttgcttagaaaccaattaaaatgcctcaaggaatggatacgtatgtagttacttcttccctttctagatcccaaatgttaaagggtattatatagacccaaggaagttgtttggttttaagcacttagccccatgttgaacaacgactctaggcagacatacttgatgagtgaagcaaaaggaggaaaagcaaaagtcaaaaatggattttgattatgggtagtgatcaaggaatggatgatgtgggaacagtgtgtaaggagtatctggagggaacatgaaggggagtaattgtgtcagacaagtttgagagagtcatttatatgacatttcccccttgagattttcccttttatcttgaattttgtattactgaagataataaatgcatatatttagctaatgtgaaacaagtgttttctctggtggattgacttttttttttaacaaagatatgtgtattatatataaaattaatgtggtaaccttttcatcttattctccttagaatccatcagtagaagaattattttgtacactatgtgtgaaagatcaaagaatatggggcagtcaccagttgtttacaacctggtttgcaagtggcataaaaaaatattagtttgtctgctgaataaaattaaacttatttttctctctgtagcatattaattgtattatagtatgccacagccacttccagtgcaatcctcctagtcttggaacagcagccaattccaggaattaagagaattaggttactttgcctagtggcacaaaaaataccaaggtattaaatcattggcttgtctgtttggggcacaatcagaaataaagtttagagataaaagttgatttgcatgctgttcacatttgttcatactttaacaggtatgtttttctatttctctccgatttatataatccttttgaaacagattttcagttgctgttaggtccagaggaacagaatgttaataaaattttaggttaaagactaaattcagaattcaactacagtaacttgatgctactggctgtgacaacattttaatctatctttggaatatttaagcaaatattaaaatatgtggttacctaacatggctatatattaaaatataaatgttatattaccctgtaacattttaaatgatttactaatctattatgtaaagtaatataagaagccagtttagtggtagaaatgttaattttattttaactttagtatttcaaaacaaagatgttatttttgaactcaaagtggtagaagcagagaggaggtgacaaactgagaaccttttgattttgttggggtggaacttggtctgctgttatagctgacattattactgtatctcaatgatttttgagattttgggaaaattgttttaatgtttcactcccaagcgctgaagatactccagaaatctttgccgttctgttcctataacatttgctcttccattttg

SEQ ID NO: 133123 - DNA, 1074 bp, Homo sapiens
attccaatagggactcgagtgaacaacgtgggcattccagttgtgacttgagtgagcaacgtgggcatgcactagggacttgagttagcaatgtcggcattccagtagtgtgacagatattcttttggttggtgtctcattgttcattttgaagatttaacatgttttttctgagttccttctctttcaacctcttatgaccctgcagactgattatgaagtttccattaaccagaataagaaaatgtacttgcagactactgtagttaactgttcatatagcattttatcttatgcatactataaaactgttatatgggtatgtaatacagaacagacaaaataaggaaaacattcttttccaaaggactcaccgtagaattcctttaacagagatctctgatggtatgttttgaaatttaatacctataaaacttcagttagattctgcatttcagaagcaaatctattgtatagagccaaatacaactatatatttttacagcacgtttgtttttttgggggagatcattaaagaatatttaccttctaatcagattaaaaacttttctttgatcttttatgtgttcgatttgttaatggtacagttggtatcagattcttctgattaacagcaactggcctgaatctactataaacttgtgagagaaacttaaaattggcccttgttattacttaataaacctattatttttcttattaatttttttaatgaccatcatgtttactcttctaggcagaaattatggtttattgtgtaatgggaataaacatgatttgtggaattatacctcgttcatatactcactgtatttcttgtgaaagccgtaacatctctaagcatagtttcttcaattgtacaatgtagaaaattactttgtagaattattacaaaaattcgatgagttaggctgggtgtggtggctcacatctgtaattccagcactttgggaggctgaggcgggcagatcagtttaggtcaggagttcgagaccagcctggccgatatggtgaaaccccatctctacgaaaaatacaaaaaattagccaggc

SEQ ID NO: 133124 - DNA, 1030 bp, Homo sapiens
gtcaggagtttgagacgagcctggccaacgcagtgaaaccccgtctctactgaaaatacttagctgggtgtggtggcacacacctgtagtcccagctacttgagaggctgagacaggagaattgcttgaacctgggaggtggagtttgcagtgagctgagaccacgccagtgcattccagcctgggtgacagagtgagactcagtctcaataaataaataaataaataaaattaaaaaataaaagcatggagctaggtcagaaatagctacagactgagagtaatcactgtaagtagtgacacaaagactaatctttgtgcagtgtggaaagtacagctgggttgtttctttgattcctcctgccccattgagccatacctacagagagcagctgtgaaaaactatcactttcaacaatgaagaatagtaatatgtcataatggagattatgaagttcagaaaggggtaaatgcagttttggggagggctgagactaagagagaacacaataagacaggcaattaagactgacatgaaagatcagtcacattgataggatatactcttgatatgatataatgagaatggcagtttaccgctgtggttttcttttcccaaaacccataaccacagcctaaccatgagaaagacatcaaacaaatcccaatttgggacattctgtagaatacctaacccagtattccttaaaaacaatgaaagtcagagatactgtcacagccaagaggagcctagggagacatgacaactaagtgtaatgtggtatcctggatagaattctagaacagaaaaaaattaaaaactaaagaaatcatgtatgagcttcagttaataaggtatcaatattgtttcattaattttgtcaaatttaccatactaatgtaagatgtcactattataggggaaactggctgtggtgcacatgagaactcgttgtactatcttcacaatttttctgtaaacctaaaactgttctaaccctaaacctagccagtaatggtgccttggtaa

SEQ ID NO: 133125 - DNA, 1498 bp, Homo sapiens
ccgccccctaccccccaccaaaaaaaaaaaaaaaggaaaaggaaagaaaaaaggagaaggtaaaaaggaaggaaagaaggtaaaagagaaagtagaaagagaggaaaggaaggaagaatggaaagaagaaaactcacaatggttggcaaataaacctctatatttcaaaggttattgtgaggataaaactcttatagttatgatataaaagatttaacgcggtgttggtacatgttgttggaataattcacagtcaacataatgagcagtgatacaaagttcaggtgttgtagcagacgtattttgagtttacagatattaaacagtgaaagtaaattttgggtttctgttaagaaacacgtaaaatagccattagagttttgtggatatgtcaggtaaattttgaaggcattttagaaatgtcaacttgctaactctaggtgactaaaataggtaagctttttataaataaggtagattgagaaatttttggatatgaaattaatgatctgtatgatgactgatattttattttgcaaatcagcataatgtttactgtgtctcttcttgttaaagtgttttatttacctttcctgtgtttgactgtctattcttgatattatgtggtcattatttctttgcctctgtcattatgtactgtttgcatcttttccgtagtatcttgatcttcaaaataaccaggcatgctatttacatgaagcagataagcataacccatgtaaattttcattgagtcactgagaggtggtgtgtgttttttcccttttactttaaaatgatttatttatttatttatttttgctggcagccttaataatgttttcataaaatatgatcgatttataagtctgttttacatgcctttccctttttgtcttagtgctttgcttctaagttgcagatgcagtgggtgaacaataccctgtgtggtgtgacaggtaaatttcccaatttacctgccgtaatagtgcgctgtgtaatgccattcaatcatctctgaattttacttgcctgattagttaagtgaagcagattttcaatttaaatgtaacttcatctgcttgattaaaaatgtaacagaacattatctgctgcaaataaatttcagtggaagagatgatttttgcctgtttaaaaataacatctgtttatgttggctggaagcagacgattaatacctctctaatttcgaggtttaccagtccagctcacctgtctctttgcatggatagttgaaattgatggctgtcgagtataaacatttacctgttgatgttgagttgatggatttcttttttaaggataatacagaatcccatcattgggcattcatttatttgctgctcatcaagatgattgacagttttgccaacaacatggaaaaaggatcttccttcatgatgcatatgagaaaaattttacccctcaatgatgagtgccctacagaaaaacatattcttgtagattctttttcata

SEQ ID NO: 133126 - DNA, 1028 bp, Homo sapiens
atacatcaggttattccttgatatttagcagaagtttttgccatagtgcttaatgaaaacagctcaaactgttaaaatacatttttggtataagtatatttggtatgttctatgctttaattattaatttgtaattttattttaacaaattactttgtgtagtttttttttagaagcagatcagctcagtgtaagaaacttagaatattgttttgtagctttctttgttatttcgttgtccttcctttttatttgtagtttgcaagggtagatgagatttttttttcagtttcacttgtccagatgatatttaatgtagaatgaataaactcagaagagcagcctttacctaaggaagaaggtatgactacttcaaattgtttcatcacttagtttgacttcagagatttttgctctgtgatttgcactgacttcaaaactttttgcatgtatctcaaaagtgggtgagaacatttatagcagcattattcataataaccaaacttggaaataaacgctatatccatcagttgataaattgacatacaaaatgtggtatattcttaaaatggaatattattcagtcataaaaaggaatgaagtacagattcatgctttaacatacctgagctttgaaaacacgttagtgaaagaaatgagacaccaaaggccacaaaatatgtgattccatttacgtgaaatgtccaaatgggcaaatccatacagacaggaagtagattagtagctgacaggaaggagctgggagaatgtgggaatggaaaggtactgtaatggatgtgggatatatggaagatgttctggattatggttgcacaactttgtgaatgtactagaaaatacttgcacatttcaaaaaggtgatttttctttatttttataaatttttaaaaaaaatttgagatggagtcttgctgtgtcgcccaggctggtcttaaacttctgggctcaagccatcctcccacttcagcttcccaaagtgctgggattcaggcatgagctactgtgcc

SEQ ID NO: 133127 - DNA, 1004 bp, Homo sapiens
agttccttttactttctatcccaccatttgtggatagcatgtaaataaatcttgaaatttggggcaagagaaacgtaagaggttaatccacttctaaggctacatcattttcagagtaactgattccaaggatgagcagaatatatttatttaatagctatgagagatggattttcataaacttttatccaaagtaacaagattctcacattcagtgtaaagggtgttatgaaaatgtaaagttcattaatatgctgtatatttttatccccttgaatgtaatttagagattatatactgtaataggatttatgacattatactgtttaatctttagggtgttacaaacacatcaaggacagttggcagtaactgaagtttgcttgcattttaagaatgcattagtattgctgagtatcatgtactttcctaaaaataaagaaaattatactcttagaatatttacagattcaaatatttttttttccttgcaggccaagaataaaatctttatgaactaacaagatgaattaaagatggaatgattcatttctatggttaggttttaattaatacatgggggatgattttggcactttttcaaagaatttgtttctgtgtatctgaatttgcacctactctgtaacctaactgcgatttataaaatgaaacaatctcttctaatttggcacttgataggtgctttgactttaaaaggcaagtgtatttttctgtcacgaatatcttgtcattctaaaataagtaaaaacaatggattgatgaaacttcttcactgcttttttctttgtgtataacaaatacattgatattttactggcataaaatgtgtattttagttgagtctttaaattattgctcagtgtattttgtttattttaagccattattacttcctttatgttggatttggatagtttagattgtaagcttctaaagggcaaataatacatcttttcaactgtggtcttgactagcagtcccaa

SEQ ID NO: 133128 - DNA, 2608 bp, Homo sapiens
aggcgggtggatcacctgaagtcaggagttcgagaccagcctgaccaacatggaaaaaccctgtctctactaaaaaaaaataccaaattagctgggcgtggtggtgcttgcctgtaatcccagctacttgggtggctgaggtgggagaattgcttgaacccgggaggcggaggttgcggtgagccgagatcgcgccattgcactccagcctgggcatcaagagcaaaactccgtctcaaaaaaaaaaaaaaagaatacatgcattagaacccacacaaggaaactgtcccgtttcagggtacaccttttatgggtgcaactaaatgtgcaaatttagtaaaacattttgggcacttgaagctattgcaacttttgctgcctcagagaagcaggataattaaatttttgcctatggaaaaagtaattttaccttagttttatgtcttttctaatttgtcataagattctaggccaaagatctaataaccattttctaggaagtttctttttgtttgttgtacttatttgaagtgcattaggtttctcttctttttaatcaccagtatattgttttgaaagtatattgaacattttttgtcatattttttctcctttctcttttatatttcttacctttttgtactttttgttttttacactgtatttctttattttagattcttcacccctactctccatgtcccctactcccaccccactaaaatggtggataggatttatgtaggggtgctgctctgagagtttgaactctgattgagagactaatccccacccccgaaggctgtctgcatcagctgtccccctggctaattagaattccaaagggcattaataaccatttaaattaatccgattatacctgcagttgctaaaggtaaggttcaggctgtttaaccctctgttaatgaacgcaaacatgaatcaaaactgggtaggaattttacagtttattttcatttctgcccaaaggaagaaaaccatttcacctgctctttgtagcagtctagtttacaacaatgcaaggaagccttgccattaattcagccttcattaaaagaccaaagctaaattgctccatcttgtgaaaatgcatttgcattgtttgtgaaagtcctttgggggcagagctgtagaaaaccgcctaacagcaaataatcctttagttaaatgcaaaagtgttataaagagctaaaaattctctttctagcaactaatgttgcaatgataatttgacagtagtggtctcccaaggggcattaaacaggtggaaaaagagctaccatttcagaactttagttaaaaaggagtggaaattgaatgaccagtattaagagtcagaagaaagtctatagggttatgtagtccagtttctctcatataggaattttttctccaacatagtggacatggttacctagtttctttgtaaacatctcagtaacagcaagtgttaataaggcagcccatctcataatcagataacttgttattgtcagagaatcctgatctgaaattagtaactattatttttctttcattttaccctttgagccatattgaattatttcagtatagctcattgccctcattcctattccctgacctctccatattttcttctttagatcaggtgtgtattacaggagatttttgaaatgtagaaatatatggaagaataaaatgttcagtaaacatgattgtaagacagcacttttcatacatggttgaagttgaaaaattttaaagcaagaaaaggaccagaagaaatatctttccatgtaattggctatttcttgaagagttattctttttgctgttaatgtgtgtgtcacctatggaaaagtctagattcaataactaagtcagaaaaattggtttgagaaaaagacatctactggaatctgtacggcagtccttcaacaaagatatctattagtcgatagatgtcatccccaacacctgtctacaatgactcatgtcttttcctgattaccacttatagatttttccctttttaaaaaaactttacacaaaatgtaaacttcatacattgggattattctttagtctggatcttttctttgaatgaaataagctttgggatgcttatttagatgttcaatggaacagtgtggagaacagtaattgtgtttgggctaaagaattaatccatttagtcatgggaagcactacttagctttccatagcagctgaattgtggtgcaactttggggctattttaggattttaacctcaaatagaaatgaaagtttatttgtattgatgaacatatgcttttgaataatgagccattgacttgatttcaatgaaagtgaaattgtttttcaattcagttattttatgtttgaacatgaattgaaagctacatctttgtattgctgaaatttaaaaaaaatcaataactttaacattttaacagaaagtgttttaataagcaattattagggtggcttcagaagggtattgtagctttaaaaatttctgacggttattagtacacttttgtactgtgtaaatcagacattggaataaaattacttttattaactaaaattctcctacaata

SEQ ID NO: 133129 - DNA, 2757 bp, Homo sapiens
gtatttagtatagggaatggaattatttggagtaatggtactgggaaaacatgtctgaacagataatagagagtgtgtggggttaagacagactctagtggcactgggaggattgggatagagcttggtgttgcacagatattgtgccttaagcttaagtgatgtattgatgattttcatggagcatttattctttttaaagggaagatttatttgggtgttgtcctggttaacttcaggaaggcttctgtgtgaaattatgctggaattcgttttaaggatgtaaatcctataaatccacagcttgggtgacaaattgaatctctaacaaatagaaggaatttaagagaaaaatcctgttgtcaaagaatagctgatattacaaacagttattatatatacaaattctctatccaaaggatgtctttgtatgttgttgagatcattgtcactgcttactctcaggtgggtatagcagaacaagaactcagatttcttggattctcttttttctttttttttttttttttgagatggggtctcactctattgcccaggctagagtgcagtggtgtgatctcggctcactgcaacctccaccacccgggttcaagctattctcatgcctcagcctccctagtagctaggattacaggcgtgcaccaccacacctggctaatttttgtattttcagtgaagacggggttttaccatgttagcaaggctggtcttgaactcctgacctcaggagatccgcccacctcagcctcccaaagtgctgggattacagacgtaagccaccgcgtccagccagattctcatattttttgtaacagcagatcccttataagtgcatccctttgcacacctaaatgcctaaatcatattgttgataagtttaattcagcaaataactgttatttagccactagggacgttgcagaagaaactacaaaataaagttttttttgtttattttcttctcatctcctttagatatatgaaaaatgctgctcattagcaatgtttgtgatgtggtcatgcaaaccaatgtgttttgcgtctaatgtagcagtttaatgagtgggaagatgactatcctggggtgaatatgaaatgtggcatggaaaaggaaacaattgcttgtgaatcctggagaatctggtaaagggggaacttaaatatgtcgaggaagggaaaggcattgtaaaccagaagaatagatagggagaacagtttgagcaaattgttttgggaggcatatttaatgtagtgaagacttaatgtagtagtgatttaatgcgaattagctggaagagacactacctacaaagctcataatttagtccaaattctgaggagtaacttatactaggttggtaatggtactactgcaagtaaataaaatattgccaaaataattttgaaattagagtcaccacgatttaatgacttgataaaaatgttaatggagagaagagagattgtaagtttgtgtgattttttaaaataattcaactactgatagcaatagggaagttgaaaggaagggcccagtccactttagttttagatgtgtagagtttgaattttctgcatttgattttggtgaaggaattatgagggtacttcaaaaaataagactagaatgtttgtgtcaggcccagatatataaatatatataaatatttgggcatggaaagaaaatcccaggaatcaaataatgtgccagttttatgattttgacacactcaaacctctgccttttgtttctctgggtcactctgtccagtacaacaataggcttgctatgtattttggatgaacaatgaaagagagtgaactgttctttaaaaagctgtttattatagtgaaactttatctgtagatgcagccactttgccagatctctgatggaactaacaataattttgtctagttaattttaatagtacgtcctttgtcacaggttgttcaaatgaacaaatataacatgatttttatggcaggtaaagaagaatattttaaatggaaggagacctgatgcaaagaaaaaggcattatttttagtggtgcagcgattttgggacttattatagtagaacctattctttatagagattattttgtttgatttttctattttgtttttctttgctatctagctttgttacatagtgaccatttttagcactataaaacttaatgtagtaatcagatttagcagattattatttaaagctgagcatttaaaattaactttttgccctgtgttcatttttgaatttcctgtttttatataaatatttgattaaaaagctttctgtttaataaaattgtgttatgattattttaatgtcgtttgaggacatttaaaaaaccctcccaaaatatctaggatattgttttaatctgtagccttctcagtagaaattaaaaaaattgggggatacacttttttgtgtgaaggataaagctcttgtattaatgacaacattaggtactgggtagtattttagtcattattaaaattattattaaaaattctgttatatattgtaacgtattaaacatttgagtatgtgttgagttcatcatttgaatacatagtgctgttttaagttatttgtgtgttatgaagaaaaggtcactatgttttatttttataaggtggaaaaaacaatccagaatgataatcaaagccaaggtagaggaacttgttaaacactttaaaattagacttccccccacccccag

SEQ ID NO: 133130 - DNA, 2752 bp, Homo sapiens
tcaaagacacaggaagttataacaaagtataaaaagaaccgagttcacatttattgaaaatgttgttatttaaagcacttgatgctagcttgtgatgatgagtgatggggtgcagtctggaaggaaaggcacagtgaactgttttttattttggaaacgaaaatgccagtctcagtgttatgatttcagagatgtagatttgtcattaagtgtgcagtacccagaataattcagttatttgatctaatgtaagaatgtaaaacaatccatcctgtaaatgaatgtcctggcttttatttcctatgcaggagtcctctctgtttcgaaagtcaaaacagcaattgcactattctggatttgatgttttgttaaaaaaaaaaagtttccgaaatctgatctgtgagatctgggccagtgacaactataagtggttgtctctttggcatagcagccaaatattctgaagtgaaattgtggatactttatctacttcaggtagtgtctcatttaatatatgagcagggatgttggcactgtcatcatgaataattgttgaatcacccatcacttgatgttatgactgtctataaggaaaaaggggaatttcccatcttataaaatgacaaaatttgtaattaaatgggaaactgtagtgttcctcataacaaagcctaagcctgtctttcaaatctgatacctctttctctaaataacctgttttccaaccactctggccctcttacttgtcctagaatctgtggtgccctgttatgttttcatatcttttttcattttatttcatcattctgcagagcccttcctcaaaaaagcttctattcatcctgtgagatgaatagacccagctaaaatatcacttgttctatggagtctttctcagactgaataattttattttctcccagaatgttacaaccagagtaatctttgtaaactacagatttgatcatgcctcaataaaaaagttttaatggtaattaacatttcatatcaaactcagtgtatcagcctagtggtctctgtcttcatttgtccagccgatcacatcttctctttgtcacagaacaacttgctgttatcccttcctctgagcctactttgtggtcacttttgccctggagtgctcacccgtctgtctattttagtcttcctcatttttaaagatctagagtctatgaggaattaagataatacaaagtggaaagtgttaggtgccaaaagagaaagaattcagttggcatacttatgttgtctttgcctcctctgttcaagtgggaggtcctaatgatagagcttgctccctcaaacttgtgtatattctgcagtctctagtacagtatcttagggaagaggtagaggaggagataaatttgaaagattagtaagaaagaactgagtaaaacctgggtttggttagataggataggtggtagagtgaaggaagaggcatcaaagactcgtgttcaataccttttttgcattgaattaattgatgattgacccttggtgtgtttgtcatattttccttgctctttgaaattcttttgcctaatgtgtgctaaagtagtctgaaacagactgcttaccacctgtatcttttagccttctacccactgagctccttttctattgcttcctatttttgacacatttgccacaccctcctccccacctgtattctctttttggggttctgtttcccatagtaatttaaatggccaatgaaaacatgccccagatgatactatttttcatcatgctctcctgccactttgttttcctgtttaaaagaacaaacagcaaaagaaaaagacacaagctgctagtttgtagcctagctggctctgatttctctaattcttgtctttgctgttctgtcattcttggtttctactgtttctttttcttttttcttttctttcttcttttttttttttttttttcttgagacggagcttcactcttgttgcccaggctggagtgcaatggtgcgatctcagctcgctgcaacctccacctcctgggttcaagcgattctcctgcctcagcctcccgagtagctgggattataggcatacaccaccacgcccagttaattttttgtaattttactagacacagggtttcactatgttggccaggctggtctcgaactcctgacttcaggtgatccacctgcctcggcctcccaaagtgctgggattacaggcgtgagccaccgtgcccagccctactgtttctttttctgtctgtctgtctgtctgtctttctctctgtctgtctgtctttctgtctgtctttctttctgtctttctttctttctttctccttttctctctgttgtccaggctggagtgcagtggcgcgatctcggctcactgcaagctccacctcctgggttcacgccattctcctgcctcagcctcccagtagctgggactacaggcacccgccaccacgcccggctaattttttgtatttttagtagagacggggtttcacggtgttggccaggctggtctcaaactcctgacttcaggtgatccacctgcctcggcctcccaaagtgctgggattacaggcgtgagccactgtgccaggactgtttctttttcttaccgcgctctgctcccatttttgccttcccatttgtgcgccaccattattaaatgctttatattctctcttttgattgggttacacgttcttttattcttcctattcttaatccttt

SEQ ID NO: 133131 - DNA, 1635 bp, Homo sapiens
ctgaccttgtgatctgcccacctcggcctcccacagtgctgggattacaggcatgagccaccacgcctggccattttttttttaaagttccaagtatattcctgtcttagagcttttgcaggtatcgtgccctctgttgtgtatgctttccaacctcaatatttacatggctgtcttcctcaattttttcaatcttgctcaaatatcatcagagagaattcccctcacctgtataaaataacatctttgtctacccttttcattttctctcccccttttcttaatgttttatatgcatatgtatgtatacacatgtgtgtatatatgtatttaatggtttcactctacctgttaaagaagaaccctttttgtttcatttctgcatccccagggcctagaaacagtactcaaatacttcttgaatgcatgactgaataaactggataaatatttgtgtttataagggaaatcagtgggcatatagcagcattaggactctggagaagtgtggagtagttaggtaggggtgtgttctggagagaataagttactggagtggacatgttcatgctaaagattatttgtgggcagattacttgggcagatagtaatacatgaagtcagaagcctttctggattattggtttctctttgaatccaccaaggacagtttttttttctcttcatttgaccccatgatataggattaggtttctttctttttctgtttcttcttcctgtttttttatttatttttatttttttattttttggcttcagagtgagcaagctttctttcaccctttcttggctctctggtttattgtcatagccagtcctttcctgccagcttgattgtcttccctctagtggctggctctcatctccctggcttcttttttgtcaggaagggtgttgtgtatgtgcactttatccctgaatgctaagagaggacttgtcaaactgacagttggtgtgactgctggctgccacttgacacggagaatgacatctaaaagtctgcatttgcagccgtggaccttcaagagactcatagaagaggctgtactttttcagtgagaaataaccacatctatgaacatttagtatttataatattaaaatgtatcctttcactaaactatatttagccctcatactgttcatcctatcttatattactgatctttttcatgtgataaataagattatgtagaaaacaccaagatttttcaggagtagtgtataataatgaacaaggtttatttcatttgtttcttgtgtgcattacatcattcatttccctcccattttgacatctgcaatggctccctgatatctactaaatataactatttaaccagcatctaaggcaattcataatatgccccaacctactttttaaaatcttatttcttagtcccctcacagattttctctaccctattccactggtttctaaacaggttttttttgaagcctcttaggcattcccttggaaaggtaggggtcaagtcaccagatttctatcctcaacctttaggctttaatctcttttgcatattttggtttctttaaaatagggctctataactaaaagaggtttgaaagtcactccatttgtctggtcagatg

SEQ ID NO: 133132 - DNA, 1025 bp, Homo sapiens
attttgaagataatgtaattactgctcaacctgacctggatagtgttatttccttgtttaaagggggcaagcaaatagttttagctaaaatgacaatataacagaaaacctgtagttccacaggatgaataaagacagacttagaaattatattggtaaatatgttattttaagaaatattagttaaaatttcaaaagcagatcattcaaggcagcaacagaacccttgttagttgctttattgatacagggatcctaatactgtctgaaaacttttaacaaggtgtcaaattcagaatatgctttttattgttagtaatgtctatttatctgatgattcatacttagtaaatgcataaatattgagtaaatgttttagattcattgatctgcaaggcagatggtataagaatagcctggatacatgaattctaatcctacttgtgctgttgttgactagtaccaatatgccaagttttcacctcctgagagtgcctttcctttccttattgtaaaattgattgtttctaaagtgttttgattataaaaatttctgatttattatcttgcacattgttttaaagaaatggatgataaaatcatatacttatttaatattgcatatttccatttccctggctcagtgcagagtaaatcaacaacattgaaaagctagttgggaatcggagatgatagatagctttttctaagtttttaggtccttaaccaatatttggtatgagattcgctcaatggtgtgtatgtgtgtgtgtgtgtgtgtatttgtgtgttagaattcatcagacaagaaaattaatttctattttagatattttacaaagaatcacttattcctaggattgttccccaagacatctgaaatcttaatttgcatatctatgtggcaaagctttaaatttaagttatccagtagtttaacataaaatcatactgaaacactcattaacacatttgagtatactatgtaagttcagaatataaattacttagtactgagccatgct

SEQ ID NO: 133133 - DNA, 1229 bp, Homo sapiens
ttatatttgttcctggttaataggtaagctgttgttttgtatatttttttattaagccaccttcctgaaaattatacatagtatttaaaaaatttataactcaacattaagttgattaatgaaaaccaaacctttataccttaaacgatacataattttgtggtagaggaagtggctgtttttctccattttttttcaccctaattgttgaaagcttcctatcacaatggtcaagtatttatcatttaaaactgagcagactctcaatactttgggggcacatttcacctaccccaaggcattaggcagaaatgctgaggaagctggaagacttagtactctgttctttggtcagcaagtgatagttgacctataattaattaatagaagaaggaagtactctcagtgttttgggtcttttatcaaacaggtatgttattcttaggatcttttcactgttactccctttctgctattctaaaatataatcctggagtctcttctttttgttgctggttgtcacatttctgcaaacagcaatgtattgtgttaatagttatttcattacagacatttctgcgttttggtttacatgtgttcttgccttatttttcttaaattatttaaaggagaggagtatgttttgtgcagaattgtgttgatcagacgtgtactaagcagttactgtgtacagtgcagcagtgaaagggaatgataatactgagcacttatgtgccagttctgaacagtatcgatgcggaaaccaagaatctgaaagaataggtgtcttgtcaaaatttaggaagctatggaatgtccatttgattctaaattctatagtcttaagccctggctacacattagaatcatctggaatatttaacaaatctcatagttttattgtactccccctcaccctcacctttcatctagccaggaaattgatttctacagatagggcctaagcatctgggtgtgtgggagagacatataattttttaaagctgttacatgattctaatttgctgccttggtgaagaacaggagtcagcaaactatgccccataggccaaatccaaccaatctcctgtttttgtactgccttggagctaagaagggctttaacttttttaaatgactgggaaaaaaatcatgacatgaaaattctatgaaattcaaatttcactgtctgtaaatcaagtttcgttgcaaccaaagcctttggtaaa

SEQ ID NO: 133134 - DNA, 1152 bp, Homo sapiens
atcgccattctatttcatttccaaatcaaatgttaatggattcctataggtaaggtatcccaaggaaatacttattttcaaagtacagatgctccttaacttacagtgaggttatatttctaaaagcccattgcatgtagaaaatattttaagtcaaaaatttatttaataagccatacccaccagacattatagcttagcctagcatatcttaagcttgttcttgtttttatttgtattattttattttagtcttaacttgtaaggataggaattaaaataataccaaatgctgtcattttcctcagcaaattttaggcatatgacctgggaaattgtgaactactttctcttttggcttttggacttcctgttgggttttgggtataatatgcttataaagatagatttttattaattgtgattggacttcttactgagagcactttctgaaaatgttaattttcttaattgcataccagtgttaaataatgagatcacaactatttttgaacaattagaggttatgttctctttaagaactgattctgtagtctctatccataaatctttcctcaccttgtttagtggtaaggtcaagtaaccattaagtagactgaaatatccccagatcaggcattcattcaccatcttttagtattgcagtggagccacagaattactaggaatggcagagaatggcactacatgaaggaatgacaggagactgacagggtcaagagaaaatgatggagggttttagaaacccaaaccaaaggaaagaaagaaaaaagaaggtaaggaagtggggattagagggtgttttttggtggttgtttttgttttgttttgagacggagtcttactgtgtctcccaggctggagtgcagtggcacgatctcggctcactgcaacttacacctcatgggatcaagcgattctcctgccgcagcctcctgagtagctgggactacaggcgcctgccaccacgcccggctaatatttgtatttttagtagagacagggtttcactatgttggccagggtttcactatgttggccaggcttgaactcctgacctcaggtgatccacccgccttggcctcccagagtgctagaattacaggcatcagccaccacgcccggccagga

SEQ ID NO: 133135 - DNA, 2036 bp, Homo sapiens
cgctagcttgttgaagaaagttctctaaccaaaggcaattctaattgcctttgaaaccagtactagtcaagctgtacagtagttttatgaagactgagcactcaacctggagttccttaaaaagaagacacaacaggaaggcccaagatacccttttgcccttcaaaatgaactgccagtgcccctgctttcatgccttgagtgaacatattccattagaacaagactgtacttttggttttacttaagaataactctctgagaaatgtgttgtttagcaatattcctttcaaattcacaagcgctaattgaaattactctctatgctatctttctagcaagacttaaggtttcatgaatagatagtgatcctcttctcatgtttcagggttctgtcttcatactctgttctccttcctttcctccatgtctttccccttgactgtatcacttaaaaagctattctttaaaattagtgatattgcttctaatttatatatttcatctccttaaccgtactgtaaacctctctgagtcaggaagtatatgtcttgtatttattttgtattttcacacaatggtcacttagttcaaataattcataaatttttggcatctaggttagaatggcacaaaataaggcatagttcttgtcttcaaagtgcttttaacctttagaagagatgtgacatgcaagtttaatatgcaagagttattaaagagagcacaatcagtttctcctcaggaaaacagtggggacagatggtattaagagccatgccttagtagcactggattattgggatattttaatgtgtgtatttgctggatcacagcattataaaggagacatttaaagaaaacactaatgatcgtaatcccttctatgtataattcttggtggtgggcaaaactcattcccgttgttatttcattttcgtttcattaccctttgaatcaacggatcacatttattatgaacatataaaaatctcacctatttagctttcagagttttgttttgtttttcctaattgccttgatgatcagaaaacagaaatatcagagtcttgacctctctctgccatgatcttttgtgttgagtttagcactcttgaagaaaggagagatttgtttatagcatctgccctgacaagtcagtactgattctctatcctggttaaccagatttattagtgactttcttataatactattgtaacattacttttgctttccttctccacctcatgcaaagagaaatgaagtaggaactttttgcttgtttgacatattcctgatttttttgtaggtttctctgaggtgatgtagcttttttggacagtacacctgctatgatatgtaatagtttgtactgttttgctaagtgatttttcttcctttaacagaagtatattttaactgtttggtttcttttttctttgtgttccaatattctttgaggagaatagaaaatggaagaagaaaccttagtaaataagttttttttgtgttaccgagaaactgtttaataataaatgtttcccgatccacttgatgtccacttttttaaaaaatggcctttattgaaggcaaaatttggtttcgattttgcttagatgaaattgcattattttgctattattcaggagactgtttctcacctggttgatcatttcaactgtttctttctgtgcttcaaatcatgagaatcccatttgccccaccgcagacttggcatgtcgaataaatgtgatggcagcaattaacatcacgattgcaatgaaaatgtaaaaaggaaatagttgcaaagttgtagtagggaaaacaaaagctggaaaagcagctttttataaataattatgaaattattttcatttttcctacataggattgaaaagtaaacaaattctctggttattttacatgttgattgtttctgccatatagcttaggactctatatagttgtggttagttttgtttttacattttaagaacaacacaataaattggagtcatcagtgttctacatag

SEQ ID NO: 133136 - DNA, 1002 bp, Homo sapiens
ttttctgttaaaataggttttggtttatcttagtgatgctgatattttctcagattttccattagtattttttctcccatctgaataataatctgaataaataatgaactggcttttgttataggggtaggtgcatagagcatccaatagcattccaaatatttggctgccaaataaggaaatcataactgcttatttgtattaaattagtattaaataaaatgattaacattttaaaatgttttggtataatctacatgcaatccgttaaaatttccaaactaatgtcagattctttattgcttggctttctgccaaatgatgttcaaaggaaattgagtttttctctagcatctaaggtaaatggaaatgtatgtgatgtttagctttgactagagagttacaaatggatccatggagttttggttatataatttatatgctatatgtatgagggcacttccttgcttcccatgatacttgggatggtgctgtcagtggagcaaatgtatgcttatgccatcttgtccataatatgtatttctgttgctatttgaactattaatgctatgtaataccaagtacttatatcagaaatttgtactctatgtagatagtgcttttgaacttctttctgatagtacatattcctgtattaatacaataaagccaagctgacaggatgacatagtgaagctcttattaaaaatgtgttctaattgttgctgagatactattggaaatctagagcttgctgcctcaagttattttaaattgtgtattttatatttacattttacatttacatattttatctattaagaattgcttttaaattaaaagctttacatacgcttaaacaaaagtatgaaagtatatttgaacttcaggaagcaattctttgtatcagcaccctgaatggttttgtattaaggaaagccagattcagtgacaagtttgaccctcacatctggaattgccattagagaaaagcaatcatct

SEQ ID NO: 133137 - DNA, 1122 bp, Homo sapiens
tccaaattaatacagcttttaaaggaatcgatggataagccatttgaaatttatatatatttgttttatgttgatgtcatagatctaccgtgtaaaatttaaacattatgaaaacagattttaaatatttagtaaagccttctctggaaaatgctaaacctttgttttaaaattatatctgtagatatctggtcactaatactgtgaaattatttcagcattgagtattgccggctacaagtgctttggaaactctttagctgttcatttttggcaaaatcttactttttgaaaagaccttattttagaggagatatcaatattgctttctcagtttttcaaactaccattttgtaatttattagtaaattgtaagtgccacagaaaccactgtgcagtattcaaggtccttgcattcagggttaaaactgagtttatatacacacatactaaactcttacaaagccagggaacaactattcaaactgcactgtggactatgctagaggagttagcatgctttctttgcagacatggttgatttgaatacaacaacaaaaaattgtccagactgccaactgaaacccttgaaaacacttttcaatctgtagatacaactgtatcagcaaaatgttgatcaaagttcaagtggaaacattaactagtctagctagccttctggtgttttcattggttaattcacaaagagcatcgcacagtggatttttacgtagtagtaacaatttgctgtaaaattgtatggtctgaggatatgaccgtagagtttgtcttctgtgtctccaaacttactatcctgtacatcttgactcattttattcatttttcacttcattaaacaataaggatttaccttaaattaagcatttttttggtatgtttattgtctcctagtggtcctttgtaatgccatatggttgctgcccagctcgacttacaaacttactctttttgcttctcatactagccattttgcaagcctgagctgctttgtggtacaggtcaagtacttatggagtaaagttaagtgaatttttattgtgcaggaatgtcttcgtttaaagaaaaaaaaaaaaagaaagaaagaagaaaaagactgcccca

SEQ ID NO: 133138 - DNA, 1060 bp, Homo sapiens
taaaatatactagcaaattattagataagcaaataatttcttagaagccatataacagtaaactaaattcaatccaacaaactattgttgagcacctacctgtgcagagtggacaatgttaagcagtagaaatgtgttattgcctaagagtaactagttcgtagcctaagagagagtcagacacataaatggatacttacaatacaaagtgtaagtaccttgatagatgaaaatataggacatcatggggacgtctaggactctgaattcacttttgggaaatcaggtaagacttctttactccaagacttctttcctccagaagtcttatctgatttcccaaaactgaattaggacctgaagaataattaaaataagctaaacagaggaaggcctggaagagagagagtgttgttgcaggttcagagaatagcaggtatatagccctattgctattgcttaagagatttatgtataatttggtgtggctggaccataggttttaaaggtaatggagaatagtgagacattagtctggattggtaaagtgagaccagattatgaagggatttataagaacgatcagaaaaatcaagaatatctcaaagatatttttagtaagatagtgacaggatcatatttacaatttacaagtcagtttggcagaaggcaaagaatagcaggggttgggcagatgatggcaagatcaaacttaaagagactgattcctttctaaaatagatgagaggtcatggtactgttcttctggatagtgaatactagaggagaatcaagtttgaaagtggacaaataatagtttgtttttaacatttgatttgaggtgcttgtggatgatctaatttgaggtgtccagaaaggaactggatatatgaatatagagccaagctcaagagagaatgaagctagatatatagattaggaaggtaatcagcatgagaatgttaactgaacccacaggagtccacaagggtcttcagggctctccatctttagcatcagcgtatgataatgattttgttacctaattcattatgtttca

SEQ ID NO: 133139 - DNA, 1062 bp, Homo sapiens
ccgtaattaagcaattaccttttaaccatttatgtaatcagtattgcttttgttctttttcagtttttttctcctaattttagtcaaggtaaacatctaagcagcaagtaatatactgatgaaaataaattttgagatttgtaatctagtaatttgtcttctgagtcttgtgttaataggaaccagaggtcttagtaaatgagaactatgattctgggtgcttaaattgttttatccgcacactcattgcgtgaaagatttcagcctataaggaagaaattatgtcagtctagagtctcctcattgtagaaaagttcccatttttatacttttgatgataacaaagcagctccattggattgtggttgacaatagcaatctgtatgtttttgctagcaacatacagatcataagtagaacatatttcagagttacacatgatccaagagaaagtgtgccgaattttgaacttggttggtagaaaaaggtgatttttttttttttggtaaagagatttttttagataaactctaagaaagtagttatttacagaaagtacactgaagtataaaaagatagtaaacatagtcataatgactatagttgctagctatatattcagtttatctgagggggcaggaactttagcatcatcttgttttatgaactctaatttacttatcaataatttttcttactagttacttgttgcaataacttatactattatacttcatgtgtggttttgatttcttaatggcagtatcttctttattagttgactatgggaaatatacaagtatagtgtccccttgtttgcaaagaaagggattcgcgtcttcacagtttactcacagctgcagtggtgagctgccctctcctggtcatctatgccttccagaactcccggtggataccagggaaaatcatacattttgccaaataaatggatgttttaatcatctttgatcttaacattattttgtgacactgtagtataaagctctgctgtagctccttacttttcatgtcttaaaagacattgttgacagaaaagatggg

SEQ ID NO: 133140 - DNA, 1028 bp, Homo sapiens
tatttctgaatttatgtatgtgtgtggcagtgtagggtagatgataaattttgtagcctaggaaacctgtatcccatcaggagagaaaacagatgttcttcctcctggttaagaactacatctatccatttagcaattatgaatctcttccctaggtaatactctttgagaaaggaatctttcagcagacaggatcaagaagcacatgattcattttttacattatgggaatgaatccttttacatttgccttctcctttttcatgctttcagtttaaataaaagtaagtagacgttccagtttaaatcacgttccagtttaaataccttacaggatgaaaggtattctttacttcctaggatcctaggattcctagtaaagggattctttcttacttcctaggatcagcgaattggagacactgtcagagatcacgaaagaaagttcgtcattcctcccatccccaatccagttcaaccaacttgtttctagccatgtttttatttaatagtttctgattttagcttgttttgattgaaattatattatccaagtcttgtttatgtttctctgaaagtggccaaatactgtttgttctacttaagtagtatttgcatctttttctgtcctcatgctaccactgtagttgaaacccttatctcttaccaaaacataatctgtcatctcgttgcttctctaaatttcttccatattgctgttggactgatcttcctaaaatagaggtctcatcatggctttctgttttccagcgaccattttcctttttcaaaggtatcctattgcctttaaaattgaggatagtgtgtttagcctagaattgacacccctcagtgttggccctagtctgtttttttcaggctgtatgccatagcactccttcacatgagccaaactggatggttcaggctttgatacttcactacctcttttctcatcctcaaatcagtctctgtctttgtgatacccatcttctcttccttcatcccctccccaaatccctgcatgt

SEQ ID NO: 133141 - DNA, 1030 bp, Homo sapiens
ggtaattatagaaatttgaacactgatgaacatctgattagttattgttggtttttaaatatatgatattgtattatggttacatttaaaagagtccttatttatcatttgtttgtttgtttgttgagacatagtcttgcactgttgcccaggctagagtgcagtggcacaatctcggctcactgcaacctccgccctccaggttcaagcaattctcatgtctcagcctcctgagtagctgggactgtgggggtgcgccaacatgcctggctaatttttgtatttttaggagagtcgaggtttcaccatgttggccaggctggtctcaaactcctgaccccaagtgatctgcccgcctcagcctcccaaattgctgggattatatgcgtgagtcactgcgcccggccattatttatcttttagacatagcatgctgaaatttttgcagataaaatgttttgcttaacaatagttcagtagaggacaagggtaagtgggtagggatacagatgaaataagattggctgtgaattaagaattgttaaagctggaactttgggagtttattatactattttttcaactttcatatgtttgaagttttccaaaatagtgaatgagtaagaacacacacagacattatacagaggggaagtgtcattaatgattttatctactatacctttttgtatcagaagatctggagaagaaacagaaatattaaagtttatttccatgaataatccctttactttcataaatatctgctgggcctggtgatttgaccagtaaatgggatttatctttttgtgtagccaataaattggctctttaatcttttctcattcacgttaactttctcttaccctgtaaagtgtgttgaatttaatgtttattattcctatgagttggggaattggtataaaatacatacataaaacgtgtaagaaaaattataaattgaacacctatgtaaccatcacccgggtcaagaaataggaccctttacatgtttcaaagctgtgtggta

SEQ ID NO: 133142 - DNA, 1053 bp, Homo sapiens
tttgtttatagtgacacctatatggtgtatcaagtttatgcatgcaggtcgttgggctacgtgattgactgttcatgtacttagatcacactgtcttaaaaattagagctttatactaattattgatatctgcctggcaagtctttctagcatgttcttctcaaatttaacatttactttgataaatagttacatagcaacaattcatgtaatcatcacatactcaaaatacaagatattaccagcatagtgaaacccatgctctcaggatgttgcacccttgcagtaaccttctccttctcccaacagttgggccttatcctgacttttgtggcagtacttccttgattttctttgtagttttgtcactgataacttctcctaatctatattgtctagttttccttttttttttttttttttgagctttatattcatggatgcatccaggagatataattttgtatacatcaggcttccttaataaaacattataaagctgtggttcatttttttgttttttagttgatgtgggatattttattttgtgactataccagagtttattcactctgctctaagtgagcattttggctattgttaaccagtgtttctcttaatatgcatgttttgggttaatttcaggtaatacatgtaggagtagaattgtttttccctatggtatgtttatcttccactttaacatggaatggcagactcttttttcttttctttttttgttttttgaaacggagtttcactcttgtcacccaggctggattgcaatggcgtgatctcagctcactgtaacctccgcctcccaggttcaagcgattctcctgtctcagcgtcccaagtagctgagattacaggcacccaccaccatgcctggctaattttttttatttttatttttagtagacacggagtttcaccatgttggccaaagctggtcttgaactcctgacctcaggtgatccgcctgcctcagcctcccaaagtgctgggattacaggcgtgagccactgtgcccagctggcaaactcttttttc

SEQ ID NO: 133143 - DNA, 1075 bp, Homo sapiens
ttgtggcttgccttttcactctcttaatggtgtttttttgttttattttgtttcttgatgaacagaagtactttatttcaatgtagtcaaaagttatcaaatttgaattcatgctcaatcattacttacctactatgtgaccatggccagcttcgagcttcagtttacttatctgtaaataggtggtaataatatccatgtcattgggtaattgagaagattaaataagataaagcacttattatagagctttttacctagcagtccctcaatagatgttaattgccttcctcatcatttagggtgctcattttcatactgtcttttgggaaattgggtagtattcatgagctatttgcaaatgaatgttttggaaattagaatctcatataattatcctaggaatttagaagattgcctaaaatagtaaatcataattaatttgcccagagaactaaaatgtaatattttctctgatgtagaggatttacactgaatatgggatccttgtataataaaactcatgactggagtatcttatccaggaaatgagaagagataataaaaaatagtctaacccttctacatgcatcatattttaaaccaagagtagttctctttgcctccaagagaaaacaaggtttattaaatagtgaaaaattgctaatcactccagcccaaagtaccttctctctcctaggaacatttagtgcctattgatgattttcattttcccatatttcatcattcaacaataatttgtaggacatctcttactatgcttactatgcaccaagtatagactcattctttgtgtgaatggagctaagaatgaagagtggaagattttgtaaaaaagattttaattataacaccatgccaaaaaatttcaaagttctgctactggtaatggcggaattgttcataatgtaccaattttcccacaggtaattctactctggatgaagcttatactataaatatttagtacataaaatctaaatgtttatatacacacacataattgaaagcacactttaatgcttcaaaacataatctggccagacctggatgg

SEQ ID NO: 133144 - DNA, 1715 bp, Homo sapiens
aaaacaggtagaaactgtttaactgttttatttctctgtgtatatacatatttatgtgtgtttatacacacaaaaaaataccttttttgcattttatgtagccagtcctaattacatttgatcaatagtgtttgttaaatttttttaaatatgtaacaaatatgaaggtttttcttgtttttacagcttttttgctccataaaagtatcctggtttttatcaggacatattatatgtattggaaatgaaagtcagcacggtgtgagtttaaatggttaaaaaaaaaatggatttttatattacctctgcaggagcttctgttaggaccagctcatgtattttgtattttttctgtataagggaaactgctttaaatatgaaaagatggtatcttaagttggattaaacatccgtaattcatgtgtatttaacctcaggacttgtgagccttgttgaaaaatccagctttaaaccttccctgtaggcctcaatagtgcatactgcattgggattataaatagtcagtctgtttctggagtgtaggttagtatgtattcccaggaggcatgaactatttacatttctaacaaatgtttcacatatgttgctgattcatatttctatgtacaaatttaggctttaatttttttaatttccttttttattagaagttttgttataaaaagtttcttaagtgtttcattctttctagcatgggtggcttaaggagattggaggggagcgtttcatttatttatatagagattttgatgttttgaaagacaatagaattaatagagaaaattgtccagatatccagcgcttggatttttgtttgagaagtttgaggaagcagatgccatttgagttggtttctatggaaaaatttatcttagagatgatgtagggctatatttatgttcacaaatgagaaattgaagctgagagaaagagaaaatgtttaatacataattactcaatatgtcttggaagaacctaggtttttattcatacctggtgtttctttataaactgcctctcttttatcttgagatggtattttcgaaattatttctctttctcattttcttctaccatttcctgacattttcttgtcttttgttctattcttcttcgtctcttatttttctatattggttgtactgtaaataggttgctagcaacacaccttaggagcaggcttttggggaatgggtctaagtattccatttggcctataataggctatattgttgttttggaatataattttgaaaaaatcaaatttatatttatcctgctagttgatcaagctataaatcaatcaatacttactagttgctgcttatataaatagaagagttaaccagtgactcagacagatgacaattgactattaaagatttttttaaattggcatatgtttaggaaaatcacttgtttcttcaaaatttattcattaagcagtattttttgagcacttactatgtgacaaacaccacacaggtgatagagatacaacagagaggaagatggaactggttcctgtctccttacatcctggtgtaattatataataaaagttaaccacaagtagaaacttggggcattatttttgtaaaatctcagtcaagtttctctctacatagaagactagtataacttcagataccatcattcatatccatatcagaatatagtcctatgttaaaagt

SEQ ID NO: 133145 - DNA, 1015 bp, Homo sapiens
ctctttatatgtattagctgtttttatgtcctatattctttttttattaatttaatcttgattctctttttccctccctccctcccccccgttcccgccctccctccctgcttccctcggtccctccctcccccttccctccctccctccccccctcccccttccctccctccctccccctcccccttccctccctccctcccctcccacctccctccctccctccccccttccctccctccctccccctcccccctccctccctccctccctcccccctccttccctccctccctccctccctcccttccttcctctctgctgttgttgaaacagagcctctctctttcatccaggctgaagtgcagtggtgtaattactgcccactgcaacctctgcctcccgggctctagcagtcctactgcctcagcctcccaagtagctaggactacaggcatgagccaccatgcccagccatgattttctttctctagaaaagtctgttagtggggatttgaacattctttttgtattatacatattttctttgaggtgtcatacattaaaatcaatttcttcaaaaatcaggatgagcatttgtacaaaagtatacagtcaactaggatgaggttttttaaaagttgttttccttttaacataaagttgtatgtaataatttccaatccctcgtgccttcttgcttcctttctggcaatctcaacttcaaatcagtaatacttattataggtacattggtacctataataacaaagcgactttgttctgcaaacgttggcctaagctttgaaaaccatgagccattgagttttatgaattcaagttagacggtaacagaggccaagactctaagcaagcaatatctgaaaaggaagtacacaaaaacaggtagaaactgtttaactgttttatttctctgtgtgtatacatatttatgtgtttttacacacaaaaaagtaccttttttgcattttatgtagctagtcctaattactat

SEQ ID NO: 133146 - DNA, 1045 bp, Homo sapiens
agaggtgtaagtggttgcctcttgggaatgggagctggcataaggaggagagaactggtattgtttcttacatggtattttagtatttttagagtttttaaaaaccatgtgtattgctttgataaaaattaatagtaaaatatgaaactggatttagagagaatctcgctggtatgtatcaaatgaaattgaaggcacagggaaaacagtcttagatctcaggtgatgaacaactgtaatgactggaagggggaaccaaagtactggcttggaaagacattttaaaggaatataatgtggaattttaagacctattctgattggacaatgggagtgaaatattaggttaagatgcaaacaaacctgttttgaggcactcataacaataggggagaaggtatttatgcccatttcaagtggagttggaatggtaggttgtgctttggatatgttatagcttgcaatgaatgtaatataaacatttgtgatatatcctgtaaacagtttgaagtgtgagcctgaacatgtttgatctaaggtctggaggaagatgtgaagcaaatctgacctaaaaaaaattataggaaaaaagcaaattgttctggatttgtttcaccaaggaacaagtaagcagagaaccagacactggagaaaaaaaggagtcaggaagtagacaaggaaatgttaaaagaaataataggataactgaaagaatgtagcttccagattgctagctatcagcagatagatagaaacttttatacagcctttaaatcttccctagaaacctttttaaaagtagcttcttgattagatttaaatgggttttatttatgcttgtcattttacagatattgtaaatatacatatggtatattttctttttgccttttgtggacagttggaggtggggaacaggcatccatagtcagtatatttaaaggaagaaaaaacaacttccataatcttgttatattgactgtttctgttgatacattttccctttctttcttgtttcttagtatgatttgagggtcattttaaa

SEQ ID NO: 133147 - DNA, 1048 bp, Homo sapiens
gagtacaatggcacaatctcggctcaccacatcctccgcctcccaggcgcaagcgattctcctgcctcagcctcccaagtagctgggattacagacctgcgccaccacgcccagctagttttgtatttttagtagagatggggtttctccatgttggtcaggctggttttgaactcccgacctcgggtgatccgcccacctcggcctccgaaagtgctgggattacaggcatgagccaccacgcccaacctctacctctttttaagagaacaagagagatcataaagttcccctgtggctaggttctaagttgaacagatataactaataattctcttgctttatcaaggtaatggaactgacttgaagcttgatgtatctttatttgcttatagttgtctttaacaagagtagtagatggcttttatttagcagtgaaacaatttttttaattcttgatttttttttcccttaggcccagatagctaataaccgaacacctggaagatggacccagcggtactattcagccaacaaaaacattatctgtagaaattgtgacaaacgtggtcatttatcaaaaaactgccccttaccacgagtacgtgaaatatgctttgcttctttccacatttgtaaactcaaaatctcaagggtgaggctgggcacggtggctcatgcctgtaatcccagcactttgggaagccgaggcaggtggatcatgaggtcaggagattgagaccatcctagctaacatggtgaaaaaccccgtctctaccaaaaatatacaaaaaattagccgggcgtgatggcgggcgcctgtagtcccagctacttgggaggctgaggcaggagaatggtgtgaacccgggagatggagcttgcggtaacagagatcacaccattgcactccagcctgggtgacaaagtgaaactctgtctcagaaaaaaaaaaaaaatctcaagtgtgaaaccctataaccttagaattcaaatctttttatagtatgtgtgttaaatttcatgtagcttacagcctagtgtcgga

SEQ ID NO: 133148 - DNA, 1017 bp, Homo sapiens
cttgcttctccagtcaaaacagcttcttctgtatctgttcctcctatgacttagcttctagatatcctcctcattctactttccctcttacatacctttcattttgtcaatattcctataagaagaggcataaggaatatatgccagctgctagtatgtacagactaagcctttttggcaaacaatatacatacagtgttttggacattttgtttgatttttacagttgtgctcaggattctacctttattgggatctcaaattagaaaagatttttttatgggattatattgaaaaacaaatactaatcttctaccttttgagactgaagagattttatgtttttttcgccacatagaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgtgagtatcctgcatataactaatttgtcaggctttggagggagtgtgcaagtttgtaattaatgtgcaagtttataactatcagtcagcatacctaaaggaatgtttactccgtgagatatatatatatatatatagtcatgtccattttgtcactgaacatgtatataaagcagtgctctaaataatataggggtaaggagcctactgaatcagaagacagcatcaagagatagcattaataaatattttaagcccattctagccctttttctttataagcttgttaaataaaggctgaatttaaagaggtaataaataacatgtaaaatttgtgtattcatatttatttatttatttatttattttttgagacatagtctcactctgtcacccaggctggagtgcggtggtgcaatctcggctcattgcaacttctgcctcccgggttccagcgattctcctgcctcagcctcccgagtagctgg

SEQ ID NO: 133149 - DNA, 1942 bp, Homo sapiens
tagaaaaaaggaatacataagtttgagttgaattaaagaaagttgtcttaactttcagaatagtgtacttttctttttcatcaatgaccaaggtattttaagatttttgtattccagaattttaatataaaatacaacatcaggattatctgatccagtatttttttttaacaactaaaaacatcgagtagacttcggctgaatgtaaaaataggtacattgcacatactagatgcttattgatgtttctgaatttttttaagaaggtggccacaaacagctgtagtctaataaaatctgtattttattcattttgttcattgttttattttttcctctattatgtctttatcaacaggtcacctaaactgagtttcttctaggtttgggcacatccaagagttgaccttggtacagtagattcatttatttcagctactttattgatgccaatatttccattatttatttctgcatcagcagtatggggagtgccaaattgatgttgtcataacaatagttaatacagtggagcacttgctatatgtcaggcattgctctaaagactttatacttatcaaccccttaaatatcacaacaatcctttgaggaggtactgttagccccgttttacctatgaggaaactgagacacagagatatataacttgcccaaaatagtaaatagctggattagaatccagccatttttgctctggattttctgattttagctgctacattatcatgctacattttactagctcttacaaggttttactttacattaccttaggtcatcagtcagcagatttactacaaatattagcaactatttgtgaaattaaccttgaaatgtaatctactgataaactttgtgccttcataactgtacttaagttaggaggagaatatcaaagagaaaaatctttgagccagaaattaagcttgtcagtttccctgattacagaggattaaaagtataggaattgattaaaatttgaccttgggtggaaagatgattttatgaagtctggttcatcttggaggcagcttagagttaaagaccaatgcatggctttccataccgattggttaaaaaaattatgtagattttatacacattgccacttacatcttgtatgtttgtagctcctctttatcaagaatggcaaattttcatgcagaatagaagtataataagcattattaagacagtaacttgtcttgaatcttaattgtatatttctatgatttcagacctcagagcagtctttatgtggaattttgattgacggcaaatgctaggatgttcttttcaaaattttccttctaggagaaattatatttcacgtatactcaaagtatatgtacaataggatacaaaaatattttgtgtagctgaggaatagtgtatatgccagtgattaccaaagtatcgggacaatcagatgacttggtagctataagtctatgaagagcctggtcttgaggcttcagagtaggggcgttctttttaataaaggcacctaaacttatatttgtgtgcatatggaacagttaagatggtggttgagtccagagactagaatggttttcttgccatgtgttttcattcaacaatttttaaactgaattattctctttattctttatttatgttattcactatcaatgaatattgtttgttttattaaatcttttgttttgctgtagtgacttgagggggccatctcctaacaacagaggctttgacaaagcaccagaggattctgttaaaaagttgtgtttcgtaattgtagttgtcgtgtcagagcctaactgacttggagctgaaggatttttgtgagatgagtagctgtgccagcagggacccaagtctcctgggctggccgcgctctcattaagatttgccgctagcagtggcggtgttcagcatgtat

SEQ ID NO: 133150 - DNA, 1001 bp, Homo sapiens
gttcaaaaaccaagtaattctttcttttattactaaattgctgcaacacaagaaaaggtcacatggtagagtggcattctgccagtgtatgacaactcagtgattgcgatttttcaaccgtattattctgaggacactgtggtaatcaagaactatccataactaatgtataaataactgcttgcttatttctacaataatccaactcaaattatatatacacagcaaaaagcttatgatagaaggtaggaaatgaatatttaaggatatattgtacattagatatttgtgtgtatacatgtttataaaaatagatatttcttgtatatattcttaagaacttttgtaacaaagtttgtggctacatttggtaactaacatgatctttgccttatgaatcaaccttttactttttaaaaatagttgtcttttcatcagtgttgttcatccagaaatgactggatataataagtgggtttttttagtaagacactttagtttccaggaatttgatattaaaactggaaagctgaccactaaacagtctttcctatagaaagctgtgtagactgctttctataggagcagtctacacagctttctataggaaattacacaggaaagttaaaatgcgtaaaggataaaatttttcagcatagatatgtttcagcatagttgaaacatatctacttttttgtctaatcacttatggtggtataatcagtagaggtattggcattcaaatgtttcttaaattattatcatagccatgatattttcagattgtatgaattacctttgttagtcttatcaatactttgaaaaataaatgaaagaggaatgacaaatcaagtaaagagttgtttcaaactaggtatcaaaaattacaaagatttcagaaagtcttactctaattttaggcatgcatctataaacaaaagctataaatttccattcgcttttaagaatcaccatttcctttgcttggtgttttaatttat

SEQ ID NO: 133151 - DNA, 1960 bp, Homo sapiens
aagcattgattaattactttttctaaccaaaattgtcatatttcttaccccaaatgatggcaaagatgattagtatccagtttggagatgtttatatttgggagctttacagttgcttttatctgcctcccaactagagggtcatttacagaacgacttaaattttaacagtaaattaatgtttatccaggagtcgttttctttaaaaaccaaaaaagtctataggttaaacagaatattgtttctcaaacacataagaaaggtggtgtagttgattgttacaagtggacttttgaaatattccaaataaaaaattccttaaaacactttcagaactaagaagaaagttatagaagtgttcactattttcaacaatttcaagaaaaataaaatgaaatatcttcaacaacctgtatatgaatataatagctttttaatcagctagactcgactacattaataaaagctaaagaccatcattctaaagggttcatgctaataaaactaaaaagactacatatacacaaacatccatattataacaaccatctggtgacaccatctttctatgttttaatgattctataattatataatttaatgtctttatcaatttggagaccatgaaaaaaagaaaaaaatattgtttttacttaacaagtacataatttcctcaaatagttaatatttttacctccttcaaaaatgtttagaatgcttttaaatgtttaataatatagctaaaatataacttcttgtattttcatttctgctacattttcagatttttgtagagcctgacttttaatgttctttttcatctttcaaataactcattctagataaaaatttccccctttattcgagaaagaatgtcccttcccccaccccctgtcatttctactctcatttatattaaaaatcctaggccaatatggccaccaacagagttttacaaccaacagaatttttaactagtagaggctatgatttgacatgagttggacatttggttaatcttgtttttaatctacttactttaaaaagtaaccaggagtttgctatttgagggctgtatgtgttaagaatcgaaaaggacaatgcatcttttatgtttaattttgcatttgatttctttgtgtgcattgttaaaatgtatttcaaccctactgccttttattttaactgaaggtttaagcaggaagcaaatgtaactgttttagaagaattaagccttaattgtttttttatatataatgttttgaatgcctagaattcacacttcaaaaaatagactatttgttatccgggaaatggggaagagtagagaaatgagtgtgcttgacttcctttctggcctaagaaaggcttatggccacagtttgtcagggtatatcttataaaccataagtaacaatattacatttcattttgccacttagttttctgtccttacctggaaatacccatttagaaatgtattttttgtgttttcacagtttggagttttatactgagtgagaatgttattctctaaagcattctatgccatactacagagtgggtacccctaaatgtcaacagatttggatttaactctagaactatgttttacactccagaaggaaggaataagaaggtggttttggttctgagactatagctatgcaaaagcctttatcctgagattgtgatgtaagataggatagataattttctaattgcctaatgctaatatggaatgtttttcctttaaaataacttaaaatgtgaaatgaagagattcaaaaagtcagccagaatcttttcttttcctggttaattggatatatgttgggattcctaaatatctttctgagaggtccttggctacataagcagatctgtaaaaaccataataaccccatccacacagtagatatcaagtgataggtctgtttttctctgtgtgcgctttggt

SEQ ID NO: 133152 - DNA, 1027 bp, Homo sapiens
taacatttcctcagatatttagaaattgtatgtatgcatatttatttgtgaatggagttagaataagatcatttagatttgggtgtaatttttatttattggagcacttgtgagaaccttagtattttcttctttacaaagaaatactgaagtgttcactccttcaattctgaagttacttgattctcagtattttaatgcaaatactaatttggtttaaatgggaaatcaatatggcatattttgcatagttttttccttgcattaatatatttagataatatcaagtactttatgatggtaatcctaatgtagatttaagtgtttcagataatgaagcaatgagaagtatgcagccttcactcaatttaggaaagatttatcataaatgttttggcatagaagcagctgtgcttttgccatcttctaaatatctttaatgacctactcactagtcatcatgaatttggctcatatttttagatattagatgttcaataatcaaataattgaatctgaagttctactataaatagtgacttcctttctttatttgacggaaaaagtccctgtgctttttattcctgcccctagtggctaggggcaaagaccagtatatttaggacttaaatatgtctcacatggccttaaagttgtacttctgttttaaaaatggaaagaagtacttgttgtggtcatctgttttcttatctgttaacaaatgtttatcctgaggatgacaaatggagcatcacgtttgcacttttttttattaccctttcctctcttccccatgtgtgttcagcattacttagaaaggaattatagttagtcattatagggacaatttattcttgattattaaatactgtggtaattaaatttcatttctaagtgcttcttgttttaacatatataacacactttaaaaatcttttttaaaacccacagtattcatataatctcaaagaaaactacatttctttctttaaaaaaattaaaatatggaacacttcatgaatttgcg

SEQ ID NO: 133153 - DNA, 6165 bp, Homo sapiens
gcagtttgtattctttcaaagagcattcctatttcatgtttgttccttgttttaagacaagcaaaggctcagatggaacatattgtaaaagcaaaagaacattacttcccccttctaacaggtccttgcagctgtggaattccctgcctttgtgatcgatggttaagagtattacagtggaataagcagagttgggatggcaggtggtgggagggccatgtgttgtaagtcatgtggagttatggtaaaaatgaaaatcttggggtttatttggatcccccatgtattagctaataaacgtaatagagctatggttctattcttttataatttttttattggggttcatgtacaatcacatgcaaaatatagtagcagatttgaatatgttaagcattttgtatggttggaagatgtatattagtgtgatttctgtgttttatagtctagcccaataaacattcagataaaatgtccatggatttacacatttatgtgttcttttctgtcccttccccctacatcctgtctccatgccttcatccctctatcctgcatcaaagcttgtggtccttctccatccatgtactaaatggtttctttgtaaaccaagccatttgtccatcattgtttggggtccaaacagtggtaagataccctgtcaccgatcccgcatgctatgaatggcagctcctctccggacaattggcggaggggccgagaaatattcctgagaggattatttaacctttcaatttagagggcacaaagcctggctgattaatgaactttctgatgggtgccgataagcggatctatttctttatttcccctaaaagtgattccttcttctgtccatattactataatcttaaacataaaatgtggcaaatagattaaaaaacagcactaaagagtttatctggctggcaaactgaaggagctaaattaaaattggtaatgacagcagtggctcagcctcatatatggtttttaaatgcactgtgtattttgaagagacttattctccagctcgcctggtaatgactgcttttggtgcacagtctggggctggcttctgttatcccaccccaccctacccacccaccccccccccccccaaaaaaaatgagttgtgttatctggatggctgcagacacatacgcatccccctttctcactgcatgggcagacaaggtcgatagcattacaaggtatttgtggcagtgcttgtttcagttttcagagctgccagtttccaggcggatttgaattacaaaagaagaagctggcatgaaaattgaaaggttttatcggctggtctgaagcctcatagcacattgcttatttatgcagtccatttgcaccaggaaatataaaaaggaaatacatttttaaaataaggccataaagactcagatatgtttaagatggcaaataaaatatagatacctataatatctttccaggaaacgattttcacttaatgttgcacattacttcagaagagcatttatgttgctgtcataaatttgtgcgtttgtgtcactatgtaggtagtctctggggattaagaaggaagcctttgctaacttactttaaaattaaaatagacggagggatagctctgcagtttgagagctacattggaaatatttaaatagggtggtatattaaacttaaactaacatttttgcattccatgtaaaattagctatggcccaatgaataaatgctactacctttagagaaaattgggatgctttttaagccatgaagatttggagcattcaggaagtgaattactctgatccttactgtgttgcgtgtgttcattgttctctgcttactgaggttttctttctgttgttggagttgttttgatagggggagtgtcctgtttacaaaaagaaaggttataaattaataagcttaatagctcatttttataaaactcgtgcttctttttagttttcagatatattttagattttgcatagtggttaatgttgtgaatatataaccctttcactattggaagttataccaataatttatatctatttacattactttaatgtagttttcgatttactgaaaaagatacaatgatgtaatcccttatactcttgactacataaaatgaagacataagtatacaaacataaagtagtgcaagaccttgagtgattggtcattcgcagcttttcaacccattggtttataaaatttcagtgtatccaaaagagaagtagggaggaagttacagagatacaggaaatatcaaataactaaagcaacacacgttattctgcagttcaaatgaacactctttaagaatcttttttccaatatggcaaattactctcaggtaaaccatgagagatgcatttttttactatttttattttcactatttttaccagtatctgggtacctttcccatgttttcacgacctcgactaattacttcatgtagttgttttttgttttctttttaaacagagaaaatatcaaaagcatacatgtctgttgcatgctaatgatgtgctgtacattttttcatgaattttcataaggattttttctacgtagcatgtgtggcttaatgatgtaatcacccgatagactagaaaatgctccaaaggagacgttccggtctgttgtgtacataatacatgtttcaaaaatctgcctaattaaggaattacccaatggattgggagtctgttgggtacatgacatggttttttaacacataaaagtattatgtatatatggtacacatggtacttttaatgccatttttaacatatgaggaaaattagtagcaatgtccactagaatacaggggaattctgttttttcactaagcaaaaataaaagctttaaaaacagcactcttttaaaataattctaaagccattagcttggagaaaattcctcctagtattcctgaaagggaagtaatactgtcaatatttgccagaacagtgtacaaatggaagactttgtccaaaacctcagttgaagtaggcctagagttcaggtcccaggtgtgaggatccacctcagaaaaacaccttaaagggaggaaagggaacagtttttggcttttttgtaacacagcatcatctttgttgtctcacagcctctgctttggttcagttcactataaaacagtttgcctaacttttaggtttctttatttgattcttttaggcataaattgatttggaaatatgaaagaataaggttgttctcaaacatgaaaatcatattgattgaagaggtgcctaggcacatgtgatttagtcagtaagattggagccaagctctacttttctcagtgttatatttggttatgaatgcatttacctcaggtatttaatatatttgctttttaatatatgtcatatagcaaactggattaataaatagaaacacatagtgtagtctttaagcatatgtgtgattataaaaataaatccattttgcattcacagaatagaaaataccctttaattagtgaaattgattacatatcgtatatagtaatgagcttcagctagatgcaagccctcattggatcaaagtcagtttagataagggcagctgaaggtcacagagggagatgcccagcaggttcatttgcataaaaaattactgttagaaataggacactgaggcagctctagcattttgatctcttggcctttgtcatggagattcctagtagtgaagggagtaaggccagtgtcccagataatgattaactgttttaatggcattcattcattcattccacactaactactcatgcagaaaaaagggttatgtaaaatgacattagaagaaaatcatttgtaatcgttgcatcgggctgcactttgaggagacattaggagtaaatccgtggcgtggtaggcttatgctttatcttctgatatttactgagtttactggtgcatgaaaagctttcagcaagaatagcagatgggatggacctttcataggtaatgctatctaccaggttattacttctatatattgatagtaaagtaatctccaagatatcaccctacaaatatagattatttaaatgtctgcaaccaaaaaaaaaaaaagaaatacaaaaggcctgcttttataagtaattaatttggtatccgttgggtcaaagtctttagatgaaattttgacttaaaaaagttcacaaaaactacattcattgccttgcatttaactttttgtcagcagtacaggcacgtatgacagaacactgaacttagagctaatcagttgacacattctgctttaaattggacctttactgttaattaaaaataaagacatgctccaaggcataagtattgagtcacaaatttatatttctaacacaatagcttagagatttttgttagatcatagtatgaaaacttgtccactggaaaccactattgagttttcagtagtgtattctaatacagaaatgttctctaattaggtaagatctaggctgatttcattcctattaagccctagtacatgatagtttattaaaatgagagtatgtagatagcgtttgtcatgtcatttactaattaattattgtgaaacagtttagaatttcatagcacaatatactgttgctatttttattagtaataatggaagtttttaactactgacattattcagatgaatgaacatccacatgtttacatttctttcaggggctaaatttgagattcctttaaaataaaataagaagtgtcaacatgaaacatgctttcaaaatctcgattaagaaggatctctttgtccctggtactgtaagactgagttcctgttcacttggcattactaattccttcctgattttgtcagagtatataccacattctcagtgtgaagtaggggagacaataaggaagctgtattattaatttattcaagctttttaatatatttaagcatgatttgataggttttcccttaatgacataaaaaattaatagtttcccaaagtatgcaagtttttattaacaagagctaaatcatattggatgattactgtaggccatgtgctttacttatgcattacctcattattcattcattaatatttactgaactactactatatgcctggccctattccaggagctgaagtacagcagtgaacaaaaacagacaaaaatccctgccctcacagaacttactttctcctagcctggggatggggttgggagtggataggtagtaaactatatagtatgtcagatatgataagtgccatgttgagttttgtttggttggttggttggttggttggtctttttaaaataaaatggcagtacagcaggatagggagtacagattggagggagctagccattttaaatagggtgctcaggaaggccttactgagatgacatttgagccaaggcttgaaggaagtgaaggagtgcactatattaaatctgggagaagagtgatgcaggcagatcaagtagctggtgcaaagcgctgaggtggaagtttgtctggggtattcagagaacagtgaaaaggccagcatgacaggcttgctgtgagggaaagtagtaggagatgaggttagagaggtgggaggatgcaaattacaggccattgtaaagtttttggctttttctctgagatgagaagctgttagagagttttgagctgaagagtggtatgttctgatttgcaggctataaggatcatctttggtttagagtatgttgtagagggcagggatagaagcggagagaccagttatgatgttcttgtaatcatccaaacgagagttgagtaattggaccaggacagtactggtagagtggaaagaggtggatgtatttgcagagccaacaagctttgctgatgggctgggtatgaggtataagcaagagacaagttaaggttgttcgtttttggcctaagaaactggaaggacaaagttgccgatgagatgggaaagattttgggaggaacatatttggggtgggggaagaacaggatttgattttaactaactaaatttgaggtgcctgttcgacattctagtagagatacgtgagtgtagagttaacagagatcaaggctgaagatagaattttagaatggcaagcgaaaagg

SEQ ID NO: 133154 - DNA, 1807 bp, Homo sapiens
ttgttgagcacttcctatgttctaggtcaggggtcagcaaactttttctataaagagccaggtagtaaatattttagcctggcaggccatatggtctctgttataactctatccttatagtatgaaatcaaccatagaaaatttgtaaactaatatgtgtgcctgtgttccaataaaactttatagacactgcaatttgaatttcacataattttcatgtgttgcaaactattctgtggtgattattattattttagccattaaaaaatgtaaaaccagctgggcacagtggttcagttctgtaatcctagtgcttttggaggccaagtcaggaggattgcttgagcccaggagttcgagaccagcctcagcagcatagcaagacccccatctcctaaaaaccttaaattaaaagataagttatgtcttatatttgcacaaacaaacataaatagaaatatttgtgaacatagaccttttcagagagcatttattatttggagagtggatgatcctttttatcatcacaatccctgctgacagctaccaactagttattgatcacctaccattagcttcaaacccatcatgggcatcccatgccacttaaaacaaatccgatattcttcaccctaatttataaagccctaagtgatctggtccctccctgtcctctagagcctcctctttcactcttccttcacctactccacttccaaatttacaggtatttttttcaaatcctcaaatttggtaagtttgttcctaccataggactcggtactactcgttccccatgccttacgccaagagtggtgtttcccagacatcacatacatggcttttcttgttatgagaaaggaccttcctagttgaggcttcccccaaaaagtcaatctaagtcatcactagtgattctcattcatataactattttaattgtttgcatactatttttcgctaatattttgtatgtttgtgtattattggctctatttatcttccaccactggagatgtgagcaatgacttttatcttgctcacttctcagttacctgatcttagaacaatatctggcatgtattaggccctcaataattattttttgaacaaattaatgaaggaatgcatgcatacactcatgccatgggcccagcactctggtaaatctccctgatggaggcatccttcgacttgtattctgctctacttgtccccttcccttcttgcatacacagcctagtttctaggaaaagtgacctatgttctgttcttcagcagctttctacttataataaatccattacaatctggcttgtacctctacccctcgaaagaaactactcacaatagtttctccacttgccaacaacttcctatttgctaagtccagtggatttcatagtcttcatcttatataacccatcagtagcttttaacagtttcttccttgaaacatccattctgccttcatatctatgacatcatctcttttgtttttatttctcttaagccatgtatgcttgtggctgcaatttgatgtcacgtcaaataatatagctgtctttgtgggtggaaaatcatttctgcttaataatttcatgtcttcacagtgttctatctgaagaaatttgtgaaccactgcaataagggatacatggcttacatgcgtacctgttaaaactctgtttaggctgggtgtggtggctcatgcctgtaatcccagcatttggggaggctgaggcaggcggatcacttgaagtcaggatcaacctgaccaacatggcaaaacctcatctctactaaa

SEQ ID NO: 133155 - DNA, 1078 bp, Homo sapiens
cagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggttttgtttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaatacatgtgtttattatgtaaaaagacaatgagagtttgagtgacaaagagcatagttaatgtttattttgtttgtttgtttgtttgttgtagagacaaggtctcactgtgttgtct

SEQ ID NO: 133156 - DNA, 1729 bp, Homo sapiens
agattgtttggagaaggagagaaaggaagcacttttttttctgtttgtctctgcacattatcttattttttcccaaaacttacaaacattttgttctagggtataatttacctattgggtccatgtatttacatgcagataggaaaggatgctgagctacttcacctgtgggcatgaagatacagtcttcatttcctggtaagagaagaacagaaacatggaggagtctttgcttcatttcctcttcatttcccttgcccccagctgttacaccaaatgttcagttaaggtgaatcagtcagtcagtttattaacatacagactcttcatacaacaatggggagtttaaaatatgtatagattcaaccattaattaaataagactttacatggataaatacaagagaagaaaagcaaatgtccaaaacagtaaagatctgtatagttggtaggattaagaagattctaaacatcttacctctggcccaactttgatttgaagcagcttgagtggctcctatcttgggttctaccttggtttgtgtttggccttctcaaaacagagcaaggggaaccagtctcccattttctccatggaaagtcttgctttcatggaccttgctatttgcagtacttattagtagctctttatttttctgttatacaaagattatgtaatcattttaagggggaaaaatgttaaaaacaagtcatatgtgattctttcacacaaaaatgtagttaaaattattagtgtctattttttcagacttttctatacctatgtatacattgttttgtaacctgtttttcacttactttgggaacaaatacatgtctgcacttttgcatgatgttctattatatggctgtgccatgatttaatcagctccctgtcgagcattttgtttccaatttttattatttttgaaaaattcttctacataatatcttctccatttattcaattgtgataaaatggaatttagggtcagagagcatgcatatatttcataaaagttttaatacatgatgccaaattatattcccaagtcagattcttccccaatcatttatatgtccctggcagtttgtgagtattcatctccccattcccacaatcacatggaatattgccattcccttgtctctttgccactctgatgggcagcaaagaaacattattcattagtgctgcagtgaaaagattgatgtgggtttgtctgtgtaaggagagacaggattagcaatatagggaaaatctgtttttaaaagatgtggagagaagcttctcataggaaacaactgaaaattcttctgccaacaaaaaattacatacaaaataagggagcctttcatttgtttatagctgtcctgatcccctggtcttatgcttcgctttctcaacaaaaggaggatgctgctggcatctaataagtagaagccagagatgttgctaaatatcctacaatgcacagactagcttcccacaatgaatctggcccaaaatgtcaatagcgctgaggttcagaaaccctagttgaaaccccagctatttctcaaatggaattctgttcactcgagagagagttcacgttgccttccacatctaacaggatgtgcccttgtcttacaaggctttgcatttcatcatattgccagtgtttgagagactggttggacatggccattcatgtgaaataaggaacactagttccatggcatgaag

SEQ ID NO: 133157 - DNA, 1120 bp, Homo sapiens
catctgcaggccccactcacttttcctccactggcgccctcttgcctgccagcctaccctggttaaccttcctgggaggagagcttgtcaaagtcgcctccgcctcagcctcctttcacaaccctgcctcatcttccacaccaagtctcagggggcctgcaggacccaccatcatcctggagaagtcatgggtcgccagccacctgtctcctgtgcctgcacccaactaaccatcgcttcctgctaatttgcattgacaaccttcctgcacttggctgctcaggggagttttctggttttatctcctcaattaactttggcctcctgggtcactctggatttcccactgcagacctggctgtggaagcctgcctatatgctccagaggattcttgtcttttcacgagccctcccttcccatctgcaagccaggctgtgcacacagcaacatcttgcaagggagtctcggccatggcaggatttttgaagttctggtgggtgtcagagctgcaaagggccaaaggactgtctagtccactctagcccacccgactttgcctcctctcctcacttcacagatgggaaattgaggcaagaactgagaaaaggcttgcggtggtcatacatcaagtcagaataatggccagacccaggccttggtgccccctcaaccccctcacactctctctgccacattttgtcaacagaaaacaatttgcaaacttcatcaagttaggagggagtgaaaaatgtgtttaaatattgagcttcaacagccttgttacttctaggcaccttcagctatttgcaagaatctctgggcatagcatgagccgggctgtggcatgggagtgaggggctggatggagaagaggcctccctcctgggccaggaagccgactcccatcccctcctttagcaccgtggactgagcacctctaaaataacacctcccatggagttacgatgcgtcagggagcaaatgaactctgagatgcaggaactagacctgaggacaggaggaaactgggaagggagtggggagcagcagcagagcaaacagaaaagatgcccgaaggaagcgagttcctaggccaccaggggccaagaccccagcacg

SEQ ID NO: 133158 - DNA, 1047 bp, Homo sapiens
ggccgcctgcttggccgcccagcccctgtgaatgtgggaaagctcttctctgtgctgacctgagagctgtccccatgccttcccccttgcagcttaggctctgctggggggcccctcagcccttcacctgtcacctgctgtctcgggacagttctgagaccacccctgcctgaccctgcctcccctcagccagccccgggcagcctgaggccagggccatcagaggccaggattcccagctgggaggggcggggacaggtgtgcggctcctgcttctcctgagggcctccctttccccgcagctgtgaggtggagcagtgggactcggatgagcccatccctgccaaggagctagagcgaggtgtggcgggggcccacggcctgctctgcctcctctccgaccacgtggacaagaggatcctggatgctgcaggtgcacactgggtgggcaggggacttgagggtggcttggccctgtgggcccctcagcctgtgctgctggctcctggctgctctgcagtgctgtctgggttctgagggcgtttcctgcgataccaggcccgagcgggcagatagcttgctctggcacaggcactgcccctccctcctgctgtgaaccccttggcgggggaccctaggagggcaaagaccgcggtgtggagactgtgggtgtggggaagtgcatccaaggccctgggttctccagccctgccacaaccttgctctgtgacctccagcaagaccctgccccttctgggcgtgtgcgtagtatgagggaggacctagctcagtgccaagccccagcaggatgtctttcctcaaccgcagccacgggtctcagcccatggaagaataaacctccccctgtgaggctgttgtgacagttttgagaaaaggttcagactcagaggctgccagatgggaagggacccttgtgagtcagtgctgagccgccccacatcctggccttggcctggaagctttgtggtgtcctgcttgcaggagagggtagagagggtcacgtcccagccaccttcttggcactct

SEQ ID NO: 133159 - DNA, 1030 bp, Homo sapiens
gaggcaggtccagggagcagcacaagattacgcaggccctcagagagcaactgggtagactgaaaagcaaaatctcatgcatgtgcgtagctcaaagacagaaaaggcgggggaaggcagaagggaatgatttgagaggaacgaccaattaactgttaatagaaggtttggtttaaaacaaagtactagtcaaagaagggctggcaaagagatattaccctctttggtttcaaccttaataacgtaaagaaaaagaacacatatttagaggcatgaatatgacaaattttttatttcaaaaatctcaagttgtaaccagcatagcaccactgacatggatgccttgatagaactccttgatagaactttatgatctgttcaccagaaaagattctacatgatcacgccagactataattaaggctaaccaatcaaaattcaggtacccaaaaccagttataatccaggtagaaactacagatcataggaaccctgggactggttttccagggaaccctggaattattttttaagtgctacagcatgtacaaggacactggcccacaagcttgcttctcacacgtagaaactgacagactaagaggtagatgagagattccaggttccatctagcagtggagaggcagggctccagcatgtatcagagataagccccaaaagcaaagtccacttatgcttcagcagaggtaagcgggcaggctcctggcaccacctcctccaaatggaagggaaggagggctgcaccgctctgcctgtgtcactggctcctctccctgggtccaggcagggcctctcattttctccaggctaacccactgtgtcccaaggttaatctcacaagacactggtccctacatcatgtaaagggtggatggggagcctcctaacaccatgtcaacatgactgctaacaaggagccacacacacaactgaatttcacaggacctcatatcctccaatgggctctttcccacatctactcgaaaggaatcgtgggtttccctttggg

SEQ ID NO: 133160 - DNA, 1050 bp, Homo sapiens
ggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagatta

SEQ ID NO: 133161 - DNA, 1084 bp, Homo sapiens
gggtttcaggaaaaagcacggggcaaatgcgtgtgtgcaatctgctaccatctataactggaaatcttccacactaatattgatttgcccttttcacttatttagggttcctaagactttggaatttcttggtattcattcctcatccttagggaatgcagaattctaacaaacttctgtgggatagatatgccatcactcacacactggtctttactaatttagacccttagtgttatacatggctcatatgaagagtaaaggggagcctgtcggtagctaggcccacatgtgtgcatgcctcctgggctgatggctgaattgccatttgcttcttatatgacaagctcttagtgtatgtgcccattatcagagatatcacgggcttcaaaggtccaagcttggccatccattccactcttttcatcataccctttgtgttctgactttgaagcttttctaggtcttaacattttctttctttgtttttctgtaggatcatggattttcctggtcactttgaacaaatcttccagcagctgaactaccagagacttcatggccagctctgtgattgtgtcattgtagtggggaatagacactttaaagcccaccgctccgtgctggcagcatgcagcacgcatttccgagccctgttctcagtggcagaaggagatcagaccatgaacatgatccagctggatagcgaggtggtgacagcagaggcctttgctgcactgattgacatgatgtatacctccaccctcatgctgggggagagcaatgtaatggatgtcttattggcagcctctcacctgcatttgaactctgttgttaaggcatgtaaacattacttaacgacaaggacgctgcccatgtctccccccagtgagcgcgttcaggagcagagcgcccgcatgcagcgctcctttatgctacagcagctgggactaagcatcgtgagctcagccctcaattccagccagaatggcgaggagcagccagcccccatgagctcttccatgcgcagtaacctggatcagcgcacgcccttccccatgagacgccttcataagcgcaagca

SEQ ID NO: 133162 - DNA, 1057 bp, Homo sapiens
aggtctcttgagtccggacacccatctgtgaatttcctaggtgtccccctgctttgcaaacatatataactatatttaaatcatcttccaactgttcttgtaaaatccagggaggcaaggaaaattgtaatttaacgtgttgattaaacatatttttgttgttatatgtaagaagtttgtaaatatgagtttattctaggtagcacacacacagagataacatttaagtccttactatatgctagtcactgttctaagcactttccatgcatataccaaccttctggagtaagtactgttgttctttttttaccagtgatgaaactggcacagaggttagatgaccttatcaggggtgatggctgagataacaggcaaggccactccagagcttgtactgttgtgtactaagttatactgcccttatttgagtactttgtagatgattggagagcatcggtaagtaccacatacctcatgtttatgcctgcttttaggtctttcaccaagaaagcaaaattattttctggaaagagccaaggacttgttttctaatcctgtctctgccactacctggtgaactgacctggggcaagtaatttcatctgtgggccttctgttttttaatttctaaaatgaagaggttgggctggatgaccgcttgatttggctaatttattttccaagttctttaactgtatactaaagctgcatattaaatattcacagtatacactcatgttaggctcagggaagtcctatagtaaagaaatctattattcttagatagacaaatgaatattaaacactattactatttgtaggcctcccaattgacttttctttctctctgtttttgtgtgttttgatagatgtatcagttgagagtgaactggcgctagagagtcagaccaaaacttacagagaaaaggtgagtgtgatagaattaagatgtgggaccttaagcaagttccttctacacctcgggtttctccatcagtgaaatgagcttgttgaactcaagggtctccctggctgctccccgctcattcagtct

SEQ ID NO: 133163 - DNA, 1027 bp, Homo sapiens
tgtgcctaaaaccacagacatcttctgggtttccaactctgggtaggtatgagggtgtgacccgcaaaggatcctagctacaggtgacactgggttaccatcagattgactctctcctgttagaaataagctgacacaacacaaacctgccacaagccttcaagatacatctgtgtaactcataagctctctctatatatacacacacacacgcacacacgtggctgatgtttgttctaacagtcccttaaagttttccttttatttgacctggatattctactttgcctcatgcagaatagaagtagcaaatgttagctctggaaggaccctgaactatcatataatccaacgtggccccaattttcagatgagaaaatgggagatccagagagaaaaaggggcctggcaagtcccctcgacatgtcagcagtaccagaatgaatctcacagttgacagtaaagacttggacagacatatccattttcttctctcatcagaactcatctaagaattacagacaaataatatactggaaacaattagaataaaatgtttatcatagacttacttttccgcttaactaccctatgagctcgaaatttgatgagggtatccagaaaccatatgcatcgggcctggcggtctcggctctccacatctgatggcaaagacttcaacgcttctatgacaaaggtgcaatggctaaaacaaggaaaagaaaaggaggcctgtgtcagggtaagatgggctctgtcaggaactacttccctcttacaacgagaacagcaggcgcctctcaccccgacgcactcaacagctgatgaaaccctgggcaacaaggcaagaccccatctctacaaaaacgtagccggcatggtggcacatgtgtgtggtcccagctactcggaaggctgaggcgggaggatcacttgagcccaggaggtcgaggctccagtgagctgtctgcgccactgtactccagcctaggtgacagagcaagaccctgtctcagaaacaaaaaaa

SEQ ID NO: 133164 - DNA, 1050 bp, Homo sapiens
tctctagcagtccgtggagggactgttctgagggctgtccacaaactgtgttcccacaggcagtgaggctgaaaaaaagagaacaggtacttggaacctgtcagattctagcaagtgctcaatcctggttgctaaaagtttggttatgggaggtaaagaaagttgctcacggggctgtagataccctggtttttcatcacccatatggatcttttgaagggcattaaaatgaaattggctgtctgatggttcccagcgggtgaggggaccttgcctgcctctctgccaggggctttgtgcctgctggcaacctttgggattctgtctttatggcctggagcatgaatgtgctgctaccttttgccaaacctccctgaacagtcatgttgaggggtctctccagttcttctgtttatgtcttccttaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgca

SEQ ID NO: 133165 - DNA, 1066 bp, Homo sapiens
gtctcaaaaataagaagcacctctgctcggccgccccaccgtctgggaagtgaggagcacctctccctggcccccacgctgtctgggaagtgaggagcgcctctccctggcccccacactgtctgggaagtgaggagcgcctctgcctggccgctgtgcaaccctccaagtgtgaagtggcaaccttgtgtgtgatttttctgccctacccaggtttgcatctttgacattaaagtttacttttaaatttaaattaaattaaaagttttaaattggagaaaaaaaaagacagtggggagccatggaaggttcttgagcaggggctgagggggtatactcacctccattgtgattaatactgttagactcaacaagagctatggtgatgggccggcgcagtgggtcgtcctccttctccagctctgtctcccagaggatggcgtccccatcctcgctgaagttctcttgagccctgtggcctcgaggtaactcgctggagccatccttctggctaaatactgccactccatacaggccattgtagctgacgtggttgctggtgacatgggggaggctggacgacatcatccacacaccacagcccttgttagctgggacagtgagaggagctggtcaccgacactgaactcaggtgaagcggcacctgagtctccctgagaggggaaacaaaagccactggcctgggagagagtccctgccttgctaatgacctcggacaagccacctgatggctctagctgcagacttcaccttcacacaagagaggtcatcaggatcaggtgaacctcacaagctcggctcgttccacacagtgtgaaagtgctctgaggactgtcaggccacatgtccacatcagaagcacatgagcccacagtgacagtgccaagggggcaccaatccctccctgcataggaggcagcctcagttggaatcccagccctaccacttcccagctgtgagaccctgagcaggttaccagacctctctctgtccctcagttttctcatcttttaaatggggttaataaccgtgcctccttcagaag

SEQ ID NO: 133166 - DNA, 2014 bp, Homo sapiens
ctgttgttcctaccatatgagtcaggctggatgggaacatcaatttacttgagcagattggtatcagattccctctgaggggagagaaaagtgccaggcatgtgtagccaccgaaaaaaaaaacacagtacggtgattgactgtcagagctggaggatgcctgggaaaccatctaatccagctgtctcctttgcaaatggagagactggacccagaaggacgacaggactttgattttgctcaggacccaacagagtgctggcagtgggtagtggagaggatggaccttttaccaggcactgtgctttccctcagttctaatctcattccgcatttattcagcagctatatggaacccctactctgtcttgtacacctactaggatctggacatagagctgtgaacaagacacacatggtccctgtcctcaaggggctttttccagagctagctatgttagtttgaggttatataatgttttatatatatatccatctccctgcccgttctcagtacattttaaaataacaataagctgcagctcccagtgagcttacctcataacagctggcctccagggataggagcacacagagaggcctgaattgtttcctgatccctcacaccagttccagagcccttgctggagcctggtgagatttgagagactggagaaaaagctgctttatcagggcttttaagaaaggatttccttctgccctggagcacttggatttctttgtctttctggtttcaagcctattattgtttttagatttctgagaagagccgccttcaccatagtgccatcattttggttgccgtggttatcaggggaattgtatttttatgatcgcacaagtagctgttaagcaataaatgctcaagcagtcaccaggtcaccatgagtttccgttctctggtttctttcagttgcagtgcagttacactatcccttccttccctccctccttttttccttcaataaacgtgcattggtggcagtgccaagaggagtgggagtgagtagaaatagataaaaacatacgtagactctggccttagggacctcagattctttggcagggataaaactgagggcagattagtgggggctctgatgatgtagatagggagtcagcaagagctctcagagatgggagggatggtgtcctgggcaaccaagaagacatcacttgcttttcacaggaagatgtgaagtaaacaaattccttgtacctgcttcagtcaggaaatagatggaacaagtgttttgttctttcagtttgccttaatgaatgaacctattcttgagttacctgtcatgggttttgtttgaaatgtctgctaatttctctcattaccctcttttagtttagtgattattagtttcccactcgtctaaaatgtttgatactgtatacataaaggaatgtacacaaagagacatttgattaagattttgtctatttcagtttagatgtttaacatgtgtgtctcatttcacaagttgggtttacattcactcttgtctttccttatttttttctaagtagactcccaagtcctctctaatgtccttattagtgagaattccagtgtctccttctccagcctctctgggggcttatacattccaatggggtcagtcttactgtcactctccagaggagagagaactgcattgtctgagcagtccacacacattgtcattcctgacacagctatatggcataactgttgaagagctgtcctacacagtccacggatgtgtgatcactgctgctcaatgcccttattggaccaaatctctgccagcatgattccatgcttggttttccaaggttagagcttgtttcatttatgcttgcgtgctcagccattctccccaaagcacctcactctgggcttttgttgagcttttcaccaggctgggttcccctggtgtcctggagagttctcttttagggcatttggggcccttcctgctagcaaccttggtcatggtcatct

SEQ ID NO: 133167 - DNA, 1030 bp, Homo sapiens
tacctaataatcacatcaggataacgggattatctgtcacctcatttataatttatttatgttacaaacattccagttatacttttagttatttttagatgtacagtaaattattattgactgtaatcacccattatgctatcaaatactagaacttattcattacatctaactatatttttgtacccattagccatccctgcattccttccctaacctttcctagcctctggtaaccatcattctactctgtctccatgagttcagtcgtattaatttgtagcatccaccaatgaatgcttataggtttttattgatttcctccccttctttttccttctgctctctttttagaacaatagtacttttaatgttttctttttcctttatattctattttatctgtaattgcttttctctttttttgtttcatgttagatgctttccttggttgtctgctcacacttaaaaattgggaactaacatggattaaaggcctggagtggagcttgttgatgttgaactttgccaaagggccatctattgggccatttttgttgagaaaactttttgcgtctgtatctttagttatttcccattgagctggtcattgctcagagaacaaagactcttccaatctcccaagtgctgaatgaggccctgccaacgttctgggattcaaaggaatagggctgtggtgaggctcaggacagacaggtgtgtgtgtgtgtgtttcaatatccagtatgtatttgctcactgcgtctctgttttgagtatagtacctctgcccaaactgcctggcatcccataatctagagaccttctattttacccttttcagaaaataaactttttattttttggagacagagttttgctccaggctggagtgcagtggacgatcttggctcgctgcaacctctgcctccctgactcaaacggttcttgtgccttagccacctgagtagctgggattacaggcgcacaccaccatgcctgtctaatttttgtagttttagtagagatg

SEQ ID NO: 133168 - DNA, 1502 bp, Homo sapiens
aataataataattccaaactcacaagattaaatgagatcatgtataacagtgtctaataggatgtttgcatgtaataggtgttggataaaagtcaattctttttatcagagggttcatgggcaagctgaataagtgtttgaaggcaccattggagtaaatagtgcttttggtttaagcatgtgcattgatttagaacctcaccagcagcagagagttcttgtgacaatgtgatgtgtcctcgaggtgcctcctgattcaaggggcaggggctttttgttatttggaaggtgttcagatcagatactaacatcaacaacaggcaatgccctgtaaatactgttaggtggtgggaggtcacagaaggctaatcagaaggctcaatccctgcctcacacaagcttatcactatgtactcaaggacccagattggtgggggaggggggcagatttgacagacacagctctaaatatatcagctttgtccatatagctgggagcggggtactggctcccttctgtcttagatttgcagtggtcaaagaataggatacaacctgggtagcatagtgagaccccatctctacaaaaaatttacaaattagctgggtgtagtgggtgtgcacctgtggtcccagctacttgggaggctgaggtgctgaggtgggaggatcacttgagtctcactcgagactgcggtgagctatgatcaggccactgcactccagcccggtcaaaagagtgagactccatctctaaaaaaaagaagacagagggtgaagaataacattgcaataccttatgaccctgtgtagcactatgtagcatctatggtactgtccttcattttttcaatcaatggttgttcatagaacacctgctctctgccagaaaattgttctaggtgcctcgagaatacatcggaacaaaaggcaaggtctctaccttcctggagtttatattctagttggagaaaataatgaagaagtcattacataaataaggtaactacaggttgtgccaaaggctgggaagaaaataagtggggaaatgtgggagaaagtagtaggagtgggactccattggagggtggtcagggcaggcctatctgagccagtgagagccacaggagagagggagccagtcttgcctggagctgggtgagggtcagtgcagcagctctgtatctgtaagaggtagggtagttctgtgtatgagaatgcagactctggggccacaccacctggatttgaatacttgccccttggctaactaaatatattccactatcaggttatttaatcttctgaacttcagttttttcatctgtaaactagggataataacagtacctccttgagagggttgttggataactgaatgagtcgatacatgtaaagtacttagaatagtgccagttatgtagtaagcaccaaataaaagttcaattgagggtgagagaaggaggaaactgttccaggctgaaggaacagcaaatgctaag

SEQ ID NO: 133169 - DNA, 1019 bp, Homo sapiens
aaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaaggagcttcgtgtgtttctaat

SEQ ID NO: 133170 - DNA, 1028 bp, Homo sapiens
ggacttgctgaaggtatcttccaatggtatcttgtcatttatggctgttttttcattctgtttctttttgtagtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggtaattacgggagcctttggtttcaaagaaacaaacatccattccctagaacactcacatatccagaaggctatctgaattgtctccaaagcatgacctagatctctgagcttgtatataattgccccaggctccaagagtttcttcagatgctccaggatcagagccacataattattattattattttttacatttacaatttattttacattggctacatttgttcttgggatgtttcatttctactgagttgaaaggttgtatctatcatcgccattatttgttatgtccatatcctctggacaaggatgtctgctgtaggcttagaggagggacaggtggtgcaaattgacattatcagctatccatccatcctggctgtaggtcctaggagctgatagaggagtaatattgttaccttgggttttcaatttgagcttttcaggtagcatagccacactcttcttgtctatccagcctgaaatttagtgatttcttcacctcttctcattcacttctcatgcaaatttagttgcttaatcctattttgatcctatttgattctgtctctgatctttggcatgtccgtccctttatctccacaagttcaggcttcagctccctcttgactggtctcagtcacttcttcattaatccctgcctccacgcttttacctcaccatccaggattttgagagctgacatcctcacacggtcactttctcgaaaagacaagattctccaaaatctacagaattccttggcattacactccaggtgtctttcctcatccctaattata

SEQ ID NO: 133171 - DNA, 1026 bp, Homo sapiens
ttttctatgtaatgagattatattacttttataattattacttttaattttctaaaaaaagaaataggtaaattactagtcaacgtaacatactgggtgttttgatgtaactcctatgctcaaaacacatagaacaataaattaaatagtacaaaaagtatagccaggttctgaaacaacataaacatctttgtgggccagaaatgaaacatggacacaaagttttaaacggggctgaaaccacagaccagctggctttcagtctagcactgacagctagtagttttgctcctgtcaggtaaaaggattaagaagtgcttaagtgtttcatgcgaggcaggaaccagagccagaatcactacatgaagtccggggtttggttaaaatatctgtcttatttatgaaaggctgaaaagagaaaagagctattcactacccgagactataagttttagctgataaaaacacagcctcatcaatagctattgaatgaagccacttgctgagtcagtaactgaatgtctatgtatgatatttccagtatcatgattaaaatggagccccgaaatgtcattataaggcctagttgtggactgggggcccagatggccaagtgggagcaactctgaaaccattaaataggaggagagagagaaattaaaaaccttttctattcaaaagaaacctataacccaaattctaaaatttataaagacatataatattaatataacaaaatcagccaccaaaacattcatttctctggatgaaattaattttatggagcagttcaacaaagactttattttaaaaaataaattatgtatttatttttgactagtaatagatgcatgtagtacaaaattcaaaggtacaaaaagggtaaacagtgaaaagtaagtctatctccacctctttcacctagccacccagtttccctccccaaaggcaaccactgttacccatttcttgctatcctttctaagataattgttgcatatacaaacatatatatatatatacaca

SEQ ID NO: 133172 - DNA, 1034 bp, Homo sapiens
aggctgaggtgggacaatcactggagggcaggagttcaagactagcctgggcaacacagtgagactccgtctctacaaacaatttaaaaattagccaggtgtagttgcacgtgcctatagtcccagctacttagaaagcttaggaggaatgcttgagcccaggagtttgaggctgcagggagccatgattgcaccactgcattccagtctgggtgacagagcaagaccctgtctcttaaagaataaagaagaagaagaaagaaattaatgcatatgtggacacggaggtatatgaagaagattcattatagcattgtttgtaatagagagaagttggaaacgaatgtctatcaagaggaaatattaatagataaataaattctggtgtactcatacaatgaaatactatacatcagttaagataaatgaactaaaagcatcagcatctgatacacatctcagaaatttaaagttgaggtagaaaagaaaaaaatgtagaatgagctttatatagtgtgataccatttacataaaatttgaaaacattacaaacataagcttggtgagggcatgtatttgttctgtgctctatcccagcatctagaattgtgcctagcatatggtgggttcttattaaacatttacagagaaaaaactgaacgcaaaacaatactataaagtgtttatggttacatacatatgaattcatggtattaaaaatttacatgggaataacaacaacttttggatagtggttccctctggggaggaagagaagggaagggactggggagggatatacaaggcacttcaactgtgtttgtaatgttcaaaaatatgtgaaagataaaatgttaaaattgataaagctgagtggtatcacagatgtttgttatatttttcatagttttctctatgttgctaatatgttataatttaaaaatttcttagaaagataagacttgtgccaagttgtttgcctttactcaaaacaacctttggctaatccgctattagaatgtattatttatcaa

SEQ ID NO: 133173 - DNA, 1036 bp, Homo sapiens
acgcctgcagtcccagctactcgggaggcaggagactcgcttgaacccaggaggcagaggttgcagtgagccgagatcgcgccactgcactccagcctgggcgatagagcgagactctgtctcaaaaaaaaagaaagttttgagtgaagatctgaagagtctttggtgcatgagctcaagtgtgctttatttattaataatactaacttccattttttaatgctttctatgtgccaaaccttctgtgaagcactttttatacattacttaatcctcacagtatccctctgtgagacagatattgtagctatttaaggaataaaaaactataactcaaataaagagatttgcccaagttcttagatatagtaagtggtggagctggaattcatactcagttccattagatcacctcactgtactgttcagagacaggggcatgcattttctggtttgaatctagacggtcattttgtacatacttggtaatgtcttctagttcatttcttagttttgtagtttgcttattatcttgtaaaataaaaaaataaaaaacattggtagttacggacaatattttctattacttcatattttgggaaagtagtgggaaaagtctgtaatttaaatacttacacccattatacaggcttacttctcattcctgagggatctgtatgtggatttagagttcctttaataatcattagctgggcgtggtggccggcatctgtaatcccagctactcgggaggctgaggcagagaattgcttgaacctgggaggcggaggctgtagtgacccgagattgtgccactgcactccagcctgggcgacagagcgagactccgtctcaaaaaacaaaacaaaaaaaagatctaggtccccccagttatgaagttgcagggagaagcccggaggtcatcataaaaatatttacttagtgatattacatttaaaaaattagtacctatttagtcgggcatggtggcgggtgcctgtaatcccagctactcaggaggctgaggcaggagaat

SEQ ID NO: 133174 - DNA, 1068 bp, Homo sapiens
gctaattttttttgtatttttagtagagacagggtttcaccatctcggccaggctggtcttgaactcctgaccttgtgatccacccgcctcagcctctcaaagtgctgggattacaggcgtgagccactgcgcccagccgattttttttcattaaaaatattttcagtagaaatgttttttgttatcgttatttttaaaataagagatggggtttcgtcatgttgcccaggctggtctcaaactcctgagctcaagtgatccatccatcttggccttccaaaatgttgggattataggtatgagctaccacgcttggccaggaaatgtatttttataattaaaaaatagttactggtaatcaccatagaataaatccataatgtattccctagtcatctctactttcccacacacagcactcctaactgctgcttctcagagggcaccatccgctcacatgcctgtgtatctttgcttagtaaccctgaccacttagggagttcctgctcatcttttattcagttcaaatgataacatcatgaagtctttcccagccaccctctttgcttattccacacaattatttcgtgtaattatgtacttacagtgtcttttctgctaggcagtgaacttctctttcatttattttgtaagtatttgttgagtgcatatgtgtctggcaccatgtgtattgtatactgcagatctaaccatgaccctaggcagacaggttccttctgtcttcagggagtttacagtaaagttgttccttacagtataatattaagtattatgatagaagctcccagaatgctttgggagctcagagaattggtaggtctaccaggctggttaaacaaggaaggcttcctggagggcataacagctgaatacagttatatgccacataacaacatttcagtgagtgacaccatatacaacagtggttccagaagattataatggagctgaaaaattcctattgcctaatacttactatgttatacttattattgttattttagaatgtactcctacttaaaaaaaaattaaactgtaaaacagcc

SEQ ID NO: 133175 - DNA, 1076 bp, Homo sapiens
gtaacatcaggatttgatggaaatgtcattatttgggacactaacaggtttgtgaataggagaccatgttaggattatgaacaaaaacattttttttaaagatggtgaacaaattcagtgttctgtcctagcctcaagaaggaaactggctttaggaaaagcaaccaaaaagtgatgatatattttgttaattgtacctagtcatatattgcaactaaaaattttggggaaaattatacaggaaggagaccaagtagtatagttaatgatgaaaactggcttataaaaaaagagtttcctgaatttaaggaaaaatatttttgttatttctcctgtgaaactaaactgtttctcactttttcttccctcaattctacatatatttattttgcaatttttgttctttgttttcatgcattaaaagagtagttctcatttggaatggtactgatctcaaagggaatgtttaggaataaagcgtggggcaattttggttgtcactatgggggaagagaactatctactagcatgtagtcagcaaggaccagagtttctaaacctcctgcagtacacaggtcagtgtgcacagtggactagttgtcccacctaaaatgccagttatgcctctgttgtgcaacattccaacaaaatgtctccttataaagaaattgatatttaaagagttgaagtttgaaaaacaattaaaatatgcctgctttgctagctatggtgaaatgataatatagtaaacacaccatgatcatttctgtgtatatttgtttttgttgttgtttttgagacagggtctcgcattgtcacccaggctgtagtgcagtggtacagtcacagctcactgcagactggatctcccaggcttaagtgatcctcctgcctcagactcctgagcagctaggactataggcatgagccaccatgcccacctaattttttattttttgtagagacggggtctcgctatgctgcccaggctggtcttgaactcctgggctcaagtgatcctcctgccttagctcccaaaatacaaggattacaggcatgagccactgtgtgtggcc

SEQ ID NO: 133176 - DNA, 1102 bp, Homo sapiens
ttttgtttatagtgttgttattgcaggtgcttaagtcctgatctttttatttgcttaaaaggcaatcctcatggcttccaagtatttccttctctggaccagaaagcaccaggaccaatgagaggagaattgttaccttttacctttctagagtcctttcatgtcacataactttggttcttacttaaataaagagctttctgagatgtaagatccaaataaaagaacccctagtcagcttctatgccttagccttaggtcagtgacaattactgctgtgggaacttggatcttttgttctatttataccctttccccacaccttcaccccgccaaaactcacacaccatacattggggagtaccacgctctttaacatatggtagcataaggggcagactaaggaatgacggcatgggaggtggctgccagaaataaaaagctttgatgaactgccttagttttttgataatacaaatcccacatcctcattttcttatatctcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggaggtacaggcagcagcactccaccttcaacagggctcattggacaaattgccattgccgtgtgtgcagagcttaggccgatcgctgactgcagtctctgccttcaagggcatactgctagagatcctgcttctcgactctcctgtttctgtcctctcttgcttcatatggtatcattatcccttccaaactcttcttattcctctcctgctggggttgagcaaggtgggaggtactttaaaggccagcatcagctcagtttttgcccagcttcttaaatcttgcctctttcatctcaccctaaacaaacaaacaaacaaacaaacaaaaaccccttgtataataaacataggtctgaaatgtttcagctaagctggctaaatgtgagattttactaagccaattgagtatcataattttctttttttaaaaaccaggggaaactctgggaa

SEQ ID NO: 133177 - DNA, 1528 bp, Homo sapiens
tccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattc

SEQ ID NO: 133178 - DNA, 1030 bp, Homo sapiens
aatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagact

SEQ ID NO: 133179 - DNA, 1118 bp, Homo sapiens
agtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcag

SEQ ID NO: 133180 - DNA, 1001 bp, Homo sapiens
taaatgcactatggctggttaaatacagtgaccatccttcttccagctgtaaaggatgaagcgtattaagcattagccaggcagtaataaagctaaatagccatacagcagctctgacaatgttgtgctggatattgcagtttgctttcaaggtgcagatgtaaggatttaaaaaaataataatttggcaccaaataaatatgagtagcatccattggcctattaaatcgagtcaggatttgaagggaattgagtttgagaaatgaataaataaaggcaccttggtgcctgaccccctcaatcatgcgtgtgactttgagcactcacaggtgtgtgcagctactcagcccagggcaggtgggttagcctggggttataccttggccctgggaatagacaccattgggcctttggttttgttgggcttccttttgtctttacactccacacaggtggtagaaatctgagttctaaagcacttttgtgaaatacaagctaagtgagaattctaaagaaaatgctttggtttctgctgtctcaaataagtggcatttaaaaacaattattaataaatatttttaatggttttaactcagtatttttttttatttctttgtcactctttacagcttttgaagaccaaactgcaaatacattaccagggatggttttgtgttgtcctatagacttcttaaatttgacaaaaaatttagcagaacttgtaaccaacagctttgtctgaacttgaagtcaaaatgtgttgttaataagagattctaactattgcttttaccttcagtgtgaactagtgtggtaacaactttgaaaaggcaggccgggtgcggtggctcacgcctgtaatcccagcactttgggaggccaaggcgggtggatcacttgaggtcagaagtttgagaccagcctggccaacatggcgaaaccccatctctactaaaaatacaaaaaactagccgggtatggtggcacatgcctgtgatccc

SEQ ID NO: 133181 - DNA, 1159 bp, Homo sapiens
tggtggcgggcgcctgtagtcctagctactcgggaggctgaggcaggagaatctctttcttaattggccaaatataagttggtgtcgtaactccaggccacagtgagttatgggcaaagcttttttccttaagcatcaacaaaataggataaaaggttccaataggaaaatacaaggttttttttttttttttttttttttttatcattacctaagagctttaggctaattgcctggtaaatagctgtccatctgatggcctttgacagggaacctaatccccaagataggattctttttcttaaaccaatcttgaaatcgcctgcattgaaacataagtggctgtgaccggccagaggagaaggtcctcaggggccaggggctcctcaggcttcctttgttactccattgcttgcttctctgccctcaggagcagctgcagaggacagtcttcattaagctcaagcatatgacaaaggggcagaacagaaaagaaaaacagcttattaggtataggcttttcatgataaattgcttgtattagttttgaaactaagcacctattggataggcattatactatttctatttagatatggtagatcaaggagctatgaaagttcctgttttgctttctaggtttgaaagttttctgtttgattctgactgtgatcttcaacccttccaaaatgtccttgtgttataatttcacttatttcattgccaaaagatgaagggacttgaatcttgttatagttgttccatcctgttaacaagttttcattttgtgtgtggatcaaattctggttagcttggtttctttgaattactggtgccatctcagcaaaggcctgtggttatttttccccttgagtgggagttggtcatattcaagcatcctgttctcttaaaactctccttttaaaaaataaacacttccataacattttgttttggaagtctattaatgcaatcccacttttttccccctagtttctaaatgttaaagagaggggaaaaaaggctcaggatagttttcacctcacagtgttagctgtcttttattttactcttggaaatagagactccattagggttttgacattttgggaacccagttttaccattgtgtcagtaaaacaataagatagtttgagag

SEQ ID NO: 133182 - DNA, 1438 bp, Homo sapiens
tcctctggccggtcacagccacttatgtttcaatgcaggcgatttcaagattggtttaagaaaaagaatcctatcttggggattaggttccctgtcaaaggccatcagatggacagctatttaccaggcaattagcctaaagctcttaggtaatgataaaaaaaaaaaaaaaaaaaaaaaaaaccttgtattttcctattggaaccttttatcctattttgttgatgcttaaggaaaaaagctttgcccataactcactgtggcctggagttacgacaccaacttatatttggccaattaagaaagagattctcctgcctcagcctcccgagtagctaggactacaggcgcccgccaccacgcctggctaattttttgtatttttagtagagatggggtttcactgtgagtttcactctttttggcaacaataatacggcgcccaacgtgggcctcagagaagactcggaaccccaaaggagttgcccgaaaccggagagagaagcggagatcctgatgtttctcagtgccattgtgatgatgaagaaccgcagatccatcactgtggagcaacatataggcaacattttcatgtttagtaaagtggccaacgcaattcttttcttccgcttggatattcgcatgggcctactttacatcacactctgcatagtgttcctgatgacgtgcaaacccccccctccccatatatgggccctgagtatatcaagtacttcaatgataaaaccattgatgaggaactagaacgggacaacagggtcacttggattgtggagttctttgccaattggtctaatgactgccaatcatttgcccctatctatgctgacctctcccttaagtacaactgtacagggctaaattttgggacggtggatgctggacgctatactgatgttagtacgcggtacaaagtgagcacatcacccctcaccaatcaactccctaccctgatcctgttccaaggtggcaagaaggtaatgcggcagccacagactgacaagaaaggacgggctgtctcatggaccttctctgaggagaatgtgatccgagaatttaacttaaatgagctataccagcgggccaagaagctatcaaaggctggagacaatatccctgaggagcagcctgtggcttcaacccccaccacagtgtcagatggggaaagcaagaaggataaataagatcctcactttggcagtgcttcctctcctgtcaattccaggctctttccataaccacaagcctgagactacagccttttatttatgttttccctttggctgtgactgggtggggcagtgcgcagcttctgattttaaagaggcatctagggaattgtcaggcaccctacaggaaggcctgccatgctgtggccaactgttgcactggagcaagaaagagatctcacaggatg

SEQ ID NO: 133183 - DNA, 1009 bp, Homo sapiens
taaccctgagtggacacagcacatgtttcagagagcacagggttgggggtaaggtcatagatcaacagcatcccaaggcagaagaatttttcttagtacagaacaaaatggagtctcctatgtctacttctttctacacagacacagcaacaatctgatttctctgtcttttccccacatttcccccttttctattcgacaaaaccgccatcgtcatcatggcccgttctcaatgagctgttgggtacacctcccagacagggtggcggccgggcagaggggctcctcacttcccagaaggggctgccgggcagaggcgcctcccacctcccggacggggcggctggccgggtgggggctgccccccacctccctcctggacggggcggctggccgggcgatggctgaatctttgtgtacatgttgtgtgaattattttcttaatctgtagtcttagaaggaaaattatggttgtgtgtgtgttccatattcattacacattggtggctctggcagatatacgccccttaggaactaatgctatctgattctttctgtgcctcagctctacgctttctactttgagagtgatcatggttctctttaacatcttttgtcctgagtgttgagcagttcaccacagcatgtgtgtagtatgaggagggaaaaaaaacttaaggaacttggcaattttttgttccaagtgaaagacctagacggttttttgttgtttttattatttcccattgaaactcttaaatatggtttggattgtttccacctcttggctgttgtgaatagtacttctgtgaacgtgggtgtacaaggtctttgagactgcgctttcaattgttttggttatatccccagaagtaggattgttggatcgtatgttcttttttttttttaaagcagggtattactctgtcacccaggctggaacgcagtgacatgaacacagctcactgcagcctgaacttcctgggctcaagaggtccttctccctcca

SEQ ID NO: 133184 - DNA, 1063 bp, Homo sapiens
gatgggtggatgggtgatgggcacagtgccccagctgtgtgccaggcatgtatgtgtgcccagaggccagagggggctaaggctcagcctgctgagaaacatcacaatgggctgacaggattcttaacctccagttctcaccaagctgcagggaagccagatcttggggcagaaagaggccaacgggtagctgagcagaggaagatgaggctgtggtgggagcttcagggccttgaatgccaggctttggagttcaacaaacataggttcaaatcctagccctaccatgtcccatgagacacaattttcctgagcctcagttttcccatctgtaaacagtgatcattctaacaacttaaagttgtttgctctacagtttaaatgagataatatgtggcaacagctcagctcagagcccagtacccagtaggggctcttgaagtactgggtgttgttatatctgttttggccatggggagccttagatggttttgacctgagggctaatgttctggggacatctgggtcaggacagcagctccccatgcacctttcaagctaaggtaaaccagaaatcccctctgtgtctggagtcctgtaactgggtcccacacattagtcccaaaggccaatttccatccttctcctgcataaatattatatgcaagtatttttaagtcatttcatcatgaaaagaagcgatttaacataactattacccaggattcttcatgaaatatgcatcaagcaattaggtctaaaagcgagaggtgaggcctcgcaccctgctcggcggccggcagctgcaggctgagtaatgttttattaaagcccgtgattgcgctgcaaggtggggcctgttattagccctgcgtgcccggcacatttgataatcctgatgatgaggaggtgctttttgtgatgataatgagcgatctgaacgcctgtgacagctccagcaccccggcctctgccagccttacaagactcattagacaggtcacccaccagagacacctctcattgtgactttgccctcgcaagatgtcctatcaaaggagat

SEQ ID NO: 133185 - DNA, 1892 bp, Homo sapiens
accagaggggctggttctgagccaacagtgtcagcatccatgacccaaatagaagagtctagtttcttctctgggtccagccctcaaggagctgtgaagaaagcgcaactcattgctcctactttacagaagaggaaacagaggctcaaaggggcttaacctgtcttaaggccgtgttgtcagggaggggcagaggctgagcctgcccagctcctggaccactgttctttcctgacccttctcagccatttgctccagctaagcttagaagttctccatttgcactcaggtgctaggctgatgatgctgagactatctggtagcaaactaggaggccaaggccaattcagaggggccagtggcaggcggcctacatacctgatgagagagaagtttaggaagccctatctggccctgggtgtgtgatatagatcaggagagaaggactagggcagtgggagtagaaaggagaggtgtgtggaggtagaattgatgagagggaggaggagtgaggagtcaaggaccacatccagatttcggagcagctgggtggatagtggctctcccggctgcaacgtagacctggaaaagaccaggaaaacagactccctgcagctcagcttcccccttcccaatgctgcctaaaacgcagaggcaagaggtgcctgctctcattctgcctcactctgccagttcacggcccagtgcaccaccccccaacccggcagtgccagacgtgcccgtcaacaggctggggttccctccctggactgctgcgtctcccgtctgagccagggatggagcagtgccctttgttttaccggagctccttggtcttctccagcatctgagcagccgcgattacatttccagccggtttttaattgtctcgtatcagcccacataaatctgcctgtgcggctccgccaccagggaagcattccaactgcccgtctgtctccaggaaacctctcgtgccccgggacagttgccttctgaggcattgggtggtctctccaaatgagaaaaacatttctttccaatcacatttctaacatcttgttaatttgaattatttaacaatatttttgcaaaagccatctgggaatgagttggttggcgacttgggagaaggcatagagggtgctgcagggaaggccacgaggacagctgcagacgtcacatctgctatcagtgaaagggtggctgcatggagaggaaggctgtgatcaggagcccggggattacagcctgaatcccaccattcctaccagccaggaggtcaccagtgagtcacttcccgtctcagcctctgagccctgaggcccagatttgcaatggcagtggaagctcttgtaaactctgagaggctgcacagatgcaggtagggtggtttgcagagcctttgtgctgtaggggcttattttactgatagctgggtaagcgatacaaaggccccacaggaaacatgattggcccttacctagaggcattcggtggggcttgaagcagctaacttcacgtggtaaaatcccagtgttaaggcagggcctgactgttccccagacttttggggagtcagagcccaaagggagttgaatcatccaggtcaagaccctggtggggtcaactgaggcacaggaaggcaagaggaccttcctgaggtcctctggaaggctgctggtagagcccccagaagtcccagctcccaccccagggttatcaccctttggagccccgtaagcactgtatattcttctctcattttctccacagacattgtcagtccttgaggcagatttataaaatcagatgtcaaattttatagcccttgtcttcgctcccgcagttcaaatgctagggctataaaatgaggttttgttgtgtatgcg

SEQ ID NO: 133186 - DNA, 1043 bp, Homo sapiens
ccaaagccagtggggctaatggctgcatacagtccttacggagggacctttggctttctaatccccgaaggcaaattgcctggcatcttgcaaacgtgacctaaggagacacctctggggtctggcctgtttccatcatgctgtggcacttggttgttcacagcctctccagcccagccaatgagctctgccccgtccagtgtcagttactgaatgagctgtagccctgcaggagctcacagcctcacaaggaaaggaagacacttacacctataactcacggagaatgtgttcagggctgcccgaagtagaaagtactctttctatgaaagtttccaggctatgaaagagggaaggaatcaggaaggggaatgtgaaggatgagcaggtcttaaacccatgcacaggggagaaaaggcaggctgcagagagaatgggcccagagacagggcagggcggagcttgcctaagaacaacaaatgacacattcatctgagcccaagagagatgtagccctgatcaccaggtggaggggtcggggctttacctgtgaggcagcagggagttctcaaggtttgaaacaggatgcagtgctattgtcagggctgtattctagaaccatgagtgaactagggggcccatgagtactggcgaggagggatgccagcttctgcctccctgtccccccagtgatcccccccttcccctccatgtccctacacatgccacgtgaactggcacagaccgagagctggggaggggcctgatgtaggagtccagaaggcgaacagcacgtgggcaggcatcccaggagaccgaggcagcccttttcaagatggagagggacaacacaggctctgcagtcagatatctgaatccaagtcctgcttccatctctttccccgcacctgatgctgggcaaggtactgcaccttcctgagcatcacgggatgcttgcctcagcaagaagtaaggcttggcagataagccctacacatagatggtgctcagtatataccagtctctgcttctcccagcttttc

SEQ ID NO: 133187 - DNA, 1060 bp, Homo sapiens
tgtagggcactgctccacacttgctattcccaccaagctatgtgactcatcttcacgtgctcagaataaacagggccccggcatctgcagagggtcccttggagaaccttaaacccggccaccaccaccacctgtcctagccaggagaatgctgtctcttccaaactggctccccttaggctcccatgatgcttcctgtcccctgtatagcttcccagaatgccttgagcctgtgaggaaattaacaattgtgttggtaccaaatgctttttgctatgtaatgagtaacagttgtaattaatgtttaacacctgtgaacagcaggtctgcccaggaaaggggggtttcagtgagagaacggggatcacttgtttcctttggctaatgtattactgagggacaggtttttccagttggtttttctatttgacgtatgaataaattcatttagtaatcttaaaaaaaggagaggaaaaaaacaccaatgtttaatagctttgtttcatctgctaattacattgatagaaatattcctccaagtgcctttgtctcctcagtggaaaaaaaacaaagatttgatagaatacttttgctcttctgtttggcagctcagagatcttcatgtggagatttttaagttccctgaggtcagagaccctgcctgtcttgttcacacctgtgatctgtgcctggcacacagtgagccctcagatatttgagtaaatcaggccagacgcagtggcttacgcctgtaatcccagcactttgggaggctgtggcgggtggatcacctgaggtcaggagctcgagaccagcctggccaatatggtgaaaccctgtctccacttgaatccaggtctctacttgagtccaggtctcctgaatcctggaggcccctaacaagttcagcataaaccctgtgtgagtgcaatacagtctcaaaaacaaccacagtaaccacagtgatacatctatgagcactcactgtgcccccaactctcagtgcatagtaccgcccccactgtacagatgaggaaacagagacaacttggcccaggtc

SEQ ID NO: 133188 - DNA, 1055 bp, Homo sapiens
aatgcccagtcaggttccaccacgggctgctggctgcagggagtggactgcagctctgcctccacagggaagtgatgtggcttccatcaagctgtcagcccccttcccacccggcagagacaccagccttccagagcaggctagactctgttcctggcccactttgaatcaccccaggagtctttacagcaaccagcaaggccagcagttgggtctagaaatggccttcttgctctgtccccaacccacccccgccaggtgcagcttgggcccacacgaggcctatgtggcaccccctgcccaatgttgggaaggggacaaggagccttggatgatgtcatggtgtctgggggtggtgcaggttggtgtggcaggtctacctggttgccaggctgtgtggcacagattgcaagatggacaaatggaacctgagcagaaagtggccacgtagggaggggcccacaggcagggaccaaggagccggggtggatagcctgtagaagcagacctcggtggaggtggcaaagacaccaaatcggtgtcttcacacctctgaaggaccagtgtgaggactgggcatgaacatgtcctgggagtctcagtttctccacctgggaagtaagaccagtagttcccacttcagaagggtcttggtgagatttgatgggtatcacatcaggaaagtactggcattgttgctagcatttactgagcactttctgtgtgcattctctcattcaatcctcataatcaccctctgggaggttagtttcctccttttacagataaggaagctaaggtcccatgagaagaaataacttggctgggggcccagcccatggctggtcagcagcagagccggactttgaacctgtcagctccaactccagagcccctgccctaacccagtcaaatgtctggcctctctggtgctatccaagatgctgcaggaaatatgattggagctctcatccccccacagccctcaagaggtatcgcatgcccttcatctcacttgcactaatttcttcatctcacttgcactaatttctgcg

SEQ ID NO: 133189 - DNA, 1123 bp, Homo sapiens
ggtgaatactggagcagagtatagcttgttgcttgtggactgggcaatcttttaaacccccatcacatcctctcaggattactgcctgctctcttccccagcccttaccttctccacattcccatgggcagaccccgccatggccgcagtctgtggggagcacacctgcctagctctcctggtgaatgggcccaggcaaattcttagggtccctttcagttctaacattctctgattctaaagaaagtgctttagtcttcttttctttctatgtatgtagttctgtttacaaacctttctgctccagaggtcaacagaaacccccatcctgttaatgtttctgctttctgcctaagaggcatgaaattacagactgccacctaatattaaaggtcattttgcatgaatgtgtagatgctgatgttcagataacttgtgacttaaaacatatggtcacagactcccttgtgagatcggtctctggaccctcatggattggcccagctaataaggaagacgggcctggtagttaggcaggaggcagcaacatctggcaagctggcctggcacaagggccttcgatgtcctggagctgttggtgagcctctcccaggagagaagatgctcccaaatgggcattttctcagggaaaggcagctgcttcctaaatacacgcagctcctggaagcccagcctgcttaaaatcatatttactctctttcatgtgctcatcttaattacattttttctgctctagtgtctttattcattatttaaaacaactttcaaaaataattacgcgataatcccttctcctctacacagtagctgtttaccttcctgtattgggtttttcagctcttggtgttgtggatgtctgtacttacaacgttgctgtcatcacagtgtagatataggccaaatctgtgatgtcagtatttaccaatgcccaggcaaggagcagaattccctgtggggccctgctcatattgacggagacttgtttaaaaagcctgcgttatactttgccccccacacataaacaatcttgcattttactttttagcttagcataatttcttgcatggtttcccatgtcgctacataatcttcagattgatca

SEQ ID NO: 133190 - DNA, 1464 bp, Homo sapiens
gccttgttgtcctttctgccacttgcccttgtcacacagtgagaagctgctgtcgccctggacagctgttgtttgataagctggccatctgccctggggtgatggagcagagtgcctcggcctccgtgtctctgtgatgtgagaggtacagggttccagtcctgaggtggtggagctggacagcccagaaggccaaccacaaagatgagataacttggggtagcagtactttaggagttttgcccactctgcagtcattttgtaccctcctgtgccagcttctacactgggcgtccagagattgacataaatgagatccaagccccagtggatgtggactcaggtctgacatgtcttgggctttactttgcgctgtggggacctccacagaggtatttcgatcactcaggttccaggggaaaaggaggcaggaaaggcttccaaggaattggagcttggcctaagtcttaaaagatgagcaggccaggagggaaggggctgtctaggcagcagcccaagctcagacctggaggagaggactagctagtggctctggggacccaccagtggtttcgtaggtgctgagctgacacctgagttgggtcctgaagttaactcagaggtgggtgtcatgtagagaagagggaaaggatggcttgcaaatggagatacagcctgtggccggcatggctgcagcttcaagaacttacagaggggagacgtggctgccaagatgttcgatgactagttcataaagggctttctgagccccctaaggggcttggactgtacccacaggactatctggagttgttgaaccttcacctgctcccacccacctcctgcctgtcagcttcccatttccctgactcagactattgagctcattgaaatcctcctgacaccaggcagacacacagattgatcacatagagcctctgctctcaaacctggatcaagcaagaaaattagtccaggataagccggtagatatggagagtcacagggcagttagagccagcactggcaatgtcttaaggccttgggtgattaattgacatgtgaatcagacagataattagtgctacattggggtaccaaagggacagaattcttctccagggtgattaagagactacagtagaaggaggggagatctaggcccaaccttgaatgcctttgggtgttgaatgaggagctgaaagaaaggccattgctggggaggtggggaccagcaggctccaaccttggcccagagccagcacatcagtggacactctgtgtctgtccaacattaggagatgaggagccagttggtactatagagataagggctttagactctcatctaagtgttcattgaattaccaaatttttttaaagaactgctgctttatttaggctctgggctcctatgtacatgatcacagaattctgcacacgtacaggcctcaggcctgagtt

SEQ ID NO: 133191 - DNA, 1517 bp, Homo sapiens
tccctgctgattggattctcacaccaccctggcgagacaggcaggacacgtggtgctatctccattgtatagatggtgagatgaggtctcagagaggctaagggactttcccgaagtcacataggaaaccaggactaaagcactctgccagcaccctgactaaaagccaggctttggcacctgcagggcagtattttggttcattttgtgagatccctcaaccccaactggctctggggctcctatgtggcaagtaaagcctctcagccttgaggggcttccgagggccaaatgccatgcactttataggactgaattgaggagcagcccccaaagactttggaggccaaatcacactgcatttcccaatggactgtacaggttagcccagcgttgcagacagaatcagcccacccggcctcggaacagcgccacctgggaatcagcacacagtgcagaggatgggaggctcaggagaatgcccccgccccctggctctgctcaccacattgggtcaaggtgaagggcaggctgccctgaagatccatgagtgcagggccttccagggtcagttggtaccatggtcaacatggggaaacaagggcaaggtcgtgggcagtggtgaaaatgcggattcctaggccccatcctgtagaggccctcactgaagcccgagaacttgcactgtaatacatggctccatggctctgggacagatggtcccatggttagagagtccctgctttagcaaagagcttaggcctggggtctccttcagttgttcaagctgtggtctggcctggcctggtctgccagcagcagcaattctcgctgacttctcgctccctctcttttctctctccactgcctgtgggagggatggacatccgttctgttgtctccttgaagctacctgtgcaagtcctgaggacccagccctgggcctgtggaaaggaatggaaaccacccactcaggtgtggtgccccagcctcgtggctcttcttgtcagccttcacaaagctgtgattcatactggaatcttgtaaatctctgaatggccaaatagaacagggctgggggtagagggcatggggtgactagtggagagagtcatgagctggaggctgcaggagtgaattgcagctcctccgacagccggtttgagcttggacaaggcatgcctcagtttctccatctctgaagtcaaggcttcagccagatcctaaggtgactttagtgctaacctgtcctggtagtggtggcagtcacacaaagacacgctggatgcacacagggacacaatctcccagaacacagaagcctcccacgtgctgctggtggttgggctgctgcctcggctgcctttgtttgtccccagtctctgtcagacctccactcagtatgcggcgcttggtgtctgcagcttccactcagcactccagaaacctgtttgtgagctcaagtcacactagcctccctaggggatatctttccacagaagcctactttcgaattg

SEQ ID NO: 133192 - DNA, 1406 bp, Homo sapiens
ccctgacactgagcacgttcaggttttcaggaaagttgcagcaggcctggaataggccaaggagagcagacagtcattgatagcacccccgctgtgggctgagggtccttgccctccaggtgctcctgtcacatggggaaggtggacaggggcccagagaacacttgatgtctgtagtataaaacaaactaagaaaaattacactggagagagaaatctggtcttggagaacacagaagaaggagtggtacagcctctgggaccaaagtgtgctgcacaaagagggcagcatcccagcaaagccaagcttgaggtcctgactcaaaatgacctcctcagggaggccttctggccacttatcttacatttccacccctcccccacctctctgatgttgttccttaacacttgtcattatttagcatattacatactttttttacatttcccttgtttgttgtctgtctcactgctgagatgtggccttcacaagggcagagatataggttttgttccctgttagaacctgaagtacctggtacaaagtaggttgtcagtaaacactggttgaatgaatgagtgcattaattcactcctgggacctgggctggtccacagagtcctgggtgcccctcaggagcccagggacctcctatcctcctccaaagaatgccagatctggaaagtctgagtttagccacttgctaggtgggcagggaggctgccttggcgtcagggtgggagttgggtgggcgttctgaccagttctgtctccgcagccggcggactgcatagggatagctgattctgcctcttttccttccctctctgggccgagagctccgtgaaggaagggactggtcctcacccatcttcatttctcttctgggcccagtaaatattcaccgattgcatgaatgagtataggaatgcaagtctgtatggagaagaaagaaaaggaaacaaacaaatactcactataagcagcctctcccattctgctgtgacttgcttgcttgaagtcacagggcctgggtcaggggaaaaatgcagtgcattcattcattgactgggtggctatttgtgagcacctgccatgtgctggcaccgttctatgctcccgggtctatgcatgaacaaaacaaagttgttctcatggagttaacagttgagtgagggaccaaggtggcagtagcctacccatgattccccgaaactcatttactagatgctgtggctccgggttatcaagggctggaattcaggggctttctcaaagtcaggagctgagtggagacttgtccccagggccagggccaccttcagtaggaaggatggtctcagtgctgtcttctggggataagggggacagctgtggcccagtggctggcaggtgtgttcctctg

SEQ ID NO: 133193 - DNA, 1164 bp, Homo sapiens
tgcaggcatgagccactgcaccgactttgccttttaaatgagggtacaccccatggggttaggtccaaggcagggcaatttgattgaggcagtttgatttagaacctcttaaagacctcatgcattctctctccaaagaagcattctagcatatgctgctctgtgtttgcatcctagcttggcagctgtgccctagtttacccacaattcttatttttaagaatataggttattaaaaggggtgttttctgtttgtaacgatccttgctgaagctccctttgactcaaaattatttgtgtgtaattctttgtggcgtcaccccagtgattgatggcagggctgcatatgggtaggatgagccatcagtgcgtagatgctccaggaggcttgcagagctgacgtgaagcttttcgaaggggagatggtgggggaagagagagtggtgctggtgatggcagtggagtgggagtgacatggaaaaagtttaaccttttagaatgatcctttttggatgatattacattttatgtgtatgtgagcgtgtaacttgtagttacagggcatcatcttgaataagtaagcataacgctgacaagaaggctgtgccctccgtgtgccgcaggtggcgtacctgtacaggaggagcgtgggctggagtcaagcagatatgggatggtcacttgccacctgaatgacccagggacctcggttttcccctgcaaagcagtagcctcagagcaggcagtcattagtgcttctagccgctttgggctgctaactggctgtgcgacgatgggcagcacgttgtatgcccccatatttacttacatatggaatgaggggccggtgataacaacaacggggaggcagctggtaagctctctagtacttgcttacagcacttgatgtcagttcttaactgggtcctcaccattaccctttggagtataggctgcccacttgactaatggagaaaccaaggcacagagaggttaaaaaactagcccaagacgtcccagctggtaagtcagttgtggggctgacttcctagcctgtttgaaccatcatgtggagcattctttccagggcctctccagccttggtgcactgtagtttggttttcagattccccagcatagccgtcttgggcagtgattcactga

SEQ ID NO: 133194 - DNA, 1042 bp, Homo sapiens
caagtttgggaaacattctgtctactgtaccaaaaatagcctgtggaagaggagtgcttttaagcaagtttagttttgcacatagtacatgaataggttctccttgtttgaaaatgttttaacattgcagagaaggtctcttttgacttcccctaagcaccccattccaagtccttccctccttcccaaagaggggtcagtttggagtgtgcatctcccagaccctttctttaacttaatagagatacaggtttctgttttgtttttcattaagtaggtatgatgttgtagttatcattctacagcttgcttgctttccattcagagctatgtcatggagtgctgtgccagctcacacagagcaactgctttttttaaattttttttttcagcctgctgcataatgttacatcgtatggaactagcacagtttatttagcgattcctctattgatggatgcagtagtttcgggtggtttctcatgattacttcaggcagcatccttcccatggacccttatgcacatttgggaataaatactgagaagtaaaattgctgggtcaaacttggcgcatttggggattttaatggattctgcccaaagttacccttgtaagtgtctccacccaagtgcatttccactgaaagcatgtggagaggacccaattctgctcacaagtgcagctgtcccacaaaagcaactaaaactctgaccagtccatagggaagtgtggccaaggggcaacacccaccttcctctagtcctttcctttgggatgaacagctgcagactacttcctatcacaaagtgaagtttctaagataaaaacacaggggccccagcagtgtgcgttccagagaggaggcatggagaggccatccccaggccactgctggtttgctaggtgactgacaacgccctgcagtgggccctgtggaaaacaaggggaggtcagagcaggtctccaggaggacaaacctgtggaagccctgtaggggctttgggctgacctggggtctgtagttttgtctgaaagcaag

SEQ ID NO: 133195 - DNA, 1022 bp, Homo sapiens
tgttgtgctgtgtaggatctcacgttgtatagtcaggttcattacaaagtggtaggaaattgatatgttgtcaaattgtttattgttgtggctttgttttttttggagacagggtctcactctgttgtccaggctgaagcgcagtggcacaatcccggctcactgcgacctctacctcccagattcaagagattctcctgccttagcctcccgagtagctgggattacaggtgcgcgccacctatcggctaatttttatatttttagtagagacttgggggtggggggggtctcaccatgttgaccaagctggtctcgaactcctggcctcaagtgatccacccacctcagcctcccagagtgctgggattacaggcgtgagccaccgcacctggtcgttgtggcttttacaaatgttactagaagaaaagttccatacctgatatcccatgtggctgtagtcttgacccttttgatttgtcctttatcttctgtcttccaaaagtgagtctggacgtgtcatcatttagacactacccatggcttctatcatgtccagactcatagcttgacattccagctgacccttacctcttggaaaggcttctttttactccatcccttccatgacagccagctgggaacctctgaccttgtgccaggatgcaaggctcacctgtatgcctctgtgtcttcacttgtgtgtcacacctttatcctcctcatcctcttaagttcagctcagctgtcctgccatttgggaggcttcctgacctcccacccctccctcctctgtgtacacatgtccacacctctggcggaagcagtcacaccatgtcatggctcctggagagccacagtgagagccctgcaccttgcacggggcctgaccccagagtggatgcaggagtgcttgtcagataagtgatctcagagaggttgattgaagagccagtatgctgtaaaaccccaatagtccccaaattgccagtaactccaacaagggaaaaaacctccaaact

SEQ ID NO: 133196 - DNA, 1368 bp, Homo sapiens
ccatccaactctcttccatccatgctgaaaacttccaatgttgagatttgttaccttttgtccggccacctttgcacagctggggttgactttttttttattttaaatgtttactctagctttttgagcacctggtattcacaggaactcgttggttgaactctttttctttgtagattctactactgtcttggtttgactctctgaggtcaagtagaaccagtctaaccttgcttctctcatataaggaccctcagatgtgcgattgtatcttcaaaggcagagagaagctgcaggctataacactgcccacagagccagattcccagccaggaccccagctgctaagggcaaggaccctttgatgtcacaactgtggaggtcttgatggagcccaagtctaggagcttcctgtgggcatgaagtaataggctagagcaggttcccggtgggtgagttgaggttggcactgaggtgttaactgtgcaggcatgtgactggatggggaacaaggtcagattcccaggtggatttggggagtctcagcaaaggagctgtcaggagtggattccagaggagtaggtagcaagtggagcagaggttgcgtggctgaaagcagtgtgatgtcagggttgggcattccctgtcctgcttcttggccccttgtgggggctagctgacaaggtcatacaccacaggagcccagggctgttgctccagacacagcagaacccaagtgtgtcccactgtggtggcatgaaacactcactggctttagggtcggaagtccagagctcaaatcctagccctggtgcttggaagcttagtaacttgggacaagtgataaaattctctgggcctggaatgccccatcttctatgtaggtagaatagtaacagatggtgtttcctgaccattcactctgtgtcaccataggtaacactttcagtacttgatccttaactgtgtgtctttgaggtgttgctgtgagaatccccattttacagatggtaaggcatttgggagatgaggttctggggaagtacattgggtcgttgtgaggattaaataaaatcatttgttgaaatggctgagcacaatgcctagcatttaggaagagctttatgaatgttttatattattttggcctgtgtgtcttgggcctcagtccagctttgaactttgggctttctatagccacagtaaagtcagtggggttgccctgtctgggctgatgatgtggtcctcagagagtgaacctatccttatcttggtgggtctgcttacggttaagctttacctgggatcaccactctgttctaagagcttgaggtatgttagctcactgattcccacaacaccccatag

SEQ ID NO: 133197 - DNA, 1018 bp, Homo sapiens
gacaagtttggtatagaaaataataagtaagcaaaactcagaaaccaaccctaattccgtaattcaaagaaaccaccattaacattttactactttttcatctagccatttttcattgcatatatatatatgtttatttttctcgccacaaaaattaagtgataccgtctatatttttttaaacgtaaagacatggaaagatgtctacaatatcttaaatatttaacaactgtaatttaatagctgcattgtattctgttcacatgttgggcttttcctcgttttcaccaatttaacagtgccgtaatgaacatctttgtaacttaattctttgcataggtctgtgattatttccttggggttgattctgagaattgttggataagacagtaaaaagtctgatacatactttcaaattgtgttctagaaagaccttacaagttgacacctgttttacccttctcacacaatcctcggaattctaatgcaagttagttgcatttgcagtttcctggattcctggtgcaaatgtgtgttgaccatttgtgttgcttttccaaaactgtttactttatcatctgttcatccttttctgctgcagggttttgtctgttgatttgtaagaactctttgtggattaacaatagcagccccttacctgccatttgggttgcagaacattttttaaagtttgtaatttgccttttggttctatatgtggcaattgttgttggttacaatgaattgttttctatttaatcagtctccaccttcatgatttcttgagcatgctgctgagaaaagtcttcccatgtgggcgcggtggctcacgcctataatcccagtactttgggagactgaggcgggtggatcacatgagctcaggattcaagaccagcctgggcagcatggcaaaaacctgtctctactaaaaatacagaaaattacctgtgtgtggtggcatccccctgtagtcccagctactttagaggctgaggcacgagaattgcttgaaccc

SEQ ID NO: 133198 - DNA, 1150 bp, Homo sapiens
ctaatgtcacacagctgcaaagtgatagagcaaggatcacaccagtgcagtcttgagttcaaaacctatatgcttcctctattttccgtggtttcaatggaaataagtagtatgaggcttggatatttactggaatatatgttacatgtctcctcctcccctttacttaatgctactcttcttgcatccctctgctgtaatttctccgctttcagcctttgctttggtgtccctagaagaggccctagagctggcttttctgtttctctgtctcccatctgcctcagagttccagaaatgagatgttaatgcagcacttgagttattttatagagaaattctgagcacagagttggcacatcccaagggacagctgcacaaaacgtgagtcttgtaactgtcatgtcttctcattctaacaccaagcattccttcccttcaaggatttgccgggctgtgtgtgctctgtttggaggaagagactggcggtacattggccctgatcaacaaggaacttaagtttccttgaaggagatcaggtgactgtcctctctaatctgacaatctcagaacatgactgattaccccagggcttaacccccatgacttgaccctatcctctctttgcccccagagcatttctgacccataaaaattagctttaaaagtcaaatctgaaacagctgtggtttcttctgatcagtcagcaaggtctaacttgcctgtggtcaagccttcccctgattagcttagcttgtgctgggagagcccagaagtggtggcctgtggggaatgggtaggccaggcttggccctagaaaataaactgggacgtgtgactttccaacagagctcgcatgctggctggctgacggcaacacaccctgtggctttgtgaggttggttgatggtggtggtaggggtgatgtattttctatttctttttttttttttttttgagacaggatctcactcctgtcccccatactggagtgagtggcacgattacagctcactgcagcctcaacttcccaggctcaggcgattctcccacctcagcctctcaagtagctgggactatagtcacacgccagcacacccaactaatgtttgtatttttttattgcccaggctgatctcaaactcctggg

SEQ ID NO: 133199 - DNA, 1049 bp, Homo sapiens
ctggggaaacctggaggtcttgtatataaaaggcacgagagggtcacggctaactgcactggactttatgcatcctccttgttaccctgcagccacaccccaggtgggcagatctcctttctcttccactgctagtggttcaaaacttcagtaaacattttttcccagttacagttaagactgtttcaaacactaaggaatgatttgttttatagccaggatgtcaagatatttaagacttgactcttttcatcaccagatatttcttacgggtcttctctgtgtcctcccctgctgggtgctggagcagggaccctctgcagcgaatgctatgacagaggccatagtggcgtgatggtgatgagtgctatgatgagacctcgtgttacagggttacaggagggatgaagggcaagggagaggttggggggtgtggcatcgaggagtgcaccttggaggcagggccattattgtgagggaggggtggtcaccatggttggctggagaagaaccctgtgcttcagggaactgcaggtgaagtcccttgtggctgaaattgagaggttaagagttgggcagggcctgagtcagggaggaccttgtaggctaagcacagagggggcctgtgaagggatttagctgcgagagtgttgtgatcagatatggttttttagaagatctctctgggttacttttcacctactaggttgtgactgcgagacctttgatcttttgagaagttgtccagatgttctttctacccaggagggaggaggcagccagggaggctcagcaggacgttatagtgcagcgatcctcaaactttagtgcacctatagggctggttacaacagattgctggggcccatcctgcagcgtctgattgagcatgcctggtgggggacctgagtgtttgcattccatcatttcccaggttgaggggaaatggctgagggtcctgggaccatggtttgaaaaccactcatgcaacagtggcttctccttaactgtccctctgggtcttctggtcagggcagccttgggatgca

SEQ ID NO: 133200 - DNA, 1098 bp, Homo sapiens
ccagagtgctgggactacaggcatgtattagttcattctcacgctgctaacaaagacatatccaaaactgggtaatttataaaggaaagaggtttaattgactcacagttcagcatggctggggaggtctctggaaacttaccatcatggcagaaggggaagcaaacatattcttcttcacatggcagcaggaaggagaatgagtgctgagcaaaggggtaaaagtcccttataatactatcagatctcttgagaactcactcactatcatgagaacagcagcatgggggtaactgcccccatgattcaattacctcccaccaggtccctccaacaacatgtggggattatgagaactacaattcaaaatgagatttgcatggggacacagccaaactatatgaaggcatgagccaccacacctggcctagcacttttttaataattaaaaattttcctgagataactgtagaatcacatgcagttgtaagacagaatgcagagagaactcttatgcactttgccaagtttcccctcaatggtgacattttgcaagaccatagtataatatcacaatcagaatattgatattgataaaagccacacatctcattcagatttcaccagttttacttgtactcaattgtgtgtgtgtgttaagttttacacaatcttatcccctgggtagatctttgtatgggatacaaccacaccatagtcaagatattgaacggttccaacaccaccaagattccttgtgtagccctttgtggtaagctgaataatgcaactaccactatcccccaagagatacaggtcctaatccctggaatctgtgaatgttatagggactttgcagatgtacttaagttaaggatcttcaaagggggagatgatgctgctggattatccaggtaggccctaaaagtaatcacaggggttcttgtgagagggaggcaagaaggtcaaagcaggaagtaagaaatgtgatgatggatgcaagaggctaaggtgatgcaaggaagaggtcatgagtcaaagaatgcagacggcctcatgaagctgaaaaaggcaaaacacaggtttccccctggagtc

SEQ ID NO: 133201 - DNA, 1026 bp, Homo sapiens
caggcatttgaactggcaggagtgggtgtgggggattccaggctaaggaaacagcatgcaaaaaggagtcggggtagaaaaatgcagtgtagtttgtgaacagggaggaatggccagttgctgctgctcagagctatggtggtgggcgggtagtagtttggggcaacacccctcaatgcagacagaggaggttgaacttgttgccgtaagcagtggacagactgaatctctgtctctgttgtcagctgggcttgaggaagacaattccacagcccatgttcaatcccaaatgtatctgctttcccccttaaacacaaataaggctagtttttagttaaggtggatttttttttctttcaggttttatggtgaaattaattccaacatctttaaaaacactgtcctgccctctcctccagggacggatggtgcaggagaaatgaataagaacggcagatccagcgacagtaaaagtctccgctaatgaatttcctccttcccagcctttacgagggcttcttgaacattacatcagacaatgattattccatgatattttaattaattaagggaaagccaggtgctctggtgtctcagtttaatgaattcagaacgtggaagcccagtgcccagggctgagatggacaccaacacttgcccacgctctggctctctggggctgaccgctctcctggaacgtgaactcgtttacggccagggctccttttcagttcagcctcgattgcatccagcagtgagaagtgcgtgggtccaaggaggcagacttccctgtgttgactttcactgtggctgtctcttcctcatgcctacatctcccctcctatattagggaacggttgattctcgagggaagagtaaaaatcctgagtactagggagtgggggaacagtctcccctcttttctccatgcataaacccacccatcacacatttgcagagctcctccagtgcaccaggcatcgccaggtagcaaagggtctacaattgcccacagacctcggagtc

SEQ ID NO: 133202 - DNA, 1416 bp, Homo sapiens
caggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacgtagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggcccttaaaaaaaaaaaagaaaaaccctcacagtcttcctggttcataagatggatttggaggttatttctgcagcaaacttgggtcc

SEQ ID NO: 133203 - DNA, 1478 bp, Homo sapiens
tctgtaaaactgaattactttctatccagttccactggttccactgttttatatctttatattaaaacatatataaatgattgattgatgattttttttcttttagacgctgctgctgaatccatggagagaaaaaggataaatttccagaactatggtccctgtgctccagttcgtcaggcgggcgcggcggagacggagaccgaggaacgccgctggggccatgcggcgctaccgcgcgtggtggctctgtgtctggcctgaggcttctgctcgctcctttacgccttcagccagctccccgtgtccccggaggaaggagcgggccgtggtggcgggaagccgcaggccgcagtggcttcctggctggcgggaggcggatgcggtgcggtgagaggcgcgagcagcgcttgtcccgctgctcatccccgcaggtgggacaggtgtagtctgaaaatacagcctgttgagaaaatgtatctaggtgaaagactggaagaaactatgaccatgttgaagtcagctattattttcaggatcaaacctcttcaattccagatttttgctgaagatcaactacatcatagctttaaaggaaggcttgacaggggtcatttctacaaatatttaattatacaatatactccataacctttccaagtgagaatgcagcagagtggaaaaactctttaaaccatgtggtttgcagagattgtccttgccgttattcctgaaagaagttgactctcacactgatagcctttttaaaagaccagctgataatatttggtctttactaaagaaatttaattccacacaaattctgcaatggccccagaacacaaggaatgtcaaataggatggtatagtcgctttgctaggcatccatagtgtggaaaagctggagtaaactctggagttatgttgacaaacatgacttgaatgagaaggaagtatttcaagaataatatgacaactgtgtgactacaatgaggagatatacttatgacatggcttaaaatatacaagttaaacattacatgggcgatcaagatctgttggatatcctgttttttcataatccagaaagcctttttgtctttccgtgtcaatggaagtgtcgtccagatcactgtctatatggaagcagttgccaagaagcagaagaaggaatctttatttttcacgggaacagaggtgtttaccatgatgataagcaaccagcatttagagctgtttatgaagcactgagaaattgttcttttaagatgacaatgttcattcattaataaaacctttagaattggaactacaaaaaatagtgcatacataccgtggaaaaatttactaaatatttatcaaacaattagcaaaaacataagagatcgctatgtcagatcaccaaaggaaaggtgattcttgttgcctgctacatcaaatggatgaaaagaacaaagcattggaggataagtatgaag

SEQ ID NO: 133204 - DNA, 1022 bp, Homo sapiens
tttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtaactaaccatcccagtcacaaaatgccgtgaactctggtgtcatgggattttgcgggctgccggtgcctcttctcctgaggcattggggcctcatgatcaagagcaaatgtctttgaggtaggggctgggtcacttgcttctcgtatgggttacctctcatcttgggagttaatgatgcccggtcccctctgcgttagattcccatttctcaagtgagatggaaagttagcctttgaaacaaggctttgaagctaagacacgcccccctaattgtctctgtgacctcttaccaagttatcttaccttcctgacgctcatctacctcacctgaaaatggaaaaatacctgtcacctgtgaaatagggccggaacaacctacctattgccattaaaggatgtcccgtctgtaaaatgcccgacacgtggggctttcgtcagcagattccccttccccaggagccaaagtcctccagccagttggcaggaagtgctccta

SEQ ID NO: 133205 - DNA, 1072 bp, Homo sapiens
atatgactgtattagaagtttggaaaaagttaagaaatgtaaataaaataatactgtttccgggaaataatattcctagttgttgctagagacaggtacagacttgggccacttcgtgaccttttatgtaaaaataagaaataactgcttttgtttttttaaaaactttgtagactgtaagtttattcccgttttttgctcggaagtaattttataaaggaatttatttttggcgtttccccacagttattcagaggctgctctactgagaagatgaacaaatttcttgtccaaaacaatgtatttcaaacgtgcccctcgggcctttcccgtgttgctcactggtaggtcagtagatcattggagaaaatgatctgaagctcaggagtgagaattaataccagcaaccttgttgctgaatctagggatagtttcactcctatccctgaccattttccctttttgaaacactgttcctttggcttctattacatttttcttctgatttttccacctgcttctctggcttctttttaaggctccctcctccttccccctttgtccatctttagctacacacctgtgtaatttctattttgatgtcctacaacttaaaacttaacatgtctgaaacttcgtctgttaccatccccccaaatcctgcttctgtgatcccaaccatttggaatactctaaaagcctcctgactaatctggagtcttgctgccctttaatttattcgttgcatgttagccttaatgatctttataaatgtcaatccgactgcgtcacacctttcagtggcgtccctatgggttaaaattcaaattccttaacatgaattacaaggacctgtaggatctggatcttgccaacctttccagcctgccaaattggccccgcacaataaactaaggttacttcaaaggtgccaagtgttttagccccttggaataggtacttttttactgtgactcctctggctagatgtccctcttaggttctccatagcattttgtgcatctcctattgaatatgtcaccctgtgacataattgcctccttattcactg

SEQ ID NO: 133206 - DNA, 1117 bp, Homo sapiens
agttaggattttctttttttcctctatgaattttagtgtgtacggttcacaagacttttttttctactggagattgacatattgggtttcatatgccacctgctggataaagttggtatagctttatgaatttatcttaactgaacattctgttcattgttgacactacctggctctattccccatttcataaaaacttttatagattgtttaaagcatactataagtagccatatagtcagcctgaagttgcgtctcgttaatgttgaaataaaaggtcactataaataaaagattgtgtgtcaattttagggaaggttaggctaggttgaagaaactgtttcaacttgtaggagtgtttgtaaatatttataaaattttatgtctacataaagtattttgcaacaggtttcaaaggatgctttaatcttatcctctaggatattctatactaaaataatatatgaaaaatagcatgcaaattctcaaaaacgttaggattctttatatgttttttgtatctttaaaattattttgaatttttttatttacaaaaaatatgttttataggtgctgggaagacaacacttctgaactatattttgacagagcaacatagtaaaagagtagcggtcattttaaatgaatctggggaaggtaagtaaagttcaataaatgtcatgttgcaagattttgtgtgactgtttattcctctggtgaattgatattccatatttaaaaatgaaaatgcaaggtattgtattgatgtggatagctttagaaaaattagattaatttctgttaagatttatatgggttgagatactgaaattagttttaataaaattttattttgtataactttggaattcttattaacagaattaaactacatttttacatgaaataaatgactccagaagtaaaaatctagacatatgaaaaaacgtttattttttattttattttattttttttgagatggagtctctctcttgccaggctggagtgcagtggtgcaatctcagctcactgccacctctgtctcccgggttaaagtgattctcctgcctcagcctcccgagtagctgggactacaggcatgcgccaccatgcc

SEQ ID NO: 133207 - DNA, 1097 bp, Homo sapiens
ctcttatagaagttttgttttattttttgttttttaaaatttttttaccattttgtagctgacaagtactgacaataaactgctataagcatgtgtagaaaaaggctcaccttgagtagttaagagtaaggaaaaggaatagtgtgtagcatcgtcttagtggtaagacttaagttgatttagtagcaaatggaagtactagtgaaccacatagatttcagaagtaggagtaacaggttagaagatgtgtcattttaatcttctctagactttttcttaatttttagaaatgtaagtggactgaacagaggaaaaccaaaacacagctggtcaataataagttaaattaatttgacaaactgcctgctatgcatttcatagcattttaaggactatataagcaatggataaggcaaaaactctgcctttaaggagatcagtcattggggggaaacagaagcaaacaaacaaaaaggcaacataatagatattaatattaatacaagaattttaaaagcacagagttctataataataggaaaatagagggaatgattgctcaacttttcttgaaaaagagtcaggaaaatattgaccgagaaggcagtcattgacctgagtcttaaagaatgaataaggtttttacagatggagtagggtagggataactttccaggtataaggaagattttgtattccagggacctttgaatattttagaatggctagaaaacttggtattatgtagcacagaaaaagtggtatgactgaagagatagagaacttaccacaaagggtcttgaatgccatgatacatagtttggattttcttctgtagggagcaaggagttagtgaaggattttaaaagcaacatgactcttgggaggtagattcaatgtgagactaatctccgaggtataggaaatacaggaaggaggagcaacaggtcgggtagtggtggaagcaggtttggaaaatgtgattggttttgtaaacgtttttgagtttgaagtgccactggggaaggcttttggaaatttatttccagagttcaagactgagctatcattgcagtttgctcagctatttactgagc

SEQ ID NO: 133208 - DNA, 1039 bp, Homo sapiens
ttttttagttgaagttttattttttccctttacatattgtatcctttagtgctttatttcactaataagaattatagtatgcaatcatttcccacctctatattcagtatatcaatttttgtttttcctttctacttctgtcttttgctataatttgctgtaatacaggtactttcatcaaggcatccagttctttatatcattctatatttttacttgggagaaatagaaatgttgctaattccatcttactgacaatacctaaattattgtttgttatagaacataatgatttaaatatacaaaacactaaactgtttgagattttttacattttatgcgtgcagaatttacattttatgtgtgcagagacaaaaattgttataagattacaagttaatgtgcaagatgatttccgattcatgagtttcaggttttgatagcatatccttatccactagattagtcttttaaaaatgtgtatgatagggaaaaaatcgagggcatgaaattctgagacttatgggaactaaacttaaatgttcgttgttagatttttttttttttttttttttgctgcgtatgaagttttaggcagtcattgtccaacaacattaaatactgaacatatgggaaaagcatatgatttttcgaaatgtttttctaaagtaatctcattctacatacacttaagagcagttataatgctttagtgacacttgaagtagctatttaatgtgatctcaccactatagggaaggccgttgcatgacttttttgtgtgtgcttaactgctaaacaggagaatcttttcctgagcaaccagctgggaaggatttaatttgacattctccctactaggacccccccaaagagactcattccctccaatagttcctacaagttctttctctttcctaaacttgctgttactaatttacccctcactgttcttcaaggcaaagcatctgcaaggttttcagtcctttccccctcccgtcctgtccccatcagtgttgaaatgtatgctacagttatt

SEQ ID NO: 133209 - DNA, 1033 bp, Homo sapiens
gactggagatagggagactaatcacagaagagatgaaaaggacctgaagtaatgtagtgtggatagggaagagtgagtagatttgatattcaagagggagaatttctaggacttgatgaccacctggatatgagttttggggaatggtagtagtagatgattctctggcttttggcttgagtgactggagagattggggaatgatgctcaactgagagagaataccaggtagaggcatcgtacatatggtagcagaggcaggagggctgtgatgatgagtcctattttggacatgcatttgagatacctgggggctatccaggtaggatgtggctgtaagatcaatccatgatggagacactggctgtgttgtggtcatatcatctgggctgtgggagagcatgagatcgaatgagattgagatacaggacatgaaggtggagagtctaaagagaagctgtgtgtaagtgtggaagaggccatgatgaagacacagtattatgagctcttgccagcaattaaaaccatgagactaaatgaaatgttcctgaaattgtgtaagaagaagacagaagatcacttgttgatcttcacttgcaatttcatttccctgtagcgtggctcattccgttgttttcttttctctgtttaaggaaatggcatcagattttcatgatagcatgtacagcctactgtttcggaagacctctctgagcccactgatccccactctgcctccctagaagtgatttctcaggcacacattctctttggtcctcttgctcctgtgactctttgggaactttccctagaggcttctgtttcatttgttctctgcttatctctccaagcagattcgagtcctgacagcagggatcatatctttgcctgctttgtctcccccaaccaaaacctaacagctctttctttattttttatttttattttttgagatggagtctccctctgtcacccaggctggagtgcagtggtgcgattttggctcactgcaacttcacctcccgggttcaag

SEQ ID NO: 133210 - DNA, 1013 bp, Homo sapiens
attgtgtatttggctgcatatgaatatggcatgaagaacagaagaaaatataattcacttaaaggaggtatatcataggatatagaaaataatatccagggtcaacaagatttggagcacctgatacgaacagccaggaaatgggatgccaatgagggtctactctatgcttccaatgaaagtgaggatggagtaattgaagaaatactcctcaagactaattgaaactaacattcattcccaaaaagtaagccatgtcagcagatgagatttatttttggattaaaaaataacttcacagaaacttttagatctgttatcgcggcccatatccagttacaacattaaatttttttctatatagaaacagatttctaaattcttaacagatatcacactttgagtaatgtcatatacaagtaaattgcagaaaagcagagaatttcagccaacagaagtcactgtagtggactttgacctggactttgttgtgaaataaaactcttgagcttgtcacaccaagttgtattggaatgggacaataaattccaaagattcattgagtccttaaaatgggtgggtaggctttatgtatatgctgggtacaaattcaaatcgactaggttggaaacaagaaaaggatgaatggatttcatgattgttttgaatttagaattttgaatacagttatccaatatttcttctcccctcttttcatgagaaaggattaccctgaaatggggccaggcaggccactggtttccttgaagtcttagttgaaatatgcttcttcaatcattaaccagtaaacagatatgacttccataatcttcactgtcaaggaaagttacctttagcacatgcctgtggatccctttcaatatgtgtgataattttggtttcaagggtcatgtgttatggtcaagtgctgcttcagaatcttagaggctgttctagaacgcttgatgtctaaagcttgccatgtttcaatttaacatcagtttgtgaatatc

SEQ ID NO: 133211 - DNA, 1023 bp, Homo sapiens
tttttttttttttttttttgagatggagtctcacaccgtcaccgaggctggagtgcagtggcgtgatctcagctcactgcaagctccacctcctgggttcacgccattctcctgcctcagcctcctgagtagctgggactccaggcgccagccaccacgccttgctaattttttatatttttagtagagacggggtttcaccatgttagccaggatggtcttgatctcctgaccttgtgatctgcccgcctcggcctcgcaaagtgctgggattacaggcgtgagccaccgcacacagcctaatttttgtatttttagtagagatggggtttcgccatgttgtccaggccagtcttgaactcctgacctcaggtgatccacccgccttggcctcccaaagtgctgggattacaggcgtgagctaccatgcccggcccttcttgaatattcttcatgattgttcttctataagaacattagagtaattttgtcaagttctaaacaaaactgctagtgggatattaattgtaactccattgcatttctgcgtttatttaagggaacattgtcatctttacagttaagctttaacattcagcaggatggtgaatcattttattaatttaagtcttcttttatgttccatgatttcttttttttttttgagacagagtctcgctctgtcgcccaggctggagtacagtggcgcgatcttggctcactgcaagctccaccccccgggttcacgccattctcctgcctcagcctcccaagtagctgggactacaggcgcccgccaccatgcctgactgattttttgtatttttagtagagacggggtttcaccgtgttagccaggatggtctcaatctcccgacctcgtgattcacccgcctcagcctcccaaagtgctgggattacaggcgtgagccaccacgcccggccggttccatgattttttaatgttagttctgtacacctatcttttgaatgtattctatttgtttatactctttctttctt

SEQ ID NO: 133212 - DNA, 1027 bp, Homo sapiens
ttatgttctaggccagtgttgttcaacggaacttcccgcaatgatggaaatgttctataatttgcaccaatgcggtagccacaagctatgtgtggctatagggcatttgaaatgtggccagtgtgtctgagaactgtaatttttaatcttaattttagttaaatttaaacttaaataagcacacgtggctgatgactgccatgctggggagtgcagttttcaggcggtgatgtactgtaacattgttgtaggggctagtgacaaatgaaaggcctgtgcaaagccagtggcagagcacaagttgtacagggttgagggagatgacacgggaaggcttttgtgttagttgagcaacaaagttgggtgcaaagttgagtaggaaaagatgtggggaatatttttgaaaagaaaattacatttccaatcagtgcgactaccagaagttttctgccattggtggaactagggaagtttgggaaagagtattgtgttattttgggattttgtttgtttgttgtttaaaaaggcaagagacctaaaaggaagcaggaggcgcagggcacgagtttacttgaaagaggatggtctcaatgcaagtcaaatactgatgctagacattcaagttttgtctgttttatatgtgaagaaatgacccagccccacctctccaaaacaaacagatgtcagggtggttcagtgacatatgccaggttaccttgcagttctttgttaggaagatgattagaagctccagtcacatgatgtcccatgttgtcatttgtccgttggactgggtcagtgtttcccaacaccagggccttgactgtcatgggaaacgtgcactgccatttgcctttcttcttgtctcacctcttcaccctgaggttgtcgttctaggcccctcaccccttcctcttctgtttctcctgcctttctgggcctgcccacaataggcctccactgggagattctggttttgatgaccgcaggctgccgtggggtcagaggccacctgcctgtggcaccg

SEQ ID NO: 133213 - DNA, 1026 bp, Homo sapiens
tcctcttctctttcccttttctacttcactccttccataaaatcgatgtgctcaataaatgtaccttcaatacctaagtctccctgtaatcaacttacataaataagaaatcactttctgggacataaacatgaacctggcttcaaatgcaacacgttgtgactgaaaagcaaatgtggctcaggttactactgttaacatgaagcaattcatgtttgaacagaattttcaaaatcaaattttgaactcactgctggagacgatgtggcccccttcatttcctggattattatgcatctcccacagaaccatttgctatattatttctttggtgtttacagaagcagatcatgtttatgaagcatgtccagaagaaggaaatgatatatggaaaatctctacgtggggtatagagtcaagtgatccctaggttacagttgagagctataaataggccagtgacttcatgtgtaccatgggactggtattttccatctttcgtcccacagtttggataaacttagatggattttttaatagttctttgaaaatggaacattagctatccacagagatttaacttgggacaaaaaaaaggaataaaagtcatcatttctgatgacaggattagacagaccttttttcttgaaagtaattgaatattctgtgtgttttttgcagtttctgttgaattgagaatagtgaccatcatttgaggtggaaatagcagaaatgattaatttagaaagaagaaggattgtagggtgggtggaagtggcattttctgcattgtattcttagaaacttagactgttagagttggaagtgctctgataaaaccgttctttaacatacgagaaaacagaggcccaaataccttaagtcccttgtccaagagtatgctgagtgcagaaagccacactgtggctcaggtcctgggccctggccctcagcgtttctcagcccactgcactcatctccagcacttctgatggactcactggggtgacaccatcaaaccatgtg

SEQ ID NO: 133214 - DNA, 1035 bp, Homo sapiens
gccaaacctcagcctcgtcattgttttggagcaagaaagagaattgaacctcactcatgttttgttgcctgtaccattgaacaaggccctgactgttaagactaatgttgagacccttgttttctttgcagactgcatcatctgctattaaaggtgctattcagctgggaataggatacacagtgggtaatctcacttccaagccagaacgagatgttcttatgcaagacttttatgtggtggaaagtgtgttcctacccaggtaagaacatttttatttgtgatgatttccatgctaaggaaccttctttgtgacaaccccatattgaagggcttttctactatgtacatgtttatatgtacagatgtgaatattgggcctttggcagggccaaaggcagtccaaatgatgtttacttcctgtttcatcaggatgtctcacaatttttatgtggagatggtaaataggtttcatctatggactaattctaattagttgtgatgaatgcctggaagaccatatggagaaagattttgaggttcagtgggaaagagtgcagtaatcacagagtaatgtccgccaagggtttatagaaagaaggcttccatgaagcagcaactggtgctaggtttttgctccccctaatttaaaagcatgggctggtaggcccataattgggcctcaaatctgagtttagtcttatctcttctcttttatgatgactttaacttaactttcctcgagaaaacatggataatcctgctgtttgcaaaaataccaaagttacccatatatgttgtctctagctttcatcattttagggtgaggggatcaattatttaaaaacaaatacatctggaaatggatgatggtaatatgaatgtattaatgccacaaaactgtacacttaaaagtggctaacatagtaaattttatgttgagtatattttaccacaataaaactaattaattaaaaattctattactacgttcatttaggaagagaagaagtaatcattaaataagtatcacca

SEQ ID NO: 133215 - DNA, 1061 bp, Homo sapiens
gagaaaccatagaattctacagcataatggtgatactcctgttcagtatcataatcacagtttattgcacattgatgctagtctatgaatagcccccaaagggttattaaagtggatcaaaacaatttattatttcattcgtgttatgtataaatgacataataaaagaatatttgacaatgtagtaaccaatgaaatagtcttcatattatgtcactgcatttttttttaatgtcactgcttatagaagaattggagactttaattgggagcagatgttcaggtctgaatccagttttttctagacacctctttccggatcaccccctaatttctcaatttgcaacctctaatttctgcatcctttgttgttttcatattttcacaacataaactcctacccataaggaagttctgtgtcaggaattcaaatgccatggaacaaagaatccaaattcctaaagagagtctagggtctgcctttactttttatgagagcttggagtccacacctttatattccagggtcccaaattcgtgagtaaatgagaaacccaacattttcttgcttcactcagaatgttttagtgtctctttggatcaccctgaagtcatgggcagtaggctgagaacctcagtgtatcctagggtggtatcagctcttccttacctgcctgtggaatgagtatattgtaggccgtgtgcttctctcacctgtgtgtgatcatgtcataaaattaacaacagcaatacatggtcactctttgccagggttttcaaaagcattcactttaaaaacttccagtgactttccagtagatattattacctttattttagaaatgaaacttctaaaactccaagatgctaaattccttactcagaatcacataactagcaactgatacaaatctcacgcccttttcacaaatcgctcttccacaaggacactttgtctgcacacatggctgggcaagtgctctctgattcctctcggtttttatggtgtcctgtctgcagtctgatagctatttttgttttcctaacttatcctcaactca

SEQ ID NO: 133216 - DNA, 1033 bp, Homo sapiens
gtttttttatgcatgcctcactctgctggaccgttcttcccctcttctacacctggccctcacctgctcgtctcaggactactcagggatcagttcctccaagaccgtgctgttgtggttccccatgcatcctgggcttacttctttcatgggacttaatacactgttactttttcacatgtaaatcctggagcctgaggagcaaggcttaatctatctttatatctacatgcctggttcttagtaggtacttagtaagtgtttattggaatatgtatttgaacagaggaataatcagctgtctaatgatttaaaaaaagagaaagaaaggtttaggtaagaaacctgtctttggtgatttttgtgtatctagctattttttaagttctgcctattttggaggaagtatccagtttcactgcaatgcctgccaaaaattgcactgagaatttaataaagtagattatctccattttgaatcacttgggattatttgaaaagttgtactggttgtcctcctatcaagagtcatttgtgtaacaaaagtacatttatattgcagtgagttttcccatggaagcaatgttgtaaatggtcattagactttttttctttccaacttttattttaagttcaggggtacatgagcagatttgttacatgggtaaattgtcatgagggtttgctgtacagattatttcatcactcaggtaataagcatagtacctaataggtaaattttccatctttctaccctcctcctcccgccctccaccctcaagtaggcccttgtgtctgtcattttctactttatgttcacatgtgctcaatgtgcaactcccatttagaagtaagaacatgcaatatttggttttctgttactaggttaattcacttagaataatggtcttcacctccatccatgttgctgcaaaggacatgatttcattctttttatggctacatagtattctgtgttgcgtatgtaccatattttcattatccagtccactgttgatgggcatctaggttg

SEQ ID NO: 133217 - DNA, 1053 bp, Homo sapiens
gtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagttt

SEQ ID NO: 133218 - DNA, 1063 bp, Homo sapiens
tgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgata

SEQ ID NO: 133219 - DNA, 1118 bp, Homo sapiens
aacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacaca

SEQ ID NO: 133220 - DNA, 1038 bp, Homo sapiens
cccgccaccacgcccggctaatttttttgaattttttttcttttttttagtagagacggggtttcaccgtgttagccaggatggtcttgatctcctgacctcgtgatccgcccacctcggccttccaaagtgctgggattacaggcctgagccacggcgcccagccttattttattttttgagacagagtcttgctgtgtttccaggctggagtgcagtggtgtaatcttggttcactgcagcttcaacctctcaggctcaagtgatcctcccacctcagcctcccaagtagctgggactacaggtgcaaactaccatgcctggctaattttgtttatttttgtagaggctagtttaaattattattattatttttttctgtagattgggttcttgctttgctgcccaggctagtcttgaactcctggctttaagccatcctcccgccttggcctcccaaagtgttgggattacaggtgtgagcccccgctattttttcttgacccttgcctcttcttgtgttacgactttcatcacaatgaggttatcaacttgtagtaagaatttacagcttcctttgattgaaaagtccctttgaaatggtgaatgaagataattcaaacggcaagatttggcagaacattctctcttaagaagactcctgcattcacagactttcagaatgttattacttccttttaattctagtaaggcaagagagaaaaggtttaccctcctatagtatgttctcttctgaacaatatagttcagagttttatttggtaaatggatgcattttgcaatctacatgagaaaacatttcttagaaaatgtccagtgaatggttttatcagtgatttcagtgatgtttggggaatcacctggtagcttaataaaaatggaaactctccaaatattccagatttattaagtcaaactctttttttgttgttgttgagatggagtttcgctcttgtcacccaggctggagtgcaacggcgcgatcttggcttactgcaacctctgcttcccaggttc

SEQ ID NO: 133221 - DNA, 1024 bp, Homo sapiens
aagtgatctgcccacctcggcttccaccttccaaagtgctgagattacgggcatgagccattgcacctggctcaccttgattctgatatgtaattaggtttgggggtcactagaataaacacatgcacacacacacactcgaatgtgagtgcaaaccaagatataaaattaatctgaagttacaagataacacaattttatatacaacatgaaataaaattaacaatagtttcttccttataattaggtagacagttcaagtttggcaaatctaattggcaccttttgatattgatcatcactgaactttagaatccccagtgtccagaactactggtctccataggagatatcaaggtactggactagtatttgatttagcattaatgaacactagttgtgtacccattgtgaaacagggattttcagatatactgtcgttaaatctttacaacaaccttgagcatggtatttctttttttctcattttacggaagagaaaattgaggccactttgggtcttcttgcttgaaaccatggttcttttcctggtcctcccattgtagaataagaaattcctacctactcactccccttcacctccagcagttatattgagatgtaattcatgacaagctatgtacagtattcataaattcttcatgcaaatcttttggaacatcaggtactgtgctaggccctgaggcaaataaaaagatgagccaaaatggaaataaatttcaaaagagcaaaggactcaagagccaagggttcttttcatggtaccctgagacctctgatgagttagattatacttgaatggggtcttaggttggctgggccagctccccagaaaatcaagtcgtgggcatttgcttattgagatgggtcagaagtactctgcatgacagtacctacctggcaccctgaaatgccacacagtgtaaaagaaaggacccaggctttaggtgtggaagaactgacctctgctacaaccagctgaatgaaccacagtaaatctcat

SEQ ID NO: 133222 - DNA, 1002 bp, Homo sapiens
ttttttttttgagatggagtctggctctgtcgcccaggctggagtgcagtggagtgatctcgtttcactacaagctctgccttccgggttcacaccattctcctgcctcagcctcccgagtagctgggactacaggcgcccaacaccacgcccggctaatttttgttgttatttttcagtagagacggggtttcatcgtgttagccaggatggtctcaatctcctgacctcgtgatccgcccgcctcggcctcccaaagtcctgggattacaggcgtgagccactgcgcctggctattagattattattcctggacttttttcttgattcttttccaagggaaaaggacatagggaaagaggaaattctgttttgaataaattctccagtttcaatggtttagattagaagcatactgaaaatgtaaattgagccatttgctcttttggaatttattgcggcttaggcctctgggcctagtgtaatacctgatgttcctaaagatttgaatgaagaattaatgaatacgtagtttcttggggttgatggggagtacgtaagcagggacttactattctacctgctgatttaatgtccatgaaaataatcatacactaaaatgttaataatacatacacacaaacggactagtgtacatggtggacattttaaactctttcaccaaaatatttattgattaacatctgtcagggccagatgaggtggttcatgcctgtaataccagcactttgggcagatcacttgaatccaagagttcgagaccagcctggccaacatggtgaaacccagtctctactaaaaatatgaaaaattagccaggcatggtggcgtgtgctgtccttccagctactcaggaggctgaggtgggagaatccttttagcctgggaggtccaggctgcagtgagctgtgattgcaccactgcactccacctgggcaacagaacaagaacctgtcgcaaaaaacaaaaaaaaaccccgtc

SEQ ID NO: 133223 - DNA, 1084 bp, Homo sapiens
gaccaaagccaggctcacgcctgtaatcccagcactttgggaagctgaggcaggaggatcacctgaggtcaggagttcgagaccagcctggccaacatggtgaaaccctgtctctactaaaaataaaaaaattagctgggcgtggtggcgtgcctgtaatcccagctgcttgggaggctgaggcaagaaaatcgcctgaacccgggaggcggaggttgcagtgagccaagatcacgccattgcactccagcctgggggacaagagcgaaactctgcctcaaaaaaaaaaaaaaaaagaaaaagaaaaaaaagaaaaagaaagtaaaaaaagagtagattaataagacatttttcacgagtcagtgcatttttgttccttgtttcccaagctgcacggcagtgtttttcctttgtagccacagagaattttcttcattctctacagtcacaagccagtattgagtttcttaaatatctgttgtgttttggaggctcgctataacctgacctcaggttatactgtttggatcttgtattatggggaaatgttggtaatagcagagaactagggaagtcagctggatttagaaaaagaaaacttccatttgagggttctttgagacagtagtgggataggtgagtggaagtgtgtagcgcagtgattctcaaacattagtttgcatctgaaccatctggaaggcttgtcaaaatacagattgcaggcccccctcctggagtttctgattgcgtagatctggggcgggggctcaagaatctgtgtctctaacgagtgcccacccaggtcatgctgctgctgctgctctgggaatcccgctttgagaaccagtgctttggaggcctttggaagtgcaggtctggaacttgcatgacggaaggggccgggcttgaggctggtctgggcatcctgtgtgtgcaggggcttggtggagctgtggaagtgggtaccagccaaagcagggcgcatagacaagtgctgaggacgaattgaggaatactgtggggaggggtggctgcgaggaagaacagagctgagagataaggaagaaatggacagagggttatg

SEQ ID NO: 133224 - DNA, 1734 bp, Homo sapiens
cccaaatttcagactcacacaaggaaagcagctgttcagcataaaccacatggttgtacagtttaaggacagtgtgagactcttaccagtcctggcagtggtgggaatccaaattcccaggcatcagctgagagccaccttgtaagtgggtctttcaaaggataacagtcaggcttgctatgttaccttttggatggggatgagagtggcaggtgaggatggtggtggggacccctgaacttggagaagggatctgttaatgcagcctcggggcctggtgctgcaggagaaggtggaaggaagtgaactggggttttgcacctagatcctgggttcagaatgataactgggattcctgcactacacggatagagaagggtggaaaagagttcaaagtcctgtgcattcattcatccatttattcattcttaacaggcgcttatcaatgcctatgccctttgaggcactgtggcaaggtgctaaggataccacggtgagcagggtaaattctctgctctcatgagacccacttctagagggaatgaatgaggaaaggggcagttaaattcattgctatggggatataccaaaggccctagggtacctacctggtaggcttagtgggagttcagaaggcatgaattttataatcagaccaacctgggtaggaatcacacctctactacttattacctgtgtgccttgggcaagttacttagtcacctggtgcctagatttcttcatttcttcatctaaaaacagggagaatttattgccttttttttaagatagggtctcactgtgttgctcaggctggagtgcagtggtgcaatctcgactcactgcaacttctgcctcctggattcaagtgatcctcctacctcagcctcccaaacagctgggactacaggcatgtgccatcacacctggctaatttttgtattttttgtagagacagggttttaccatattgcccagcctggtctcgaacgcttgagctcaagcaaccctcctgcctcggcctcccaaagtgctgggattacaggcatgagccactgtgcccatcctttcttttaaggctgttgtgagaactaaacaaggccgtgtatgtagagtgcttatttcaggggctggcacagtagaaatgttcactaaataatggcttagcgacgcctagccaaggataggtgtgtattctccggaaagactggcgtctgctgcatcttcactctgcaagtcacttcagaggcatccccttcagccctgggctcatgggtgcacacaagcctgcattcctgccacactgctccgcttgctggtctaagaatgctttcctgtttcatttttctggctttttttttttttttttttttttgagacagggtctcgctctgtcacccaggctggagtacagtggcgcgatctcggctcactgcagcctctgcctcccgagttcaagcgattctcctgcctcagcctcctgagtagctgggactacagcgtgcaccatcatgcccagctaagttttatatttttagtacagacagtgtttcaccatgttgtccaggctggcctcgaattcctgacctcaagtgacccgcctgcctcagcctcccaacgtgctgggattacagatgtgagccaccatgcccagcctcatttttctggctcttgaacacacttttctctttacctggatgccccagatttcttttgtcagcctaaggaatatgt

SEQ ID NO: 133225 - DNA, 1014 bp, Homo sapiens
atcatcatagataagaatcactttgtaagagctgcatgttaaatgcatcgaaaattccaataaaaaatgaaactttaaaacatcccatttgcaaaatatcatgtcacttttcactgcaggagaacagcttccaatgggtaacaagtttaagttgattttttcttgttgttagctcaggctttgttacttatttagagtgttgtatagtaatttttatcatgcgtcatcagaaatacaatttgttagaacaatgactgttgtgtgagtgtaattacatcttcctgtatgattaaatgagggctgtatgggacctttactcagaggtggcagctgtagccaaccaagttcagcctataaaagaattcctgggactaactggtactaattgtttgcagaacaaccagtgggagtaatattcatgaatactatggaaatgaaatattccaagaccaaatgctttagcccttgttttttactttattgtggtcagattatattaattgcataatcaggccaagtgaagtgggagctcttggtcttttgttgtttttggaagaaaacttagccttcatctattcagtcctctcatcttataaacagggaaattgaggcttagggagtagttgaagggttatttaaagtcaccaaactgtaatataccctgtcagagttttaagtacactcatatacccctgtcagatttttaagtacactctaccgtatacatgagtatattagtttgtaaatagtgtaccttattacaatttaaaagatattagttctcaaggtaaatattatgaatattcaaaacacaaacattcaattttattttttatttttttgagacagagtctctctctgtcacccaggctggaataaaatgacacgattatagcttactgcagcctcgaacttgtgggctcaagtgatcctcctgcctcagcctcctaaagtgctaggagtacagatgtgagccacgtgcccagcaacactcaaatttttaaagcatgagag

SEQ ID NO: 133226 - DNA, 2079 bp, Homo sapiens
tggaagcttctcactatagatgtaaatactttttgtctgttttggggacccatatagaaaaaagggtcctctgtcttgtggggataataaatgagttcttcattaagaacttgtttcttcttggtggagaatggaactcctagactgatttaaaaataggaatgaaattgttggataatattctaatacccaagaagatgaataatgggtgtgtctagagcccatttttacaatctagacatttaattttctgattttgaaaatgtttttttaacatggtttacaaatgtagcaattcttaagaatgaagaaaatatgccttattactataatgtttttcaacaatacaagtgtttttctgattaaagtgtatgtgcagactatgcttcggggaaatactttgcttgaaacagcagttttccttccacatctctttctgcagccccactgatttaccatgatgaagaaaggttgagaagttctttatgcatagctacaagccttagttctaactttcttctctgaagtcttcttttgtgcttcttacacattaaagacaaggtgaatttaaggtgcctttatggtagacgatatttttagggcctgaatttaattttcaaactgaatgagtcacacagtagcatgtactgatcaacttgcatctgtgtagcaaatatttctttttaacaattagatagttactagcttatttttatcatatgagcaatgtacattcattatagaagatttagaaaatacagaaaaataagggggaaaattacccattgtcctatctccccaagagaactactagaatcgtttaggtcagtggttgtcaacggggaggtggaaatagggaattttgctccccaggggacaattgtcaatgtctggggcattttttttgttgttatagcccaggggttgctattggcatctagttggtagagtctggggatactgcccaacatcccacaaggtacaggacagccccctgcaacaacgaattatccagcccacagtgtcaacggtgccactggtgagacatttgatttagataggttttcttcccatctgtaaaagggtacattttattagaaaaaaataaatatttctttgggaaatcttagagatgctttagaatggaattctgaggcaacattttaattatattattgttattctactgttattgtcttgaaagtaaatggaagtgtgtatatgcgtggagagggcagggggcatacagagactctatcagagtccatgtaggttaatgctgttcagccagggctgtggaaaacattgtaatgactaaactgagattctccaagtagcctctcgtgattgggcatgcggtagcctagaccttagtctcagaatgacgaaagtttagaactgggaggacctttgccagggatggcaaacaggtttcatgtggaagacaggtgccagttgatggttggctgcttggagtatctagctaggaggacctggaggccaaacctgggcttagcgggaaaggaatatcgcaactgattagggatgtttgttctgaacctatgattagggaattggggagatgcaagccgtggcctatatatttaccattcctgaattctagtttagtgttcgaattttacaagtgggaaactcagcctcattggagtcatcctgatcaagggcctggctctcagacagaaacgggatgttcttagtttctgcctcagggtctttcatgaagggattcggcctaaacaagctcccatgattcagatgtgcaagttgattgctagattattaatttttgttcagagataacctctactagcaattggaataagtaccctaaatagacctaaatagatctctgcttctcctcatttccccaaatcaaaccaaacagaagtcaaattattacaaagtagcccttaataagggaagttgaatgtgccttttttttgagagagagaacgtttccttaagctggatgaaatagcattggatcagaggacgaacaagatcttccttgtacctataatactctttgagttctgtgaatacacagggataaaacat

SEQ ID NO: 133227 - DNA, 1083 bp, Homo sapiens
agtgctaactcggtttcagtatagccacaatggagaaagatagaataaaaataattgatacccaaatactaacctaaaatacccagccacctatgaatcttccttttgaaatctgtaaagtttttcagctttaactcatgttacctgacaattttacattatctctcaatactattgaaatccaagaatatattttatttctttctgccaaatgttcttttaatttagaggccctattcaataatagtgtattttagaaacaactgattgttattgggggtttgtatacatgaaaaaactccttggattattatagagaaagttaaagccaggatacattagaaatgcagaaaactccttaaattaaaaagcaagccattttaataaaagaaataagctctccttggagctgatacctgtagaaaagtttgcatatgaagccaaaagcataactaagtacctctcgatttgtaagccatttatttatctttggaagtaataatagaaaccatgtatgggctgggctttaatcccgttgcttgctttgtaggatgtccagatggcatagctttagcctttgcctacatttcctgctgatcctgggagaagggaaatgtgcctcccgcctgtacaaataaaactgacaccatcttttctttctatttcatcgtgtagggagtagagtgttttgcacagacgccacaatatcagtttgtctagcaaacagaagagtatgtccagaagtggtgagaggctgcattcttcctcccactgaaagtttttcctgtgactgcccgagtgaagctgccttcacaagctcaacccagaaaggagcttgcctccttgtggtattcgaaaggcacatgcaggcttcataagaatttgcagaaggggtatttcttgggttttcttggtcttaggggtaaaacgagaaagtatttgccatctttcctgctggtgagcaacccataaatataaacacaagcctaggccagttgcggtggctcatgcctgtaatcccagcactttaggaggccaaggtggatggatcacttgaggtcaggagttcgacaccagccgggc

SEQ ID NO: 133228 - DNA, 1595 bp, Homo sapiens
ggattgtggtgacagttgcataactctgtgaaggtactaaaagccatcctaaaaacgggcaaattgtatggtatgtggacttcagtgcatttcccaaaatcttaccattgcagggaatgagcatgttggatttttaacaacactgtcttttccagggtgcgaagtaccacattactgtcatctccctgtgagtgggattggcaccccggctgcagctccaggagcaagtactccaggaagcacagagctgtaccagtacacggcccacgttgccaggtatttgcttatttaatctctcatcaacctagttactggtctcccccaaaatttgttcgaatagttaccgttttcacattctagaggtagtcagagttaccatttttgatgttgctgatatatacattttcatagaaaatttaatggtaatgtcctatttaccaaagaatagaaacatcttacctgaattaatggactgaattgataggtataactttgccatggttggtgaatgcttattgaggatgacctttctggcatgtaagtaagtacaacttctgtggttcaaaataaatgcctaaattggcatttggtgctgatgatgtctgggattggaggtcattttaataggttatattttttcattatcattgaggtagtaaaattatataacagtggtaagcactttgatgaaaagataaaggacatcagtcacactggcttctaaagattaattatgtccaagcttttagtgaaagagctaggagcgagtattatctatttactgattcacttttaagagtgaatcaaatgagatttacaaggtcttaaattttgacagatgtgggatgcatttgttttttgttacactttgacctctgtttataggccaggccatggctagctggaatggggttgtaatttttttcatgtgcttgttttataattcctgtctgttgaagttggcagcccctacttgggtggattccagataaatgtgtgaactggagtttagtggagtgtgaatggcacactccagaagagcagatagtcgttcagatcctagtcctgctgccttctaattgtgtgatcttgggcacatgtcttaatgcttctgagcctcagatccttcatctgtaaaaagggaacgtcgacatgaaactaaatgagttaatgggcccagcaagtaccaggcccatgctaaggcctttctcagtgtctagttgtccaaatgaggacattcaagtgggggaagtcctcattttccactgaattaacagggctggatgtgggttttgtttactgaaatgttctctctggagctctttttttttttttttttttttttttttttttgagacggagtctcgctctgtcgcccaggctggagtgcagtggtgcgatctcggctcactgcaagctccgccctctggagctcttaaaggtcccagccaggcaaggcagctcatacctataatcccactgttttgggaagtagaggtgggaggatcgcttgaggccaagagtttgaaaccagcctaggcaacatagtgagaccctgtctctatttaaaaaaaaataataataataatttgctg

SEQ ID NO: 133229 - DNA, 1309 bp, Homo sapiens
gctatttaggatctgggaagtgtacaagttaattacccccaccctcaaaaaagaaaaaagaggaggactttaacaaactttgaaagtgatcatgagggcaggacgcggtggctcatgcctgtaatcccagcgctttgggaggctgaggcaggtggatcacctgaggtcaggagatcgagaccatcctggccaacacggtgaaaccccatctctactaaaaatacaaaaattagccaggtgtggtggtgggcgcctgtagtcccagctactcaggaggctgaggcaggagaatcgcttgaacctgggaggcagaggttgcagtgagctaagacggcgccattgcacattgcaatccagcctgagcaacaagcgcgaaactgtctcaaaaaaaaaaaaaaaagaaaaaagaaagtaatatataataactaaaagtgaaagcataagggggaagcagaacgttagatgccgctctcctggaggtaatcacaggggccattgagtggggtgattattgtgggaggaagcctgcaggtgaaccgggtggttattgttaactggtgtttggactgaggaagatgggtggagccaggagaggagatgaggctacctggaagtgggggcggggacgggggaggacacaaggcctttactgaaaaaacatcaggtccttctggcggagttttagctgctgcctcagcactttagtcatctctgtagttgagcaattctcctaacgtgtcacaatgtgtttacatatcgttgtcttcaacacactgtgagcaggctcccttttataaattgtcattatcttctgtatagctaccccagggtatatggtaggcattcaagaaaggtttgttaaaggagagttacgattccagtctactttacagtgtacacgttaactaaattgtttggtgaacctgtaaacttttctctttttttttttttttgggggggggatggagtttcactcttgtcgcccaggctggagtgcagtggcgtgatctcggcttactgaaacccccacctcccaagttcaagtgattctcctgcctcagtctcccaagtagctgggactacaggcgcctgctaccatgccagctaatttttttgtatttttagtagagacggggtttcaccatgttagtcagggtggtctcgaactcctgatctcagttgatccatccgcctcggcctcccaaagttttgggattacaggcgtgagccaccgtacccggctgaacttgtaaacttttcagtgttagttttctttgctcccagttgatgatactttataaccatattg

SEQ ID NO: 133230 - DNA, 1849 bp, Homo sapiens
taagtacctgttgagtagaagaatttttttttttttttttttttttttgagacggaatctcgctctgtcaccaggctggagtgcagtggtgcaatctcgtctcactgtaacctccgcctcttgggttcaagcgattctcctgcctcagcctcctgaacagctgggactacaggcgtgcgccaccacgcccagctaatttttgttatttttagtagagacggggtctcaccatgttggccaggatggtcttgatttcttgacctcgcgatctgtccgcctcgacctcccaaagtgctgggattacaggcatgagccaccgcgccctgcggagtagaagttctttggataaacacattctaggagtggggtcaaaatgtgcaaacccacacgtgaagaagatgactaataaattgtttctccaaagagttgtattgatttacactgccaccagcaaaaaagctaatatatcaactgaaccgtgtttctaacaaccatttactgaatgcttatcatctgtcaggtgttgtgccagaagaatggagtttgtctataaatatttcatcatttcgagtagtgcagtccaacagaactttctgcattgatggaaatattctatatttgcactgtccaatagggtagctattagccacatgtggcttctgagcccttgaaatgagacaagtgtgactgaagaactgaatttgtcatttcctctaattttagttaatttacatgtaaatgtaaacacttactggtggcaagtggtcatcttattgaacagtgccgctctagagagaaaaaaggaaatcagtcagtagatgtaactgccacattctggattattttttaaatgttagtggctctaagcccacatcattaaggtgtggccacctttcaagtgctatcatttttattagtcagcaccacctaatttgggaaatattttatttttttttccttttttttgattaaaacaatttttaaaaaatagagatggggtctcactatgttgcccagactggtctcaaactcgtgggctcaagtgattctcctgccttgccttcccaaagtgctgggattacaggcatgagccaccgtgcctggccagatttgggaaacattttataaataggtgcttagatcaggagagcaatgccttacatcaggaatacaaccaaaatgtctaagtccggagactcgaggcaaagtgggaaacgttactcacagtgctttttatccagaggcgtggacttagttactccaaaggagtccagaagcataacacttctggagaggcatctactggacttgtttttccacgaaacttctagacttgttttgatcaggcaggaagtgaagcaacttttcagggagagagcccagcatctgcatctcctctgggacagaccacaccttttaccttctacttgtgagcctaggacgagttttgctttccaattaagggaagagcagggcaggcaaaactattctcttacaagatggttttttaagatttcaaacccaaggttatatttttaatcggtacctgtttggattctccaaattaatttatatgctcttaaaataaagacacttaacgtcactgcacaattctttgcacatggaggacttcgaaaggaataagcacactgaattgcattagatgaatcctgtcagataagcacttgtgacctactggcaaccttttataagctgatgatgggagaggagtttcaatctctttattggagttgttggaaatgtgccaaagagataacctggaatatattgtcctgaaaagtcctgttttaatatttaatacgaacatcttataaccctcggaattcgg

SEQ ID NO: 133231 - DNA, 2102 bp, Homo sapiens
cggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccggggctcctggaacctttactctgaagtcacttgggctggagattaaggcgcgagtaggggacactgtcttgaacccggtgtcctggatttctgctggcttggaggcatctcgtgtctgttgtgtcgcttgcatgtctttgtgttttccttctctatttcaaaccacactcggtattgatgcaaagttacaggcttgtgtacgtgagagaaactgaaaactcatcacagagcagaatcccttttccctttcaatcagctgcgtctgtaatagaagtaaaagttgtttttttttttttttttttccagtagggaatggggatggaggtttggaaggacccacaaaagaggagtgtgatgaatgctttgtattctagtactagcctacctgtcaccagttctttttatgtcttcatttgtcaagtttctgcttttacacggtagtttaagttataaataatcagggatttctaccacagggttttaacattcttgaaatgtggacaaacttgggagtgagtgctcccgcgcttagtaatggaatacagcctcccacctctatttcagcttcagttcttaggctaggctgcttttctggcagctgtctggcctgagtaatgatggttgtggtttccctgaagttcccagcggagagtcatcccatgatagaaactgccttgcgcttctcactcacgctctcagcccggggaatcccagcggggaggagggagggaggtcgttttcttcagctccccaggtggtctgtgctgggtgtgctgacggtccttttgggaaaacaggtccacctttgccagcgtaattcagaaagagatgtaattttctgagagcacacacctgggcaggagatcgcttgaagtgagaaattcgtagtggtaaatgtatttgtagcaaagtaccactgcatatcctgcttgagaggatgaaatttgattatttagtaagttttcatgaacaactccacttcagtgtggggattacgcagatgagcaagagcgtggctctgtcacacagtcccgttgggaaagcctgcaactcattaagaatccgatgagtgccatttagaaatgtggacagggtactggagcttcctcattgtggggagatggcagaagcggaggtgctttactaaagcaccggtggcttttgaggtgtttcttgtgtttttttcagaactacttctgcagtggggccactttatttcttttcagagctacttatgcagattgatgaaggggaactttcccctctgaaatgctgctgtaactttttcagtaccatccagatattataatactgaatgagcccctactcctgccagtcactgtgggggatacaaagatgaacaagattcaatttctgcatttaggggtctagtggacctgaaactgttagactttactctgcaatctgtgtcgggattcctgagactgagggagggaatgtatgatgccgatgcacactctgcaatacagaaatttagcaaagagtgggattggtcctatatgcattcccttcaggggattcttgctgggaataaagggcatttgaacagttacctcacccgagcaagccactatagaaaatggggccagtaatgcgcccacctcaccgggc

SEQ ID NO: 133232 - DNA, 2627 bp, Homo sapiens
aagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgattaggaaaagcacttcttagaactgggtgactgacagctagagccccagaagacctgcacaagctggggcaatggctacccataacagtgacggctccattctgttttttaaagggattggtgtctctatcatccagctggccattaaacaaccaaagcttcatcatcctagataacctgtgagctctcagaggagacagagtaaggactatcatacccccaaaatacctaatcatttaataaagcattttctctaccttttatgctatcccaaaacagtgctttccaaagtctggtatacagacagacttacaggtggtgcagagagatacatattctatttttcaattatgatgcatgaatattatatgttaggaataaaaacagaaaaccagctaccacatccatttatttcatggctagattgcttagaatgaggcaaaaataaatattaagtaaagcagtgagtttgctttaagaaaaattatcaactctgggaatgagtaatatgaggctaaggcaaaaatggtaaagctagcccttgacatctgaggtgtgcataatactgcttaaaatatgagtgtggtgcttacttatagagagcctggtataccttgaccacgccttcaagaaagtcaaacacagaatggcccagaatagccaggaaagttgaatttgatggactttctgtcttaagcgtgtgcatcctgctcttatccactcagatctcttagatgtggttgcagacagtgtatttgtagagctagctgtttgttttaacgtctggcccaattctcattcctttctctgcttccacaagccattctgcagtttttaaaggtctgttggtatgatatttttgatatgatagagtgataggggaggaagtattttgacactgatgaaggacatcactgtattatcaagtgactcttgctcatgattcattgccgaagaatgtggacagccaaacagcctcacctgtaaatgcatttaatttctcaaagtctttcagaagaatgccaactggatgagtttttttttcttattttttttttaatatgaagcttgtattggtctgtaaaataggctttaacaaggattttcgtaggaacaggaagccttgaggtagaaaacaagtatccctgctttgacctagagagatgcatgctcatggcaggcgaatgaatcaaggagaagagaaaatactgtttcagtagactctctagtgatgtgtgtgttcacaccatttatgagaaatcctaagctttcaattagtaacttgtactttagtcatttaaaatcagcacagatgtttgtttagtgcctctgccagatggttaaagttaaatcaggttttttaacctgaaaaacgtaatgtagctttccttaaccatttacacaccattgtatattgcagaccatagtcagatacattttgttataatgaatgtttattttaccttttagctcaattagaatatcagtggttatggtttctattttgttttcctacagttactgtatgggggtgcagtaacagcggtggtggtgaaagtaagttacttttttctttttctttctttttttttttttttgagacggagtctccctctgtcgcccaggctggaatgcagtggtgcgatctcggctcactgcaagctccacctcccgggttcacgccattcagcctccccagtagctgggactacaggcgcccgccaccacgcccggctaattttttgtatttttagtagagacggggtttcaccatgttagccaggat

SEQ ID NO: 133233 - DNA, 1064 bp, Homo sapiens
aagctgagcacacctgagaccctgggtggagctctacaatgggaataggagtaagtaatgtaggcttcgagagacaatcattctgctctcagtccttggaagactgttcctaggtatatatggcaaagcagatgaaattatttgagggaattaattagcaaaactaaacatttctgtttttgaaaggaatgaatcatttggaaggaacttcctggtgagctcagttttagcagcctggtttctgcgttacccttctgcagtctggctgaatcaattgtgttcttgcctgtgattggtgaggatgcacatgctagtatttattctagcccttatcacttcccatcagccctgagcccctccctggtctgagtcatcttggtaaccccagaagctaacagagcaccaacacatccactaaacgttggactgacttgatttggggcaggcttgttgtataagctagtaggaataagagactaattgagaaattaggacagtggattcctgacatttatatagtgagtagatgatcgtttgttagaattgcgaatttcatccagagaattttgtccaaaaaaaattatagaatttcatctagaccatttttgtaatggcatggaagcagcattagctgcaccactgattagctgggtggcttttgctgtcttgtgactctagtttgcaatttcttttttttttttttttttttttttttgaggtggagtctagccctatcgctgaggctggagtgcaatggcccgatctcagctcactgcaacgtctgcctcctaggttcaagcgattctcctgcctcagcctcccaagtagctgggattacaggcacacgccaccacaccctgctaattttttgtatctttggtagagacggggcttcaccatgttggccaggctggtctcgaactcctgagctcgtgatccgcctgccttggcctcccgaagtgctgggattataggcatgagccacctcgcctggcctagttctcagtttctttatcagaaaatgagtagttacagttgatcatctcaaagtcttttgtgcttaa

SEQ ID NO: 133234 - DNA, 1012 bp, Homo sapiens
caaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatgtactcactaagaacttacctcttattaattaaacaaatacaaggaaataaataacccaataaaaacactcaaaacaagtttatccccaaatagtgtacttgatgctaaggacagacctaaagtttgttgaggatagaaatgaaaaatgaggcaaaagaaaccaggaattgagatgtgtgtgtgcctgtaccagcacccgtgtgagccccttgcaggtaacgacccatggtccctgcacatcagtcttctgttactaagttttgcataaattgagtctggtggttggcaagctacatatagccagctgcgtgtttgttgttttttctgcctgctagctaagaactgttcttgcattttaaatggttatgtaagtatctatatgatctccgtgattttgcctcttgtagtggcaagcctaaaatatttattgtcaggccctttgagaaaatgtttcctggctcctgcctcagacctcctggaagcagggtgttggcttgatttgtctcctgttctgcaatctgggaatagtagatcaggatgctgacttgtgggaagatgctggctgcatgagatgcccctgtctgcagtcactcatagcttggaaaagcaaaaaggaaaaagggttggatctgag

SEQ ID NO: 133235 - DNA, 1094 bp, Homo sapiens
ttccctctatgcagaatgcccacccacctgaccagttagtcatccttcagcatggagctgtgggagagggagcctccctgtggttgggacatacctccctccaccccaggcctctcatcctcagttaacaacccgcctgtgccatcaattacactgttttgtggttttttacacctttttttctagacacaggatctcactgtattgccaaggctggagtgtggtggcatgatcatagctcactgtagcctccaactcctgtgctcaagtgatcctcctgcctcagtgtcctgagcagctaggactataggcacatgccactgcacctggctagattttaacatttttctttttgtagagataggatcttgctttgttgcctagcccagtcttgaactcctgggctcaactgatgctcccacttcagcctcttaaagtgctgggattataggcttgagccaccatgggggctggcctcgcttcacattttatgtagttgctataaccccaccactcaccctgctccagcccatgtcaccttttctctttcctaaatgtactaagcttgtttcccaccccagggcctttgcatttgctgttcccgcagcaatctggagagctgttcagattttcctaggattaattcttcccagtctgccatcccatggcacttattactacctgagatgatgatatatattgactcttgtctgctttctctgctaaaatcctccctgtgaggaaacgagtttggcacatatcccctggcagcatctgacatggcataagtactcagggagtatatgtcgaatgaatgagcctcttggtgggctcttgtacttgcactgaattgtaattgcttgtttacacatcccacctccccactgggctgtgtgacttcctttgcatcataacttggggtgatttgtctttctgtccacagggccaggtgcatggttgcttttgggtctgtaagtatggaagctaggaatctttgagaaggcacatccttaaacccataagctcttctcatggaggtagctgtccaccacaaaatgtccttctgatgccattggtagaacaagtactggttg

SEQ ID NO: 133236 - DNA, 1024 bp, Homo sapiens
atatacatctcagcctcaaatcaaatggcacactttacatttgcacgctgtttggccaagcccattggcatataacatacactatggtagcaagaattggccagaggctccccaagaccagacttctgaattcctaaccccagctcccaagccccaggcatcccataaaatctttgctagatgttcagaaacctaaaatttgcttctccacccctcccttctccccaagtggtaaagacaaagaacagacggcagggctctttgttattcttttatctgctaagtttacaaaaaggttagacagtggaactttgctgagcaagcattctgtccctgagttgtctctgagcagcaccaaatgagtcttatcttccccttgttatctccaaggacgtaaaacattttcttttcatgctttttaatttctgtgtaacattagccattcagttgacctgaaacattgctagtttatttctagctggcgtgtgtgtgtgtgtatcagagggtctatactgtataaatacttctctaaatattcttttccataatgttgctctaaagtgtctcatttactcaattctgtcaacttagatgctgaatcattttatgtgcttaaaagaaatatctactcggatgctctagttccctggcaagggagagagagggagagaaagaaagctgttgaagtggtgcaaatccaaactgctttcttttttgctcataagtagtgcttttcaaagcgtttggcatccctgccatatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgtgagtccctctgcaagctctccccttgttttccccaacctttc

SEQ ID NO: 133237 - DNA, 1090 bp, Homo sapiens
gagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgt

SEQ ID NO: 133238 - DNA, 1043 bp, Homo sapiens
attttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatt

SEQ ID NO: 133239 - DNA, 1039 bp, Homo sapiens
aaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaac

SEQ ID NO: 133240 - DNA, 1922 bp, Homo sapiens
actttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcagg

SEQ ID NO: 133241 - DNA, 1016 bp, Homo sapiens
tcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcc

SEQ ID NO: 133242 - DNA, 1030 bp, Homo sapiens
attggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacat

SEQ ID NO: 133243 - DNA, 1443 bp, Homo sapiens
tctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactagg

SEQ ID NO: 133244 - DNA, 1130 bp, Homo sapiens
tgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagcc

SEQ ID NO: 133245 - DNA, 1559 bp, Homo sapiens
ataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaaaaaaagattgtaaagaaaaagattgaaaaatactgtactgtatacccagaatcaccaatcgcagaacgtgtttttcttttgctgtccagctaaagttttctgcccagtctgatttagatgcaccagataattcttactggtgatgtgctaaagagaataatcatcaccactgcttacaatgcctctcattaagagagctgcttatttgtttaataaatcattatccagagcagaatcaatataaagacacaagggcttatatcaaaagattatttacctttagtcagaatcagagctgtgactctatgtttttccttataccagaataaaacctatttaactcaataatttattatttattattactattttttgagacagagtctcactctgttgcccaggctggagtgcagtggtgcaatctcggctcactgcaacctccacctcctgggttcaagtgattctcctgcctcagcctcccgagtagctgggacttagaggtgtgcaccactatattcagctaatttttgtatttttagtagagatggggtttcgacatgttggccaggctggtctcgaactcctggcctcaggtgatccacccacttcggcctcccacagtgctgggattacaggcgtgagccactgcgcccagcctaactcaataatttagatgagaagaaagccataattgattgtgtgagccatcagaagtagtaaatgtgataggtactaagtaataataagtgacctcataaaatacatcagcgaaaatttgcaagccgggcaagactggaagtgtgaaggaaaagtggctgttagcgtgaagcagtgctctcctcgctccccaccccagtctcattcctcagctggacatgggtctcacctgggccggctcatgtaccctcagtgcagcagtgacctcagaagcccactcttcgagtcccaaagcctgaattgttctgagatcttctccaagatgctgatctcctctagaacaaaattattccaggtctgatcttacctccagcaatcacagccctcccagcactttccctattcctttttggcttcctgacattcctaatagactagtataggaagggaggtagggctcaggaagcctggccagtggctgtttgccctgctgtattacattccttgtcagaatggtatttgtggaccacctt

SEQ ID NO: 133246 - DNA, 1008 bp, Homo sapiens
tcctgggcaaagtcaaaatatttgagaagatggatcacaaggccaggttacagagaatgcaggagctccaggaagcacagaatgcaagggtaattgtttttaaactacacatcatcaataagagttttaaataagtttgatttcaacataacagcgaacagcccctttgctgctgctgcagatgtggcagggatgcactgcaccaaaggcaggtgctgtgtatgtcacttcagattgccagctcccagcacgtcccttgttcttccaaagaagaaaacttgacaatataggggaagaagattctgctctttatacacagaactttgtatagagttctggaatgaggaagtgtgaggagggaatcagtgcctctcggaagtcgttttaattagaatgtgatttttttttcttaaacgtgtcttcattggctcccagatttgccgtagaaaccaagcaaactgggtgctaaaacagaaaggcccatagattgtactttttgagctgtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcac

SEQ ID NO: 133247 - DNA, 1645 bp, Homo sapiens
tcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaattttctttgtggtggatttgtatgctacttcctatttttaaatgcaacttttatttcagttactaatcatagaagtgattactaacctccttgtcgaacattggaaaatggaaacgtgaaaaagaaaattatacccataatcccatccctcagataattttggtgtattttctccaattacgtatttgtggatgtctgtgtgtatgatacttgagggtgtactgtgtttgtagttctatttcctattttttctgtttatcattctatcactaacatttctcaagtggttacaactgtgcagcaaggtatttaaagcgtggtgtacacatcatcattaacaacca

SEQ ID NO: 133248 - DNA, 1050 bp, Homo sapiens
taagtttttggaattaagaagtacacattattgcatgagggtcataataatagccagcatttatttgggcactttccacgagccaaacaccatctaagtcctttacatgcatcctctcctgagaattgtcttatggaggcagcgttattattattttaaagattttctacattgtattctggtgatgtttgttgaagtacttagtggtgccattgtttccttgccccagaaagtcctctttgccctgtgtgccttgaatgccctgaccaccaccgtctgcttggtggccgctgccctccgctacctccagatattcgcaaccaggagatcctgcatcgtaagtctatgcaagggcatcatggccacgtttccgctgagccagcccatggaccccttcgtgtcatccactgcctctctccccgtgcctttgtaatgaaggctgttgactaactgagctgctgtttaatcaggatgaatcccagatttctgctgaagaagcggaggatcatggacgcatccccgaccctgatgattttgtgccgcctgtgcctcccccttcctattttgccacgttttactcgtgcacaccccggatgaaccgcaggtatcgttcctgagttcccctgcagtctgagtgggatgctgtgggttctgaagactgaagtgtctccagaactcaccacatgagatctcacttttctttgaaaaagaaaaagaaaaatttttcctgacttgaggaacgttagcccaatgagtgacaaaatcagctagtgaaccctgtggtatggcttttagagagtccacctctgccagccttctttagaaaaatgaaaaacaattatgctgtttttcaggggtttctattctctctgtctctctctctctgttttctgtcttactttctctttttgtctgataaaacagatgaatccaaagaaaagttaaactttggcctgaagatagacattttcaatttcaattagctttctaagggaaactgacacccagggagataacagctgtaatttgacatgattgagagtcgctgtt

SEQ ID NO: 133249 - DNA, 1089 bp, Homo sapiens
cattcgtttattcattcaacaaacgtggaatcctctgtgctgggttattggaattcaaaatgagctagacctgcttcctcctctaccattaaggagctcacagtctaggtcattaaaatgtgtgttggaaggatcacggtaatattcaaaagagggactttgggtgcacagagaaggtacacctaacccagagtggcaaggcagtcagagatggcttcctggatgaagtgaacttaagctgagtttaaaggataagcaaacatctgttgaactttttgaaagagaatctcttaattccacagaaatactagtgtctttagcttcatattcagagggccagaaatttctattttttaatccctgtagtacatgtagagacttatcaaactaacttggtgctgagcttgaggtttttagagaagtattttctaatgtccagggtgatggtatgtgactttgagataggtcaccagtggggctgccacccagacactgttagtgttcttttcagtggcttagctgctgactcgtccctcagttatacctgaaccctacgtctataccctccccagctcacttgcccaggcaggggcagagatgactgcaaagctggaggggatgtcagctgggtgacaggtggcctgggctaggcctgtgggacagcttggcctctctggtgttcagggagtggcctctactggaatttcaaagcctcaggggctgggatggcttccttaatctttcaggaaatgagccaagaatgacagaggctgaagagatatggcagcaaaacacatgttctttctgtacctgaggacacatttgcaaaaatcttagcgccgtctcaggctgtctgtagagggtacattggaggacagtaaaaaatgactgatatttcatggtggggatgagaaataccctctccaataagaagaattctttgacactgaggttgcggatgagcactctgttgacctaggaggaggcagcagacagatttagtttctgcagtggcagaaagggaaagtgactcatgtgggtttaggagccgagccatccagcagtgtgctctgagcactcccgaccttc

SEQ ID NO: 133250 - DNA, 1046 bp, Homo sapiens
caagggaagagaacccagtttttctgggatgtggaagcatgtctgggaaaattaaagagtgcatcctaggaataaaagcggaggatgtggacagtgtggagtgcattcaacatttgatttcctgaattgaaggtttcctttgatagggcatgttttctcagccctttggaaatgatgacataggtgaattttaatatcaacaagattctaagaggctgttcacattcccatgaaatgtttggcaagataaataagccaacaggtcctaagggaataagcaccttttcttcttgtagattaaaaagtacaaggcaatccccgaaactgaagccacttggggaaaagatagaattgggcatgaacataatccagttgggtctcaggtttctcctctttaaagtaaatggttggactaggtagtctctctacctttatttttgaatgaatggagtttccttctggtaagagccttctctccacctcttttaagagccattcccttttaggtgttggcttcattgctgcaggtagtggggtggatgttgtagacagcaccccacaatggcgtatggatgttttgtggctctgtgtctttgggcattaaatggctaacaaatacttcctcaactgaagtgggctaatttctcagggtaattaccaacttcaggatgtaggtaaattttcaattcaaattgagtaaataccctctcactgtcccttccgttccccctttctacctgctggcctcttcttacagaagccagaagccaaactctctcccagtccctcaggggattcagcggggaggaatgatctgattacttgcatgaagaggtacatgaaccacagaccctcttgggtttgcactctgaaagagtgatcagttgacggttccgggtgaggctccagttactaacctatgtagggaaaacattttacatcctggtgtcccttagctactccagatgtcattgtctgtcaccttccctctgtccggccccaatagcccaataatcaggagtcacttctggaaggctgccaagctc

SEQ ID NO: 133251 - DNA, 1015 bp, Homo sapiens
gaacatttggaggatttacaaagaacctctggaattccaagtgagttccactttgggaaaatgccttttttttttctttttcaaagcaattacacattaagataggtggatggacctaggaggtaggtcaaagggccacatctggtaaagcttacttaacttctccccacccctctcttttcccaaagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaa

SEQ ID NO: 133252 - DNA, 2352 bp, Homo sapiens
gggctctgtagatggttttcatctgtgtgcgggaggtgttggtgcccacagggtgaggggggcagaggagcgatgggggaggtagtaggttactctgggactccctgaaggcggtgttgatgggcaatgttcagaaagcaaacccgtgcacagggacccggcacccctgccatgcactcctaggagcctgctctggcgagggaaggtgtcgctggagaagtgggctccaggcattggtctttgggggtttcttcctctcatgaacccaaggctgatggtggctccctgaaatgctcacactggagaaaaggcaggatgggttctggtgcctctgcctggaccaggagggggaggtgaacgtgggagtccaaccccaaagctgagccaccagcacaccctggtggagcagccacagcagctctgtgccctcacagcgtttgggaaggctgccctgtacatagccttcccattacatggggtatttagatatttacatgtataactatatatactgggatgacagaagggaagaccaccacttctcttgggactttcaaaaaatctagcgacttgcttttaagactgtggctgctgaggtgaccatacctaggctcactcccttgccccagtggtagtgggaaaaagaacccacttcagctgggtggacctgtaccgagctccagcaacttccactcactgggtgtgaagacacacctggattaacacaaaagaatgtggcagagaaatcttctcactctaatgttacaatgtcagtcctctaggagagcttgcagaattggctttttcagcacctctcaaagtttacaaggtttttgtgcaataggaatagaaagtatattctctcctttaggtgaacatacataaccgttatgtgcaggttgtacagggatgcactactggagttctgtcccctggccagtcgtgggcgggcctctgtggcactgcccaggtgcctagggacagacaggcatgggcccctacgatgattttccaaggctcctgatgcctgaaataccaccagtaacacttcattcctgttctatccactcttattggcagaggaaagatgaactggctgatgactctttagtgtctcactgtatcaccagatactctacagcaaatggagaaccctggccatggttccttcctggtcctcacgtttgtgatgggttgaccttgaggctggtctcccagaaacattctgtaaagcatccttcaaagaagtcctggggagctttacggaccatcccagagcccctggccccaccgggtgccactctctgcagcagcagaagtccctttccccccagggcacctgggcagccagcggcctcccttcctcagggctcctttgtaacacagtgaaactgagagtgccactgctcgttcctgtcaagcactgagcttccctgattctaagcagaaaactcagaagatgcagagatctcggggaattgatcacagaactctctggttgaagtctcttgtccctaatcttgttatagtcactttgctccctccttagaatccctccattctctctataaatacatgctacccaccatttgctcactgagttcctatttccatagacacaacataaatatctcggatgcagagaacagggactatattaattacaaaatataatagtttctcttcccctgtctctactgaggtcatgaatgaaacaaaacaaaagcaaagccaaatcacacctcacatgaacacaaaatgctctttggaccaagtgaaaactggctcagaattataatattactaaaacatctacactgaactgagacggaagcataaatatgaggcacctgatgaaaacacggaacaattccacaccagccaaaaatgctctcaggcccacaaggcagcaagagggtgtttatggaccacatctggggattctgaggcataacttgaggttgctattgtctccttaattttgtggtttatgtactattctggcctttccaatatcacatccgcctagtggccctgagcagagaagaaagttggtcttgccttgggccagaaaacaagacgcaattgcacctgcagcttgccttcttgggaacagtccctccttcccagactcctgggatgtgtgttcggcagggaggggagtccaggaggaggatgctttaagccaaagtggtgctggaggggctgggcctcagcgcagagagggcaggtctctcaggatgaggctgagcagcccccgcctgcctggccacctgccagggaaggggccttccagagaggtgggtttccaggggatctgtgtgcctaatcttcagcttgtctcactggtgg

SEQ ID NO: 133253 - DNA, 1090 bp, Homo sapiens
cagtcactgctcggcttcacctacccagggctaagacgccacatgttgcagatggagccctcttagcccacgcacagatggggttcctgtgggcaatgccttccttttgggaagtgggctgggttcaagggatctgatcaaagtacttgtgcaactatgaggaagtatcagatgtcctttttggcttcaaagatgaaggaggcacactatttcccccagccaggagcaacatgagtgggaaatggacttttcttctgaaaggcaaactctagcaatgactcctcttctaacaaaggacatctaactcacagcaactggcctgattcatcatggctcttttctcttgtctctgatgctcctctttccccttctttctgccagttagagattttatagctgtcaacattcccacagcaaccagggactccaatcagtgtgtgcctccttgggagaatggggagggttgtaggatgggtgttgatggagaaggaagaggaagaaatacgacttgcagactgttgtttcatgatccctgatgacacacctctccctctaaattaaaatggagcgtagagggaaagctgatcttcgactataaaaaggaactagtttcagagactatgtagaaagcttccacctctgtgtggtctgagctgagctcaggctcctgctcctgtcccctgatcagactcacagcagtgacagaagccctggtgtgctcagaagcatctttagaaaaccatcacaaggctacacttgccctctgctgggtggtgggaaggtttgctcctgcaggcctgaccactgacttgtcagcttcaccctagaggagggtgccaggcaaaaggaactcagccctgaaacaaatgtccacttccagtctccccagggtgcctgctgtgcctcaacaaactcctcattgccacatggaggagaaggaatggctgatagcaggtgccttcccacccctttcaagtcatggtatgcaggaggatcatgtttgcatgctggggtaaacagaccacactgttgtagctgcaggccctgcagcccctggccctgctataagagctgaggcagcgggggtcat

SEQ ID NO: 133254 - DNA, 1472 bp, Homo sapiens
tgggcttcttttgtggggctaggaggtacggtggagagcagctcagacattcatgcagatatttttatctgctttgagtgcttcctcctttccatccacctaatcaataaatatttacgaatcacttgtcatgtgccaagaaatgtgttaggcactggagattcagggaagcgcaccctctccggggctggataagagacattatcagtactaagcacagggctctgagcccagagggggctggagtcccttcacccttttctctctaatcacacaccaggagaccaggaatttgtgggaaagaagagagatgaatgatgaagacaggagcatgttgttggaatctcaacccttcaggcaaagccacctgctttaaatgtttacgcctattaaccactgagattatttaggtatgcttgtgtgatacagaaaatgttacccaacataccgaaaagcaagagaatgactctattttctcaatgttgcctaaaaaattcatattgctctggtgggttctttccggttctttccttctctgtgaattgatttgggatgcctgatctgtccctcagtgaaaaattttctagattggggaaaatgtgttgcaagatgaagcttagagaaatagcaatttgaaataacgagaccatgcatttgctctgctgttcctaatcaatgtttcatgttgggtcccattaacttggatttctgagctgccattttattggaggtgccaattaaataaagggtcatttggtccccatgacaacagtggaacggtacagcaaattaagaaatctggtgggaggggaagcccagagaagaggggcgaagagagaaaagagaagccagaatggtctctatagcaacgggagagcagaaccatgatgctcctggggaagcaagggaagctgtgcgctattctaaaacagagcaaaaacccagagggcaggaccacagaggcaaaggcacagaaagaggcagcctgtaaaatgttccacccaccaataattatgccttgggaattaattatgacccaaaaaataaggtaggaagagtaaggcaagtcaatacctataattctactctagaaattgatttcctgtaacctggggggacaatagtcaaccagtattgaagtggccagatgcagaatgcacactttggatccctgttcctgaaagtgtagcctgcagactggtgatgccatccccgccgcaaagcctgccaaaaatgcagaattccaccctatacctgctgaatcagacctgcattctaacaagatccccaggtgattccaatcagtttgagaagcactgattcatcaggatgagagttgcttgtcaaagtcactgcaaagagcatggacatacactgaaacaaatttgaacacagccttgaagtggtccagatgctgctctgcagtggcccgaggggtgggggtagggcagtgtgcacatctgtccaggtgc

SEQ ID NO: 133255 - DNA, 1016 bp, Homo sapiens
gaaccaaggctatcagacgccatcttctcttcccagatcaggactccgtgctccatgtgagaaacagagcctattcctctgtgtcaggaggaaaaatgagcacagtcaaaagcaatggccctcagggggtgggtgagttttctgctattaaaaattactatagggctgtggcctcccctgggaggcggcttctgaggactgctgaggcccaggatggtgcggggaggtaggggagcacctgggagcagcttagttcaggctgcagtttgcagcctggtggcctcactagcagcttgggttacaaccctgaaagtaggccaaatgacagaatggcttctgttgtaaacaaattttctctgttgactgcatcacccagagaaatggagcttaggaaccactggctttgtgccaggaaaaggagctggttttcctaaggactggggtgggcagtgctcctgctgtttgctggggagggacagggatgctaactttcctgtagcccagaggatggtcctggaccacaaagaactgtcctcccaaaatgccctcatgcttggacagacctgctcaaacccctacaggaggtgccaaattcttcctactcttcacctcatcccaaagtcgctaatagcttggcctcctttcccttcctcaaagggaaacgcagctagcccctgcctcagggccttcgcatttgctccttcctctttctcactttattcaggtctctgctccaaggtcacctcctcaagtgagggctttgttgatcaccctacctgacatagcccctgtccctccatcccctgaccctgttttatttgtctgtggagcactccccactacccaattttacattaagtatatttacctattgattttctgcctcctttcagcccttgcgatgagtaccctgtctgttttactcagccttatatctctagtgctggaacagtgcctgacacacagtacgtgcacaataaatacatgcatcatgtgtgatgaattagactgaatca

SEQ ID NO: 133256 - DNA, 1046 bp, Homo sapiens
caccttacagccagtcaagtatggttcgcatgcagggtgggctccagggctcactgcaaagcccatgctgagggatcaacggatacccacccaggccggagggcatttcccttagctaatcaagagcaggaaatgatctgtggcaggtgaaaagaaataagaaattccaaacagttgaatctcttgtggagaagtttaaaaaaaaaaaagacaaatcaaaatggcagggctgtttctgtttttgtgtgcgtgaatgtaagagattttaaataaaatttcttaaaagacaaatttgttcacattaatgaattctctgattaaaatttctgaaaatgctaaacgtcatccatgtcttaggggtgtttttgggctttaagaaagcaatcccaaaccccacccagcagcaggcactgtgaacaccaccttctagctcactggggcccagaatctagggacagctgctctacagacacatgcctgctctacagacacatgcatctctgagttacgatgtcactaagcttcaccctgggaaaggtggaagccagctgatacctgtgtgtcggcgttcagcactttgattctctgggtagaaatgaagagatccacttcagtcattggctgagattcgccttcaggagcctgagaagaaaaaatgcaccaagagaaagtttgaccacactaccctgacccagatgcagaaggagtaaggttagctcacacagaggcaccacgacacagtcaccagaacagcaatacagactctagggttaaactgccaaagctgaagttaccacacagaggatggacacatggacaagagttagcacctctaggttacagggaaaaatgcggaatccccttttcttcttcccctatagaagcagtaactcactgcagtagatttcactctttgaacgatgatggcaagtggccctctctgtaagggttttggagcccaacagattgaagaaataggccaaaaagctcataccaaaagaccttggggaagtcacttagaatttgcctctgcttgagctgatagg

SEQ ID NO: 133257 - DNA, 1010 bp, Homo sapiens
acatgtgtggttattagcgagttttcttttttgcatccagcaatctgacaaatccacaaatcaagcataactataatcaaacagactcaagtccctgccacatcgatgctcctgaatgtttggaacttccatactactatacgattcattcagcgtctccaatctgctccctgtcgttcctctgaagtgaaatgactaatgagcaacagaaaacggccaccttcggcaactgagttttgagaaacgctggcttatggggcggttcaaaaagaaatctgaacaaaaacttgctggatgcagaaaacaaaaacacgaaaatataaaaaggtaaaacagaaacgaatgaaaagaacaggcataacaccaagctgatgaagttgtttgtactgcaccttcttcctgcttttggctaatttctgggccatctgcttagcatggaacaaacagagacaggagaatagttagaaagaatgtgtagagactcaaagtcaaaaagggaattgacaaactaatactgaatagtggcataaagcgtttctgtgggaggaggactggcttttaaaaatcccagtctaaagataatcaatgtcgtaattcagaatttagtatgtgggaagtggtgaagtgagacaaaggaaatgtgttgcagtgcttcttatacttaattgcaagtgatctttccaaataaccaagttttggttctgttaattttctttattgtacgcctggttttctatttcactgatttcagcatagatctttatttccttctactttctttgggtttaatttgctgacttctcagcttcctgagataaaaacttaaattatggcttttcaaactttattctgatatgcaaagctatgaatctccctctaagcattgctttggatgtattccacagatttttgtgtttcaatttaatcattgttccgttaaattttttttcaaatttccactgcaatttcttagaaccttggattatttggaattgtattattaattttga

SEQ ID NO: 133258 - DNA, 1485 bp, Homo sapiens
ttggccagcctggtctcaaatgatctcaggtgatccatctgcctcagcctcccaaagtgctgggattacaggcgcgagccaccgcgcctggcctctagttatctttttctgctgattttggaattaattccactgtggtcagagaacacagtctgtatgtcaatcttttgaaatatgctgaggcttagctctatggtccagcacatgactgcctttggtggatgtgtcatgtgcacttcaaaatatgcattccgtagttgttagggacagtgttcaatcaatgacaattaggtcaattaaggtggttaacagtattgttcaaaccttctatatacttgctggttctttaatctcttgttccatcatttattgagtgtgttaaaacctccagctgttatgtggatttgtctgtgtatcctgattctgtcaatctttatcttacagctatgttataaggtgcacacacaggtaggatggtatacctgcttggtaaattgatcctttcattgttctccctttttatctccagtaatacttcttgccttaaatttatgtaatattaatgtagtttacacctaactaaaaatggatgtaccattctcccttttgctcacaattaaaagacagcatagttgataaaagcagagcgtggggctggattgtctaaaaccaagtcctggctctgccacttactagctgtgcaactttgaggcaagccactgaacatctctgtgcctcagtttcttcatctgtaaagtgaagataaaaatagtatctacctcacagggatattttgaggacaaaatgaatacatgcaaagctcttcaaacagtgcctcatacattctaagcactatatttgtgtttgctgttatatgattataattgacctaggtcatgatgcaatttcttgccttttgctaagacttgctatttatacagatcttgtacaaataatggcaagtcaatggccaaactgcagacgctattgtggtaatgggattggggtggaggaagaactgctctctcatattcctgggtactcacctggtagaaaagctcctctgctctcagcagcacatctctgtttcattagtgactaaaatatgttgcctatactacctcattgtagagaaactggataagtcagccatccagacaccacatagcgaatctctggtacacccgggaaaccagggcaaccacactcccacacagatgccctgctgttcttactggtcgccatgagttcacagtgaatagtctgctctgaaaaagtttgaaggtagcaactctgtcatcctgactgctgcacattacagtgggaatagttctgcatctgagaagtgaccctatgctgatgttatgccatgccacaccacgaggattcccgtgtggaaccccagagtctggccagggatgttcggactggcatcagttataatctgcataactgacagctgggagatctttaatgtttgttttt

SEQ ID NO: 133259 - DNA, 1614 bp, Homo sapiens
acctcaggtcatccacccgccttggcctcccatagtgctgggagtacaggcgtgagccactgtgcctggcccgaaacagtttttatgaagttaaaaatattctgtggatttagagtaataccatctttaaatcactcatgatatccaagtaccctgcaacaaattataatttaaaatttaaatataacatcacagaagatgggagagttggagccagaatgagaaattagggtagcagaaaggggtccaagagaaacataaggccagcatgcattttaaagccaggaatgacaacatctatttaaaccctcgtgtttcatgggattgatcatggtttaccacgtggcggggtgtagtgcaaaggacaaactgcagcaccccccacccccttactccatccacaatgtgtactgagtttctgccgctgttaacacactctagattagtcgtgccagggatgctcctgactgttctatcttttctctccccactgacatttactgagaacttgctatgtgccagaatccttcaaagtatttcacataaatcagtgtaaaagcttacaacacccctgtgagctactaccctgctagatggtaagccatgatcaatcccatgaaacacgaggtttaagtagatgttgtcatttctgcctatattatgttatcctcatttttcagaagagggaaatgtggcacagagaggctaattaacttgccccaggtcacacagctgtgaagtggcagaatagagattcaaactctggcaatctcactccattgtaaacccctagttgtgcaactggggcaagcatgtcatctgtaaacttctccatttgtctataccatggggttaacaacacctacctcacaatgttctctaccccatccattttgaggagtaaatgagattgagataatgcatgtgaagggcctaatactttactgatcatagatttcttcaactaagctgggaaatgctacaacttaggcaaagctataatgatagacattttacttctacaatgaaatcataattttgagaaaatcataaaagaatgaaaaaaatctgatctttgggacaggctagttaagatgaatatatgaatatttgataatgaatgcagcttgccaaaatgcatggaccacaagatacctatacaccatttgtaatctaatctaattgcattagcttcacaaatacaggaagaatggagacacaaacaccacactctgggtggatggacatgaagcagtctctgtggttcaggtagggctcagcaggccaccctatcttctggttgaagagcagagaatgaagtgggaatgagagtggaaggcaaggtggagatgcagtggagaacaaggaagacaaatgagctcattgtgctggcttccagtctggctttctctagaaaggggtaggcatgagtcccacgttgttaggggagagatgtgtttctatctacggcacattaaagactgacagcacataggacaaagctctctctagaagtttctcccaaaacatgttccagagaatactaccaatgacaggtatctatcacatggtaacaatgtattctgtgctcaaataagtatgggagctgctagt

SEQ ID NO: 133260 - DNA, 1054 bp, Homo sapiens
taggcaggtctaaaatgtatttataatcagaaagcctctatcttggttgttctgatcaacagagccatctaatttttgattcaaatgaactgtggaacttcgggataccaatcctttggaagctttgaagtaaaatctctgatttcttatgaggcagctggactttaaagaaggaataacaactctataggacaccactttggaaataagaaaatgtaattcacaatataattggcactgacgagctttggtacagggatgctgtgtaccccgaacattgctttacgttcaagtgatgtgccccgtgcccgctttttccctgtaaggccatctcagcactacctaagtgccataaggggactggaaaggcataaatgttctgtctgtaggagtccaaagctatcagagggctaataaacaaggtgtcccaaatgaaacctgaaccttaaaatgtttgaagccttgatggatagaacctagaaaaaactaacctcaaggcaacgtgcagttttcaacctcagaagtcttcagtactcctttgggggcagactgctgctttattctggaagatacgcctgaacgggctctgggtagcattccttgataggggctctttggcattttggtagagataaaatctttgttttgtggctctgccctggatgttatagggtcttgagcacacctggctctggcccagaaaatgcccccagtcatggtgacaagcagaggtgcccccactcatttccaaacacatcttatgaaggcagtccctgtctatcagagaccccaagtgaggcacaccaggcttttgtgcttccaccaaacctggggaagctaacagcaccattcacctggaagcccaggtggcatatctggtacccatggggcacgtggagtcagaactatgtctctatgtctctttgatttaaagttctctgctttatacaaaataggacgtgactttgcctgagaagcagcttgctctctctgagaggtttgtgggttgttgttttgaatgctgtgcctggaagacaactaaattaagatggag

SEQ ID NO: 133261 - DNA, 1097 bp, Homo sapiens
gctcagtattttcttttcagctcttaccttcaacgtaggttgggaatgaagccaagctttttcttgactgtaataaagacaaagaggtttcaaaaagagcaaagcataatgaaatatgaattaacacaatcatccatgcaacatgaaaaataaatacataatcagtggcagttaccaattattgatcatttttagttagagaaagtaaagtgcagataaacatgcatttattagtaaaggttacctaaaacccagaatagtccattcatattttagataatctagaaatcttacatttcacaatcagagaggtatttgccaactaaaaaacaatcccacagacaagtctctaacaacaataaaaagggcacaatttgtattcttaaggatctgcatttccatgtgaaaaactgattagtgaaagcaccaatgctatgattatagctgaaattaagaattctctcagagaaatttattttactctttgccacagtgatctctcactgtgctaaaaatgtgtgctagagtttttaaaaatctcttcatctcctactgatttattttagttgaaaaactccattatataaatcattattgtgtgttatctgaataagaacacaacaaaggagtaaattaaaaaccctggaatttcttttgcacctcagagcaaaggtcagcgttctcacagcactgttggaagcagagatgatgagctagacaccttttagagcctgactagatggcagcttaactgcctgctatcagaggagcaaaactcaccatacgttcctttcagaagcagatgtcctagatgtaacactgactgagataagagaaaaaaattcacccctgcttccaccagtagtagaatttgtagctagtgtgtctggaccagggtgatacaagcatcacaggagagtggagagctagtgttaaagacaagtccctaaaatgggcagaaggtaaggtttgcatggccaagaattccattgctgagaacctacccggttcttaggtgattatttaaatgcatgactttaagaggaaagatatctggcactgaatagctgttggataggctgacctgcatagaggga

SEQ ID NO: 133262 - DNA, 1053 bp, Homo sapiens
tggtttaaagaaaagaaaaaaaccctcataacttcatggtatgcagatggaagctagcatcttcataggggcctaaaacttttaagttattatttcccaaccatttccctacccttgtcccaagtaactatagcctggggtaatgagagtttgtttaatcagaattgcttagcctccaggtatatctaagaagtcaattcacattttcttgctctattttgatacttttctgaatgctagacagtgtccagattttagcagaagctacaaaagaattactttggtctatagctctaaaagctgcagttttattaagagctacaccaacatggcacatgtatacgtatgtaactaacctgcatgttgtgcacatgtaccctaaaacttgaagtataattaaaaaaattaaaaaaaagataagtttgaaaaaaataatttggcaaaataaagtttaccatctttaaaaaaaaagctgcaacagagggcatttggtacattcacttattctctatgcatgagctcatgactagctttcttagtctctggggtagtaaatttttttaaaaagagttttgtgaaatgaaagaatctctaattattacacacaaataggattttcatcatcatttctaaggatatatagaaacatgagccaagtcttgtaggaactgagaaactaacaaatttgccttattatatctaatgcataatcaaatgctgaatatttagatgtctggttagccctttatttcacatgtggactgagatgaacatcagttgatccttaactttcaagaataaataaataaagttgcatttaaaaagctaaaggctaagatctttggggtttgggtttgggggtcacacaaatcgactcgtgcagaacttggaggcacaattggacaactggaacaatgacagacaaggtaccttgtccatgtagtctgtgacctgcaaacactttctactccagcagtggcagatcttggcagttaagagcacgggttcccatgagttctggatttgaatcctggctgaccacttgtgagctct

SEQ ID NO: 133263 - DNA, 1805 bp, Homo sapiens
actgttgtggggtggggggaggggggagggatagcattgggagatatacctaatgctagatgccgagttagtgggtgcagcgcaccagcatggcacatgtatacatatgtaactaacctgcacaatgtgcacatgtaccctaaaacttaaagtataataaaaaaaaaattaagtcaaaaaaacaaaaaaacgaaacaaaaaaaaaaaaaaagaattccacagcaatggtcctctgagaggaaggctgcgctgcttcacagtctgttggcaatgtttgacaaaaggcataaaacacagagaaaaactaaacagagatgtattctctcaggaagtgtggggatgcgtggggaggtaagtcctgagcaaaggaagcaaaataaccctattgcttgcttgaacccatgtctgatctctcgggaccagcccccttgggggaaactgatgcacagagacatcagcaaaatattttcatggaaagggataatattgcacacagcaatggtgctggtgttggggctgagggggcacgctgatagacaagggggagcttggtgagcatagtgtgaaacaaacaaacaaaaaaatcttttccaaaaagtctgaattatggaaaatataaagggccacaaatgaacagaaagataatgcagtgaaattcattttaattcagatgaagaagttgtatgatcccagcctaatgctgtgaggcttgaatttgtttcttgtgatcccatacacctgattctaggcagggaggtcaggacaacgaacaaaccccttaaacattcacatgcagacatcagacactctgtggggaagccaagagggcaggcccagggtaacagctggcataaagaaccccagaccccacagcccctggctgcaataaagtagccccacatgccttcaagaagaaacacacacaacttttatttggcaccaaagagagctggtgggtacttgctgatttagctctctggctgactccaaattaatgtagtaaagtcttcatgagaatttaatgcctttaaatttccccaatctgaagagcttctttggatatgtacgattctattttttcccccaagtaattttctgtcacaaagattttaagggtctggcccccagggaaactggtgcagctggattttctttaattgcatggtttgagggctgtatcacaccttcattaaaaacaatcctccagagagtctcacatttcctatttctcaattgctctaaatcttctaaaaataaattctttacaacattatggggacctgatgatcttaggatgatgtaagaagacaggttatacagagagcaggggcatggaagagggaacccggaccccacagtaaagtgaggtgactgctgctgagtacccatatggaacagggggaggaggcacaaatgagcctgctgtgggcactgcccttgcagaggctctggctggacccacaccaacctcatcagggaccacttccctgcagaccccgggtgctcttgcctttggcacatgcttgagctcattcgagtttcctcctatttgcatgtgcaattaatgacctccacttagaaagttcaccctcattctttcctacattcaatgttcagctcaaaagcactcatcttgctgaagcttccgcagaccctattcacagtacattccttttctccacagccacgtgccatgctgtgtaatcatctgttcacgttatgccccttctcccccaagagctctcaggagatagggaccttgtcttgttcatgttcatcctccaactgcctcgccttgggtcttg

SEQ ID NO: 133264 - DNA, 1833 bp, Homo sapiens
gcacaacccctttccaagcaccttttctgagtggtcgagcagcctttgctctgtccttaccatcttggacttccaagccccaggcaaacctgattccactgcctcctgtctggggtaatgcacactccccctctctattcttgctgtactaactcctaccgtcaagggaaatgcagagaccaacttataacctgacaggatgagaaaaagaaaataaaaagcaaaacagcaaatgtgattttgaagcctaggatccacctacctctccttcgtgacactcaaatcggtacatccagaagttctccatctttccgggtgctgtttgggcagctgggccagctctagtgcctccacttgagagccgaggctaagtcctgacctcagtactcgtgtgagttgtttccagtgttgttagatacccgagtcaatcatgcaactggtaacaggagatgtgaccacctcccagggtgtccgaccctcacattaacccctcgctgcctgaatggtccaggcagtcatgcgtcactgctgggcatcagcagctgatgtttctgagaaggggctggcctaccccttctggcagcagcacctactatttctggagaaaataaactcggctctgaattgctaccagaaactttcacacaccccaaactctgctacgtttatagaacctgtgaaaaagcatccagctcatgtggaaggaacgggtgggagttgggggaaaagaggctctctcaggacctgcatcaggatgcacctgggcatgtggtgcgagcctggaggacactgaggccagctaggggccgcacctctaggcacgggaagtctcttcacctttaccgagggcctgagacagcctcatgctgcagtctgaataaggggtatggcaagccagcgacaccaacacagaaaagggctgcctccagggccaatacggtttgaaccaaaccaacagataatcctacattgggctcaagagctggactatatatgctggttcagaccagaccagagaaaggtcaagacaaacatggcagaactaagctggatggaggagctcttggaaacagaggcagcagtgtggttctgaaggcaggaggcagacagagagacctctgcagagagacgcccccagagctaatcagcctctcagtgatctgtggcgatggggaaggatgtggatgcatgaaaagcgctcatctgaatagatgactttagccttctctctcatcaaaccctttatcagacatgctgacaggtctctctgtgagcctacctgattggctaatgtgctatgataggaccaaaaggtagaaaaaaagagacacaaagggcctgtgaacaatccacagctggcaaatcctcccatgctagttgacagtttgctgtgctgtggacaagctctgcaggccaaagtgggaaacggggccagagagagggtgtcctcaggcactgccctctctctcctcattgttctggcatttctgaccactcttgttggcagtccgattgcacctactctaatccgaatcagtgggatgcaagtcccatagctgctagccaccattctagaaagccctttctaaatggtgagcactgcaggaggtatctcttcctactttacagcactgggcatctctcaaaacactttcttccgtctattaattatttaaagagagaaaatcttggggtgttgattctcaagagtccagactgaatattcctcaccatttaactctccctagcccatggtgcagccatttcccccattatcactcttgaaaattgcactggtttccatttatgaactgctcagaacaggctgggtga

SEQ ID NO: 133265 - DNA, 1063 bp, Homo sapiens
agcctgccctagtcccagctttttctgacatagccccctgcaccatctctgtgctagctctcacacaccttcccttttacgccactttggtttcatcgtccatcggtcacttcgggatctgcaaatctgcctcatctcagccagacaacaaaacaaatgcagcccaggagttcggaatggttgacaaggtcagtgggagaggacaaggccagcagctgctctgccctaaatttgaagcccagtagctctttgctggcatggaacgatgacagataccaaatgtggaaggcagagttctcagatggctcccaatcatctccacctcctggtattcagcctcttgggtaatctcctccctggggagggagcacggctgagtgacttactctaagcaataaaatacagcaaaggtgataggatatcaccctgtgactgggttacaaaaaaccatgacttccatcttgctaccagactccatgaccttcttatcctgcatactttatgaagcaagatgccaagtgtcagacagcccatgtagcagagaactgaggacacctctggccaacagtcaactgggaactgaggccctcagcatcaatgcccatgggaagctgagtcctgccccacaagcatgtgagcttgagatgactgcaggccacctgaccccctgatggcagcctccaagagaccctaatggagagaaactgtgagatagtcaaggaaggttgttttatgccactaaattttggggaaatttgttacacagcaatagataattaagacactaaataaggattcagatgaaaggcttaagagcagaggaggcttgaaggtctcgcttggggcttgacaaaggactagcttagattgtacactctgcaccagcagagcctgtctgtgtcagtcagagcctctatctgtcattgctgtatccctggggtcttgcacagtgcgtgatctatagaaggatctaacaacgtttattgaatgagtggatgataaattgtaagatgcactttcaacttttgacctagaacagtagtcacaaactctctgtagttca

SEQ ID NO: 133266 - DNA, 1028 bp, Homo sapiens
gcctctaccccatgcttgtaatcatgcggatctcgcctctatccaggtcacattccgattagataaagtccgggcttcgctctttaaacatagatttcaaggccccagacttcttgattagagcctctggaggttgggtcttggcacgggtgttaataagattcagtcaaaattggtaagtgctagcttaagctgtggaccagagtttaacactcaactctttaggatctcattttccgcttttcttgcgtgagttaacctgttgcctctgtaattcactgtcggtgtctcatcgttctcctgtatctctctcagagcaagtcacacagatgcgctgctcagagtgtccatcgtatgtaaatatttggctcacagtcgatctgctgcagttaccttgagtttgtcacctgctttcctcccagccttcagtttcctcatcagtaaaatgagttaatcaggtttatgtcccagggaagctgtgagagaaaatggttttgcagatatcgagtcctatatggaaatgtgaaacaagaatcacaagtttgttgtgccagttacatttggaagtcaaagctcacttaacatttggggttggttactggcgatctgaattagggggctggcctttagtagcccttcctcaccctctctaggctagtgtttcctttctgctgtcctcagcattcagatcccccactgggctgcccatcctggtcaggcactcaggcgaccctagttctcagcttccaccttaagcagcattataccgtcagcctttccttccagggttggtctgattaaatcaaactaaactgctaattagtgataatggcaacatgcaccgcccctccagataacatttaccttttattggcattctactcctgatttcagagaccactggagaaagtattttgaagcaggaaaccatttcagcactaatgcttcttaatcagaaaccagccactctcctgctgagatggaggtattgtcaaaatcctgagaagtaagggcttggtgtgaactct

SEQ ID NO: 133267 - DNA, 1049 bp, Homo sapiens
cctgccgcctcgtcggtcacctccacctccgcagacccctccaagtggttcatggtgggagtcggaacggctaggagagaagctgggcccggctcactgcgctctcattttgctccactgggctggaaaaacaagaaggggagaggctgtcacgtggtgcaaacagtcgttatgagctgagtattcagataaccataaaaacaactgctattgattccttttagttctgggtcaattaaaaaaagactgcaaatttaagttcaatctgacagcacatacatagcacgcatcataatttgtaattacatatctacttgtttaattgcttattgcctttctccgttcccacccctcacactgagcgcctcaggaacgttttgttctccaccacgcatacgattcaggtcccatttctgatgcatctgaataaagagtactactaaattgaatgggccaactgacacattttccatctgctaacagataaatctctccaaattaaactaggatcctacaactttagaaatcactctttacatcaatttcaaagaaacataatcttgaacaccttttgaagccattctgagagaggctatcagccagcagtggggtcccgccccggttctgtcattactgactttgtgacctcaggcaagtggcttaattttctggacctccacggtgtgactggactcatttcctacatgcaggatgttaacagctattatatagggtaaaaaagactcggtggtcaagtaagtttggaaaatgctgagttacagttgacttttcattgttaatatccagaaggaggaagatgcaggacacagggtttccctaacttgtttgaccaggagacactttttcctagaggccaatgttacatagcagctggtttctaatagttaggcttccctattgcgcactcagcatccaggatacaaccaaccacggaagacaatattaggggaaaatatccaacacaatacaacaataaaaaataatgcaagtaaaaatacagtataacaacaatttatatagcatttata

SEQ ID NO: 133268 - DNA, 1035 bp, Homo sapiens
actccttcaacttcttctaatgctttaagtgcctaaagaatgcaaatgattcaacattctcctgcatctgagtgtgttaatccaatgggcatttatcagacatgtaccagtcactgtgcaaggcaaaggggatgtaaaagtttctaaactatggtttagggcagacagctctgacagttatgatacctggtgataagtgcaaaatagaaatatactcaagatacaaaagcagcccagagttaaaacaatgacaacaattgtaacaccttgtgactcatattaagtgctgctgttcttatgggttctggatttcatgagctagtgagcatcctaagcaagcttaggaaagaagtgacatcatctaataaatgtccttgatgatgacccatgtgcctctggaggaagacagaggcaaatagaggaagagcggctgatggaagaaaatctctcttcctctacaaaaaagttggatgacctggaagacacatgcagaatagtcccctcctcagggacacctgcaaaacatgaagaaggggtgctgtggcatcctggctacaggatgagggtctccacgttaccagtggtgaagcacagatggctttctggtctatggttctagaatgttccacagcttgggtggaaaaggtgaacaaaaagagggaattccacttcagtgcaccatttagaaatagaatagttcatgattcagcagttgaatccaggtatctcataatgtgtagcagaggctcgtgttgatttgggattgatagaaggggaggctgtaaattactttagttgctctttccttaagcaatcattgatgagcatttccaataaactgtcccttttagcatattcagaagtagtgttagaagaagggtcagacataaggcaaatgcaatgtaaaaaagagcaaaaggcatcataccatcttaacacagagagaagtttgtgtacgtcagtgatagagaacaaagaagagcattacataatgataaagggttcaattcaacaagaaagcttagctatcatgta

SEQ ID NO: 133269 - DNA, 1064 bp, Homo sapiens
attttacttaactactgggcagcatttgatacagcctatcacacacttgttctcaaagcactcttctctccaggcttccaggccaccactttctcctgttgcttccccatctcattggctggtttctctttatccgtcagacctctcaacactggaggacccaggctcagtctttggactcaactgttaagtatctacactgtcctcccaggtgatcacatgaaggctcatggtttatctaccgtctatacaatggcaattctgaaatttacaatgacagctcaaactgttcccctgagctcctttagacataactgtgcctccttaatacttcaccatggatgtcaaattatcatgtgttaaaacagacttctgatttctcattctaaacctgttctttccactgtctgcctcatcattcttcttccagttgctcagacaaaaccttggcattatcttttaatcctttttttcataccctatatcaagtctgtcagcaactcttgttatttctactttcaaaatggatcaagaaccaactaaacactttttattccttccattgcaaccaccagcatcttttcttacctggaccatgtcaacagcttcctaatttgtcttgagatttccaaaatctcgccaaagtgtaagttagatcacgtatctccttgaatgatttctcatctcactctccctcgcacctctcacctcagcgtctacgctcctcctgtccttattttcacagtcgcattagcctccttgctactccatgaaatgacaatacctgctttgcactctcctttccctctgcctctactgatcttctctcagataattcactgggcttattcctgtctcttctgcatgtgtctgcttatatgtcaccttattagccgggggcagtggctgacacctgtaatcccagcactttaggaggctaagggtggcggatctactgaggtcaggagttcaagaccagcctggccaatgtggtgaaaccctgtctctactaaaaatacaaaaatatagccaggcatggtggtgtgtgcctgtaatcccagcta

SEQ ID NO: 133270 - DNA, 1038 bp, Homo sapiens
agcttctaagatttacacacattctttcttccaaaaattcaaagcgaaattgcattatcctgttctgcctaaaataaaggtatcattgactggggctcagaagttttggttgtaacctgccattttggatgacggttttgcctttgtcagaaatttattattttggttttaaatctgaggtcttcagccagtgattgggctcagatggtggtttgtggcataaggcatgtgaatgcaagatgagaagacaccttttgattcttctggagctaactgtcccgtttgcccctggttccagccatgcatcacttgtctttttctctttagctatttagtttcatccttactaccctcccagaggaccaggagaaggaaagaaaggggaaaattccacatgttgatttgctgccaaaagtcttttgataagaaagatgattgactctgttttgcatattttcatggtcatgtgtgtgtatgtatttttttgtttgccagattaagcatattctttttcttgcatgtatttctatatttctaaatatgtaatgtttttcattttgtgaaatgtaggcagtcactagaataaaaactccactggggagactcatagcctattttgtttcccaatctctcccccagggcctaaagtggtgcctggtgccaagtaggtgctcaaaaataacaagaatgaagaatgctatagagacagaaagtagattagtttttgctggggtggaagatagaagaatgagagtgactgctaataggtctgtgatttcttttttcttcttcttcttctttttttttaatgagacagagtctctctccgtcacccaggctggaatgcagtggcgcgatcttggcaaactgcacgctccacctcccaggttcatgccattctcctgcctcagcctcccaagtagctgggactataggcggctgccaccatgcccagctaattgtttgtatttttagtagagacggggtttcaccatgttaggcaggatggtcttgatctcctgacctcatgatccgccc

SEQ ID NO: 133271 - DNA, 1031 bp, Homo sapiens
ttaatcgcagctgctggccctgccatcctcaaagctacctctgtgtcgagtgtgcagctacaaggccacccttctcctgccactgctgaagagagcacgagctcccccctccctttcataatgtaagctcccagtccgcctccgtgcaggctgcctggttggcagagctcacttctccctcagccttttctctagctgcaagggaaactgggcaagcaagtctctagctttttttctctcacttcaggtagacgatcttgcctcgcccaacctggactcacaaagtggtgaacttgccaaacacataactcggttcaggcagtgagtggccaaatgaaagaaaaatgttttgcttgtgtcatgttgttatgagatcttgccttaactgatgttttcaaataactaaacagcttcctgttcaatcatgttagagaaattgacctcaattctgttggcctctgtggcttggacaaagttacagcctttcttacttacctatcccatgagccagtaaggatcaagtaagatgaaaatgctttggaggtaataaaaaacatacaagttatacttattcaacccctcgactaatttctcagtatctcctttcccttccaacatcgatcttaaactgtcatcttgaggattatcgtggatatcctaataaactatccagtgacttctggcttgacaccttggcagcatctgacacctctcccacccccagtcccccactcccatccccacacatacttctactcactttccaaattctatagattcttcccaccatgtttttttctgcagcagtctctgtttccagagccctatctaggccataatcatcttctaccctgaataatcacaggtcactatcattctacccattgctaccagacatcttcttgaagcacatcttttattacctactcctgctgagaaaccatcagtggccccccactactcacagaataaagtctgcttccaaggggtgtcaccattaggaccctggctttccatccagcatgagttca

SEQ ID NO: 133272 - DNA, 1026 bp, Homo sapiens
ctcattgctatatggtattcagttgtataaacatacaacaatttgtttatccattctcctattgatagaaatctaggttattttcagtttttggctattataaacaaaactactatgaacaatgttatatatgtctttctgtctttgtatttcttcagtatatatttaggagtgaaactatttcgtcatagggatgggcatgtgtttagttggagacattttagtcaactgtttttataataagtacctttctgtttggtgtaatctgagcatatattcttcacaattcaaggatagatgtatgtatacatgctctgttttaatgcagtgatttatttttgttaatttccttctgattttgttgtccagctcagttaactgaatgtgattttgttactttatctatcaaagggaaatgaggcatatgcttctgaattcactggatactgaacaggtatactgaattcaggttattcgtgcatatttgaggaaggtttttgtcacactctgttaagaagccaacaaccattcactaacagatattttgtttgttttatctgagttcaacaaggttaagcattcagactattttcattaaaaatagtttcgtgtataacaaaacaagacagtacacgttttaattttaacatcttcattttaaacattgagttccattctaaccaaaacataacacttttagccagaatgctgttaaacatctttaaaacaccaagtaacaataacatggcaaatgtttgtgtattgcttactataagcagcataagacattgctcaaagcacttaacctacattaactcatttaatcctcacaacaacactataaggcatgctgttgttatcctcattttgcagatgaggacactgaagcagagaggttaagtgacttgcccaagatagcacagccagtaggtgacagagccagaatttgaatgcagctagccagagtccagagtgtgtgcacatataaccagtataccacactgcctgtaactctgtctctcatct

SEQ ID NO: 133273 - DNA, 1051 bp, Homo sapiens
atcttgttttttatttcacaaagagattcttagagtaatcctggctgtcaggattctgagtgctttacctcttcttaatgatatgagcaacagacagaatggtatttctgaatttactcttttagtattggaaaagtctgatgataatacaaatgtctcttgtatcagatttctcatatacctctcacaataactacagcagcatgatcagcgaaaggtctgtgtagggaagctaactaggctgaattgaccctctatcatattttatattctcatattttttaaaattgctagtgacctcactagatatattgttgagaaaaatactgaaaggtagtgactcaatgggacaggtgcaacaccagtcacccccatttgttttattttcaagtaagttgtgtagccataccatctactgacatcccttggagcaaaaataatcacattatctcttgtttataactaaatgaggatacatctagttggtggcattgatatgtcttaatttcagttattccatgtgaataaaaaaaatcatcttgtgtagcatttattatactagaaaatcaccaagaactacaatgtgcaacaatagattgagtaaattagtgttttcctgtagaggtatactatgcactcataaaaatagaacttataattacaaggaaaaagcctcataataagtttagtttttaaaagtaggttacaaagcagtatgtaaataagattctaactttttttttttatttaaatcccatttctaatcatagcaggaccaaccttcttactgagcacaactaaaaatgttggaaaatatattaaaattttattcaaagcagataaactaaaaaacatcataccaaaactgtagaatgccagtagaaaaaagaaatcaaaaagagctaaagacaaaagattaaactgataacttacttcttgacagcaacattgagtcagaagacagtggtaatctagaattataaacagaaaaaaatttttggtgaatgagaataaagtacacatacacaatatgagtccattcatgtaaagt

SEQ ID NO: 133274 - DNA, 4177 bp, Homo sapiens
accaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtggcaaaaagaaaaggcaaaaatatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaatgagtgttaagtgtgattttgtttttacttttggtgctttaaacttgagtctagtctaccaagctttccattttatttgctttgatggtggtaggggggtggaggtgtgaactgttgtctaaatgaaaccaataattttatgacctacatttgtagaaagaataaaaatgccactatgtctagaacataaaagaaatgtcaaaaacaaattagagatatcgccacagttgtttttaaattgtattaacagtgactaattgccttataaaagttattatgactagatacgctttttcccatccatttcaaatgaagctgtagagcacatataattactcggttattttagtgttacatcctatgttttctcaatcctgagtctcacttctgtatgttataagccagatatagtggtcttacttacacaatataatacatagatagactccaaaaagtgt

SEQ ID NO: 133275 - DNA, 1114 bp, Homo sapiens
actgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatgctagaaaatttgaacctgataacaactgaaccttttgtcttgaataaatttctcaaatagaactgtgcaaaccctagcactttatgtgttgctgcctccccatacctaggtatgctctgtaataagctcccatttaatggagagatgtgtggaggcactgagaagttaatgaagaaaaatcaaccctaagaattccttattgtcacatagtgtcttttaaaaaataactgtagag

SEQ ID NO: 133276 - DNA, 4233 bp, Homo sapiens
attagagcaaagcataatataaactaggtatgcctgtattacataggccggttttctactgctgactcattgtcattaggcagcttatctagcctttaagttttaccccctgtaaaagtggaacattatgtgctccctgtctgcttcagaatatgcaaggaaaatgaatagaattctcttaagggcttagagttgctaatgtgaatgatgagatgtaacaacctagaagttatacagttcattgtacatggatgtgcccccactgaattgaaatttttggagattagacgcgggaatcttcatttttaacaaacaattgtaggtggttgtaagggcaggagaattgctctcctcggagggagaacaggaactgtatcttttacatgttttgctcagagcccagcacatccccaatgcatgtggatgtttaaaactgtagttggtgatggatttagggtaaagttcagttgacttttagggaataagacccactacaacagatatgttatttttattaaagtacttgatagaggccacagattaagcctctaaaggaactgttcattccccttatttctgaatcacttgtcttctaggatatcaatgagatttgtcttggttttgttttatatttataacttatagcagaaataagactgtcacatatttctagttttatattacggttaccatagagtaccatctccaagtcattgtcatctcagtaaatgcttatgaaaaaccttaggactgtattctttctcacaaacaaacctgtaagctggagttataaggctttctttgtccaaatatcctggaacatcatctctactgtttttcctccttcctctgtataacttggttatgaaatgggcagtgaattgaatactgtatgttttgaaattgcaaacttttttttctggaaaagcttgactttgtaatgtgattttctttattctcttccttcccctctctatcgcaggcggcatattttctaccttcagcatcacttaaatggtaggtttcctcacagcatgacccagttgtcacctgcagacagccctggggggactttgagtgacttgcaccttatcccagcaggctcccagctgtctcaagcaatggaagtagatggactgaatgactctagcaagcaaggctattcccaggaaaccaaacgcctgaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttccttcctgctgaacagcgagtcttaaattttctgtttaacttctcaccctttgtatttctatatgtggggcttctcatttggttttcctgattggttcacacacacacacctctacccccctcagtccaattgctgcataggcaaattcttttaaaaattaaaaatttaaggcctaggcaggaggattgcctgagcccaggactttgagaccaacctgggccacatagcaagacccgatttctacaaaaagtaaaacaaaatagctaggcatggtgctatgcaactgtgttcctagctatgcaggaagctgaggcagaaggattgcttgagccccaggtgtttgtggctgtagtgagccatgattgcaccactgtactcagcctgggcaatagagttgagaccctgtctctaaaacaaattgaaaataaacatttatgttgcagttcaactgaagaatgttggtatgaatgccgaataacttgatgtaattgttttgagaatcaaatggctagatgggcgaatgtttaaaaatgtaaactagttctctttctctagcatgttctacccaattaccaaagtcagaagtattggaatttatatgaaaaaaatgcttccaatgtaatccattttttaaatggttatttaagaaaaaactaacttaagagtttatgtaattgcagtaaaggaaaattatttttattgctagttttgatagattatttttacctcaaatttggtatatgccaaaacacatcagtccttataaaattgatttttttttcctgaaaacctggaatgccatttttagctattactactttttaatttcaaattcacttatgacaaatgggagaaatatataaagaaatagatccataaaaatattcctttttaaaaatctaaattattgaggatacactatggaaactataaaattatcatgaagtgactgttaaagtttactggcaaatgccaagggaaggaatagtatgtgcaaaacaaaacactttgatactgaacttaatcagggatgaggtaccaaagtatccacattatagccgtatcttatgtttccaataacaagggctgagtttttcaggtaggtgggatgagggtggggaatgggccatgtaatgtctgctttcttatatttgcccttttgtaagtggtctgtttcttcttttcatatactttgttttgccaatccattacgtattttttgtcacttttgtgtgtcatttttgtatacctttcctttcttacttcaggggtgtgtcttcaagatttctaccccctatttgcaatgaatttcatacctcatctaaaatacattcatataccagaaatatgaagagtggcccttctaaaagtttccctaatgatggaagctgtcagttgtcctatctgtgcagaatgtgagtaatagtggcagaaataagtgtgacaacaatgctttgcctgttgttctttttacttgctaggtaatttgtaaagtggggataaagatgtagggaaagtaaacctctctctcactgttacggaaagcctggacttgagttaggtagactgccttaaagaagaagaaatatgtccttttctttggcatcatggttttgttgagtggcagactgttgaagtgagttgagacttaagaacgccagaaaagttgtctagcctggccccagtagacagaatttgttcttctctcaagtaaaaaattacctttttatagcttttatattatttagatgaaaaaataccattatgaacataattccatggccctttgtgtacaaagcatattttgaattaaatacctcaaggtccacctagacctctatggataaaatcataagtttatgatttttagctcctgtgagtgtttgggggcaaactacacagagaagacatgggtggttcagcccattccactaaaatatgttgccagattctggcctaactcagtattaccttttttcctaaaaatcatttttcacattttgagtaatagggcttatgctttgatgtgaaaaaatgtcaggaaatgagtgtagacaataccctataaaacactagctaagttttatagtgctccatgcctttgtgtaccttccactgattatcttgcctatctttggtgtgtaaactattttcatatcttctaaggctcttaacccactcttttctgaagccgcacagtcctttaatatgtcttgtttccttcctaaaagtttaaagtagagagcaaaaatgcaaatacccaaaggatactgttagtatgtaacttttgtgtgctgctttatttctagagtttgcattttttaattgttcattcacagaaaatcctaatattgccctatatggttggtttttttcctaagtggttaatatttaaacccgctagctgtagcatgataatgtctttgactgagcttatgtagtagaaaggatgtgtctgttttctgggacttttagtcttcacttatttttctataacaatctaattgttaaaaggaaaagatggcttattgacacatatttcattaaactttcactggaagaacagtgggtcatcctactgtggattaagaatactactgacaagcaaaaagcattaagctctgtaactgtctccaacaccaccttcaccccgcctttagtgtaccttagtgtactttagtgtacctattttggcagtacggtgt

SEQ ID NO: 133277 - DNA, 1232 bp, Homo sapiens
gattaaaagtagtatagggtggaattatgacactaattttctattttatgttctctctgatgtctgcatgcttaaataaacatttaagtaaattttaaaatatttttatatttgagggtagtgtggcaggaaagattcacagtcaggcagtttattactactggcaaattacaagtttcacataaaaaaagcacatatagtcatttctccaaaaaacctacccacaccaccaataaggacatgaaaagatattcaccatctttactattagggaaatgcaaagcaaaaccacagggagtgagataccacttcacaccaaaatacggacaataacaaatgttggttaggatgtggagaaactgaaactcttatttatggctggtaagaatgtaaaatggtacagccactgtggaaagcagtttggcatttcctcaaataattaaacatagaatcactatatattaataaaactatagttaatatatatcatattcttggagaaaaacatgcattaccatatatgaccctgtaattctgctcctaggtatatacccaagagaagtgaaaacacattccataccaaatcttgtatgagaacattaatagccatattatttataatagccaaaaaataatacctcacctgaggaatggaaaacaaaatgtggcgtatccatgcaatagaacattggccataaaaaaggaaggaaatactgatacatgctataacgtggatgaaccttgaaaacatgctgattgaaagcagtcagattcaaggccacatattgtatgatttcatttatataacatgttcagaataggcaaagcaggttagtgggtgccagaggctggggaggagggaatgggatgtaacttctaataggaatggggttttgtgggggtggtgaaaacattagaaattagataagagcaatggttgcacaattctgtgaatatattaaaaaccactgatttattttttcacttcaaaaatgattctaaagtacattagagagaataaagcttaaagaatagctgaggaattgttgggaaaaacaataaagaacactctaccattagatacttacatgtttattaataagacagagtaattaaaattgtgatgctatttcaaaaatagactcagtaatggaacagaatataaagtccagaaacaaattccaatacataatatgtacatatttcattaatgatgaatatggcatttcaca

SEQ ID NO: 133278 - DNA, 1048 bp, Homo sapiens
aagttgtttggtgggttgtcagggatatggagtgcttggtggtcatctcagatccatgacttgatagtgtgtgggaagaggaaagagatatggggaggattggggataaaaaggaaggcggagtccaggttgactgagagatctttggaaatttttctgccatgatgtggacctttacaagtggcatttccataaaatcaggaacaaggggccaaagtgaaatttttggttacttgagaccatctggtggtaaagataactcattaatggtgagttataactcattaatggtgagctcagctgccagggtccactcctgggttcagatgtcatcatccttccttgacccgcccttggaggaagacttaccattcttccattcaccacttgccactgcaacatctcttgctcttgttgtcagtgaggagtcctaaatttgcaaaatcccctttctgttgttataagccattgggcccacctagaacatttactactatgctttgtctgttacaggaggtaatcacaaaaataccagtagtctaaatcagcttaaaaatatatatgaaatgagccagcattttttaacttaggaaattgaaaatgactttttaaagtgctggcatcgagtattagtaagagtatgaaaatgagcattattcaaattgttataagcttactgaagggcaacatggcagcacttatcacacttttaaaaatagggtgttatttttaagagttctgcttccaggaattcatcataaagaaataatggaagatgaagtatggtagaatgattagaagcttcactcagtggtcatgcagacctgctttgcattctggctttaccaccaatttgctgtgtagccttgaggaagttgcttagcctcttcaaccttcagttttctcatccggaaaaggagggtgacaataattcccatctcactgagtgatgcaaattgaaagggaggattcatataaagtggctatcaaagtgccttaattaagtgctcaataaacactggctattaaatatagaagtttgatatat

SEQ ID NO: 133279 - DNA, 1145 bp, Homo sapiens
tctgaatggaaattaaattaggaacaatgaaaactggttatttttctctctggtttatgttctttctgtgttctctttcccacatgctgccttaacaggcgatgggtgctacaacagctaattcaggaaacctccttgccttcctttgtgaccaaaggaaacttgggaacaattcccacagaaagggcacagcgactcatacaagaagagatggaggtctgtggtgaagcagcagggagatacccaagcaactataatgcttggtcccatcgcatctgggttttacagcacttggccaagctagatgtcaaggtaggaatattactgtctcctgggcagactgcctgtctgcccttaaaatcttctggtagtagttcattctcagaagagctttgaaggagtagagaaactgatggtctggcaacttgagagaatcgcaacagctgctacctctggaggaaccctgtaattaaataaaaagcttgcattccccactagtgctgtttttggcagtcttaaggctagtgcattggtaaagcaaggcaggtttaaccaactgaggaagattgagcataactcactttatcctgaaacaggaagggattattaagccttatagaactggaattgctatttcttggtagtgtttggttatgtgacaatatactaagtcagctggctgtcttttcacactctcgtcctctgaaaagggggagaggagggcagggatagacaatctcacccaggtgtttttaaaattggctgagcctataaattacctggggattcctaagttccactccaagcctactaaagcagaatgagggtggatctagagatcagtattttccactgactcagggttatttgaatgcagagccagtttggaaactctcacagcctaatcctttcagtttagaaatgaggagatggagatttccagagaattttaatggcttagacttagctacagttgtaccacttattattcatcagaatgagagccacatgtcccttttgctccttatatactacggtgtctcagttttttcttttctgatggcgtcacagtgccataagaatctagggtgctcatctaaaaagcttctcaggcttgagacagttaaaagaggtcaagttgaaga

SEQ ID NO: 133280 - DNA, 1004 bp, Homo sapiens
agagagttacacttaccaggagagggtcttgagagtaatcttcatatccttgacagcttagaagagggaatttatcattaaagttagtatgacatgagagatatattagtataatgtgatagagagaaagagaaccttaaaagaatgagaagccaagctttaaaaggtaggactatttgtttttaatatgacttctctttattttagaattgatagatgtcacatgtaccctgctgcttctaaacccagactttaccactgcatggaacgtgaggtatgtcattttcattagtgatatgataaagtttgtccaaatttctgaagacatgtaagccccataagttgttagcttttgaaaacgaaatataaaccattttacacttatttcttctccctattctttatacctgtgacaattctaaataggcattttgcccctttttgtgtggtgtcttcataaactttcttgcctgaaatataaattgtcatgttgagttacagtatactgtttgatacatgcttttattttccttcattttttggggtgggagactaatgggcaatgggcataactggttggcttataaggcatataacattatatcattggtatttgagaagcactgcagtgtagtggaaagtgtatgggatgagaaagagggagtcatgcttgcctctggctttttccctgagcaactgaaaggatggaattgccatttactgaaatggcagtgtctggaagagaaacagatttaggtaggcggtgtttgttataggccaagagttcagattgggacatgttagatttgtgtccaagtagttgtatattaatttaaagttcaggaaaaaggtctgggccagatgtaaacttgggaattactaacatatagatggttttaaagccatgaaactgttttaagatccccaaaagtgttggcatagctagagacaagaaccagttcaaagactgagccctgagacattctattttctagggttgcaca

SEQ ID NO: 133281 - DNA, 1061 bp, Homo sapiens
catatgtatctcttccattttacttgaagtactgtgggaagataccgcaagagtctactttttgtaacactttgcttttatgtaacaagtgaaaagaaagctattgagagagagagagagatctacattatacaaaggtgtagggaagaagcaacaatgtacctcctttcccatacctcttcctcctcaaagaaaagaaacatggcatccagttctgcattactttcattttagctagttgtttttggagtttattttttttttttttagtttattattttttattattatttaatttatttttattttattctttagactggagctcatgatttttttttttaagtattctaaccggttcagcttttctgcctaaaaaagttgccaaacgtgtatcttaccaaagtgttcttttcctctaaggtgatgattgtaaaacagttaagaagccgttggatgttttgctcccttgtggcacacaattggagacgtgcaactgtgccacattaaaaacaaaacactgctggcctcaaaacacacctgccacctctgacagcatccacttccctcccccttatgactgctgcctttttcaaaatgagagtgtttggaatgatttcctggcagtatccatagtggttgctgagccttctaaagaatgctttgatgccttgctgtatatcagtctttcgatttctttttgagaatgggagccttagtgcaagtaagagacgacctcaaaaaaaaaaaaagttggacaaatgaagagtgtattttctcatcactggtatttttctagaagaaattacagcagagattagaaatctaatacaaaatgtcgtaatcatcttatgttctcttctttgaggtagactaaaagagcatcattatatttgaagaaaccaagattgaatgttcattggcttggcagtttttaacacagtgcagtttggaacatgtcccagttcttgtggatcacatttatggaaactcttaaaggactttaatgcccctccctaatcctttttctactgtaaaacctcattaatatatcctcaatg

SEQ ID NO: 133282 - DNA, 1026 bp, Homo sapiens
caactgaggatgcagggcctcttaacagttagtcccgggcgtttttcagagcttgtctgctttattttcccagcctgagagatgaagaggtccagaggcattgcggcggagcgagtccctatttgaccgtgttggtgacctcctttctaactgtgccaatttttgtctctgaacttgaaagcagcctttttaaaaaacattaattaaaattcttaaatttattaaaggaagagaaaggaaagtgaaggaaaagttatttgccatctgtatgtaggaagtagaagtgaaatcgtttttagatttttcgacttcattttgtactgcatttggtagcctttgcgtcaattttggaatttaaaaaaaaggatcaaggctctgacagggtttgttcataatagcaaaaataaatttttgtaggaaaaacgagctttctagtttatttaggattttgaaatgccataactaaaatttttgtgtatcaggttttcttttgcacctctggtagaaaaatctggctgcccttggttcagttttattcttccacccttgaaatctggccaggtgcggtggctcacgcctgtaatcccagcactttggggggccaaggcgggcggatcacaaggtcaggagatcgagaccatcctggctaacacggtgaaaccccgtctctactaaaaatacaaaaaaaaaaaaaaaaaaaaaaaagccgggcgtggtggcgggcgcctgtaatcccagctactccccactgcactccagcctgggcgacagagcgagactccgtctttaaaaaaaggccgggcgcggtggctcacgcctgtaatcccagcaccttgggaggccgaggcgggtggatcatgaggtcaggagatcgagaccatcctggctaacaaggtgaaaccccgtctctactaaaaatacaaaaaattagctgggcgcggtggcgggcgcctgtagtcccagctactcgggaggctgaggcaggagaatggcgtgaacccgggaagcggagcttgcagtgagccg

SEQ ID NO: 133283 - DNA, 1223 bp, Homo sapiens
ttgcattactattcatatatagttttacttcagtgacatgatagtgattgtttaacaccaactggctttgagaaggatgtactgacttgtatacatgtccaatttctgtagtttaaatagtcccatcatggcccagttccagctaccaatgtgaaatcacctggagctcggacagaatgcatacaatggactattggaagcccgtacaagttggctgcagcacaccactgccttatctacatgccgattaatcctgtttctgcctgaagccaataaatttaaaaatagcaataaaataaaattagaaaaggaaattggaaaggcaatttaaaaatattacagaatatggctcttcgccatcttttctcttcccgtggagccgtcgccacgaaggtcgagctgtgcagttttagtgggtacaagatctacccgggacaggggaggcactacgccaggaccgacgggaaggttttcgagtttcttaatgcgaaatgcgagtcggcattcctttccaagaggaatccttggcagataaactggactgtcctccacagaaggaagcacaaaaagggagagtcggaagaaattcaaaagaaaagaacccacccagcagtcaaattccagagggccattactggtgcatctcttgctgatataatggccaagaggaatcagaaaccttaagttagaaaggctcaacgagaacaagctatcagggctgctaaggaagcaaaaaaggctaagcaagcatctaaaaagactgcaatggctactgctaaggcacctacaaaggcagcacctaagcaaaagattgtgaagcctgtgaaagtttcagctccccaagttggtggaaaacgctaaactggcagattagatttttaaataaagattggattatatttaaaaaaattacagagtatgttttcaaaactaaaaaaaagtgtcacaaaaagttttaggaattaagtaggacaggaaacaaataatggaatatgcataacatgtgagcatatgtcattatgttatttaattctcacaattctgtagcataggtattaacccttatcttaaaatgatgaatgtaagtttagagattattcattagaccagaatcacataaacaacaaatattatagtcaagacttgaacccagatctacctgactacaaaacccaccctctctttctctccaaaccaacgtctggaagctttaggatattgtc

SEQ ID NO: 133284 - DNA, 1050 bp, Homo sapiens
catgactgaggctcgggaagcaataaagtggctttcaaaatactaaacgcaattgagattttttcctgagttaaaacaaaaaaaaaaaggaactgaatgccgaaatatacggagaagaaactccagttgccacgtccccgaacgtctccacccagtcctgcctgctgtttcgccctcagtctgggcctcgcacagcgcggcggagcgcgggaggggcggggcgggcctgctgacgtcgccggacctgaactgcgcaggcgcggcgcgagatcgcgggagcgagcgcgcggtaacagttcgcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctgtaagttgcccggaggccgcgccgcgggtgtggaggtgtgctggccagcaggccccggggctccggcagcgcgcgggcgtgggcgtgtgggtgtgtacctggcttgtgggtctggccttgaattcgtgccggggttcccttgaggattttcctacgtaggctgtggagattgacgtgtatgatgtaggagatgtgtgccttgggtgatgtggtttttaaatttagtcagccaaggttttccaaaggtgtcatgtagcaggtagtggttgtaggagggagtaggtctctgcccgctgggagtcgcgatccatagcggccctggtctggaattcacagaagtattgtccccgggaacttaagaggaggcaacagttaattcggcgtgatagtgatgctgtggcggattcttagggtaggcatttgccagagaggagtagataagacggtaaaggttgttcgg

SEQ ID NO: 133285 - DNA, 1008 bp, Homo sapiens
tgagccactgcacccgcctaagaagataggaaagtcttgcaagaagtgaagagcattgaagacagaaggaactgtctgaaatagtttggtatatttagaaagcgtcaagtattttagtaaggcaagaatataggatgtgaatgagtatttggacaaagggtaagcaaccattcaggggcctgtatgtttactatgctaagaagttccgacatcatcctgtaggcagccacggtgtgttttcaacagggaatgacgtgtgttctgtgttattctggaagcactgtagaggatgatttagaaagggtgcaagattggaagcaaaaagacaatacgaaggcaagagatgatcagagtgtgaaggaatgagatttgacaggatccagctacagaatagttgtgaggcatgggggaaagggaggaatgcagcatttttcccaagtgtaagagccttagctaattgatcaggtgctattcagaagagggagcagtttgaggagaataataaatgcctcttagatcctgtgacttaaagtttcctttgtggcatctaagagagatgttctataggcagaatgtaggagtctggagcttagaggaaaatatgaacagatgagagttttgggagtcatgcatacaggtgattgatgaagttgcagaactggttatgattgcccaataggaattatgaattgaagaactagaagaccatgtacagagtcttgggagaatgcctacattaagggtgaactgaagaaggactcaaagtcagaaggaactattcagggaggtaagatgaaaacagtgggagacaattatcaaagaagccaaggaaaaagaatgtttcaaaaatatcacctgctacattgaagtcagatagcgggactgaaaagagcccactgcatttagcaattgggaaatctttgaccttttaatgaagcagtggaagcagaaaactttgcaggccggatgcaaagagaagaaagagaaggtagctggaagtgcagaggt

SEQ ID NO: 133286 - DNA, 2491 bp, Homo sapiens
aagttaagcttgaactaatggacatattataaaaagtgcactcaacaactggagagtatgcattcttttcaagcacaagttaacatttctaaaagttaattgtatactgagtcataaagcaagtatcaaaaaatttcaaaaaatggacaccacgtagaccatatcctatttctattaagatagaaataataaaaaaaaaattaaaagttaatggatggttacaaaatggaagcaaattccccttaagattataaattatttaaaatgtgtgtgtgtgtgtttagtgctatatggaagacatttatcaggtagaagatacttttctctgttaataactagccttgtgaccttgagcaattatctggacttcagtttttcttcatttcaaagatgagagagttggaacagatagcatccaaggaccaactcagatttttatgaatattgatatatagttttttaattgtcagatcatttaatccctatctctttgtaatcgtctgttggattgtactccaggggctgtacagtaggactgaattggctataacaatttttactaactttctcatgttgatttttgtcatgaaaacacatctcatccttgagtgataggatttttaagggaggctgtggagtgcagtgtttcctagatgacagattgcagccctttgggtacacagatgtatttatgggatgcccaagttctcagcaagaatatttaatgtatttttgtttaaatgctaatataaaaatttaacaaaaacatactctacaccatctgtatggatactttataataagaactgcctcctgatttttgtttcctcctcattggtaccaagtcttttaattcttgcaagctaatgagcagatgtcattcctacatggatgtccttggttttcctgtgaggaaacagagaggttaagtaactgtccaatgtttaacaacttgtatgtggtggagttgagatttgaacctagatagtagatgttaaaacctgtacttttaagcattaggctgtacttggtggttacaagataaggcttttttttttttttttctcccatctttctgggactcagctttattgtctataaaatgaatgtatacttcaaggttgcttatgagtattaaatgagaaaaatacatgtttagtgcttagcacaacagtatatagtaaatgcttgataaatgttagctgttgtcatcactgtcattatcactattaaaaagattactatttgtgaggtatattttctaccttttttaatatttatcacttatttatagcctgatttaagatccagtctgatttttttaggctcagactttgttttcggacttagactcataagcatatagaaactagcacagatatgtctgctttatcatgtaaatttcaattatattgctccttttagaacgatgcttggtggcaattatatcattaacaggataggtaatattagcgtggttgttaatatttaacctgcgcgactgtaggaagtcttcaatggtaataagaagctttgagtgcttagtggttatactataggacctgttttcccacaggcattttctcttctgtctgggtgtttaatatagtggacaagtacacaggctctggagccaagatttcctgggttcagatcgtttttctggcacttactggctttgtcacgaggttggtaagaggctatggagtgcataggagttcgataaatcttacctaatattattattgttgttatttgtgggagggaacaatggaggaacccagatctgggagagataccttagaaagtgacaggagcgaacatacaagtggtacctgaaaaaaatcttgatttgacaaataataatgactgctaaatctctgattgttaacctgggaatgtcactacacagctcactttttcttttttatgtcttaggttgggttttttgtgaagagaggatgttctagaggcatggttgaaattgaattgtaagtgttaaaagtgctaaaactcctttttcctataaaattcttagtttatattcatgttttcctgatgattagaaaagagtattaatatagtattatggcataaatattggaaataatatttaaagaatacttaatccagataagtaaggggtttaaaaaatatattttaaaaacttaaattgtaggctagccatggtggctcatgcctgtaatctgagcactttggggaggccgaggtgggcagatcacctgagatcaggagttggagaccagcctgaccaacatgaggaagccccgtctctactaaaaatagaaaaattatccaggcatggtggcacatgcctgtaatcccagctactggggagtctgaggcaggagaattgctggaacctgggaggcaaaggttgcagtgagccgagatggcgccactgcactccagcctgggagacagagctagactctgcccatgccccctgccccccccaaaaaaaaaactt

SEQ ID NO: 133287 - DNA, 1149 bp, Homo sapiens
gtggagtacatggtgaggaatccatgggctacctgtatgggtagttttgatttctggaaatgccacgagtcagttttcattcatatgttttctgagcagggggagtttcaaggtttaactgctctaccctttaatatactaacacattttgaattgcagtcaatgcatgtgattgaagaatagcatagtaattaaaggataaacaactccagctatgtgactcctctagtagtgtttatgaattagtgttcacatttgctttaattttaacagtttaaataattttgaatgttgagtaagtaactgatgtggtcaattatggcattatgactaataaaatgccaaagtttccttcttgaggggccaaaatatcaaaaggagtaaaaatcataataataattctatctggcaccttttgtgcaagagaattttgggaattttatttctaaactaatgtatatattttgaatataaagattcttaaattattttttaattaggttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggtatgagagaaataaatgtaaagatgggaaaattttgtatatagtgtttcctttttatgccgttgaagggatatcataatgactgctatttaaattgaacatagcactcttacagttctttgtaaaggtagcatttcatcacttagagtataatgttattaatttgtagtaatttggaaaatttcaattagtaaaaaagtctaaattagagtattttgaaataaagtattatttttgaagttcagagagtggctcagatagctatgtgcttctatttgtagaaccttaaaatgttgttaatgaacaactttttagtcagtttttgttcgtatacattatacatatatttgagtctacaaaatatttgatataataaaactcctatatttataagtataccttctaaaatcttgttatagtttattaaacataaaaaatgctaataatttatgttaaatgttaaagtcatattacctattaaatttg

SEQ ID NO: 133288 - DNA, 1002 bp, Homo sapiens
attatctccagaagtagatgtttgaaattgcctttttttttcctttttaaaccctctaacatttcaactgatatgtaatagacagtgatcattttcatcttgggactatgtgttcttttattcccaaacttttattatacatatgtagacatttcaaccttgaaatattggcacagaaaatttttaaagatgatcaaaaaggtaacagtttatatcctaagtttatcttcattattctaaagaataatgcacaaaaggtttatatctcaaatgttttttttaatgagtttcaccttgacaagtgtaagcattgagtgaaatacattttgaagatatatgtaaatgaatgatagttgctgatatttaatttttgtgctctaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgaggtactttaaatagacaactcatttgtattgtttcttattgatttctgtatctcagaacatgggagagagagtagtagtattgattcattgagtgaattcgtatttgtgattttttttcacttaggattgtactgctaatatcagttaaagtgacagagtgagaatggatctaataatgtgaagtttaaaaaggttgactatttcagcaaatacgtattactaattgaatttttaaggaaccagtaacagtattataaaaaaaaattatctcaggaagttattctttcattcattcagtatctattaaacacctactatgtgccaggcactgtgtaaggctttgagtaatagaagagataccatgtgccatttaatatagcacttccgttgaaccaattctctcatgtatttttttcagtcacatgagggtagactttggaagagaattacacatttagttggaatgttggttattttcaccattaa

SEQ ID NO: 133289 - DNA, 1039 bp, Homo sapiens
agctttctttcatctcgtttctaagacctttcagtcatgagtgttcatttaacatcctaatcctagtattactatttttcatttgtatatcacttttacagcttttgtttagctttcatttatattaagtgaattgcttctacccttcaagtggatgcagcagatatttgggcaagaagagcctgggctcagatgtgacagggcttctttacagttaggactaataaattgtagaccctagaccagaacttgggtatgaatgttgcttttacacaggttttaggtgttttgttgagacagggtctcactgttgcctaggctggagtctacatagttcttaagaactcctgtgaattctttattgtgaaattttgccatcgtttatttttcattgttaaaagatgtgacctgttgtcattttttctgtcaaactgattgttcaacatatatttattgtagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggtaagtcataatttttagaggcaaagtacgtgtttctttaagtagcagagtaattatgatgaaagtattagttactgtgtattcaagttaggtgcttctttttcatttttggctttatatgttatacataataaaattcatgtcttttttttttttgagacggagtcttgctgtgtctcccatgctggagttcagtggtacgatctcggctcactgcaacctctgcctcctgggttcaagcgattctcctgcctcagcctcccagtagttgggattataggcatgtgccaccacacctggccaactttttttttgtatttttagtagagacagggtttcaccatgttggccaggctggtcttgaactcctgacctcaggtgatctgcccccctcggcctcccaaaatactgattacgggtgtgagccaccgcgccaggc

SEQ ID NO: 133290 - DNA, 1113 bp, Homo sapiens
accatcatcccattcactcttatataatgttgccttagtgtgccacttaatttttttttagcaaatactcctatgacatgacaggcatcactttcacctacatgctggtttttatttttcttttgacccattttcattttgttttttttttttatttttaccctttatacttgagtttcttttgcttctttatacatccctgtatctcttctttattgacagattagaggtaagtcacattttcgtagccattaagatatgtttcagataacaggatggaagtctgagaatctgaactggtgatagaaataaacgctcagtgattatcaggactgttattaaatcattacactggtatttactatttctgaagttgtcccagaggacaaatttacattaataaacctgttttgatatcaaaacaatcttttcttacatttggtttctgcctgtatcttgatttttagtatatgtgttagtttaaggtagggcattaacttctgtttgttgaattatttgcaaggaatatgaaaatgttcgtcaggaatatgaagaagtaaaactagttcgtgaccgagtgaaggaagaggtcagaaaacttaaagaagggcagattcctgtaacatgtcgaattgaagaaatggaaaacgagcgtcacaatttggaggctcgaatcaaagaaaaggtactttttggtttcaattttggattatctgaattttattttagcaaatataaaaaatattttgcaggtgtttgaaaatattttcaagggttttcttgtatctttcatttcttaagttttttaaccaggaattctgccaccataggattttcaaggacatacttattactgtggaagtgttgctactttataggacttccaagatataaagagagaaaagtgaaatatgattttttttaggtacaagaggattcatagtggtattcctggaaacactgagctctttttgtgaatatattatacatctgctttgtaattatacacccttttgaaggagggcaatatagaaaatctgatgtttttggaatagataatagaataatattccctgtattttaaaagtataactagatattttttatgactat

SEQ ID NO: 133291 - DNA, 1068 bp, Homo sapiens
ggtgttaatgatgtgtaatatgtgtctataatatgtcatgtatgtgttttatgtgttaatgaaaaatatcaaggaggtagcatacttggtatgatagaactctgcatttgaaatcagacctgattttttataattagtttccattttttagctatgtataaaggttacttggcctcttttgagccctaccagtcagtaatatttgtcctgattatcctgtagggttgtttttaggatcagatgaaataagacaggaagataaatgtaaagagaaaaaacatgcatgcgtattactgcaactgtttattaatatcattaggaataaccttttatagacttgcaaataactgttggtattttgttgataattatggattttgcttgatgtaaattgttgtgggttaactcgatatttgaatgggcagggccatataatttgcttgcatgagtttttaactagctgtccccccctctccccggtttaattttacaggcaacagatattaaggaggcatctcaaaaatgcaaacagaagcaagatgttatagaaaggaaagataaacatgtaaggtttcatactaaaatttttattacattaaagtttgctctaacttttgttttcaaatacagattatgagacagattcttgttggggaatggccaagatcctctgcattctctatttcttaatccgagggaaagtaagatttggaagtatagtagttgctcagaggacaattgtggaaaatttctcaaaactactagcagctgtgccttatgatatttgtagctgggtggctgtagttttttaataggataatggtggatttggttaccttaacagcaaaaactaaggtctaagggatttattctgttgttgtttaaaacacagaaatagaccttttattttgaaaaatcagtgatgacgcttatgtagaaaatgcgtatgtacctttatgcatgattgaaattaatgagacaaagtatacttaaactatggaacttttcgtctttttttttttttttttttttgagacagggtctctgttacccaggttggagtacagt

SEQ ID NO: 133292 - DNA, 1028 bp, Homo sapiens
catgtcagctacaaatggggacagctttatttctttctttctgatttgtatgcacttagttttcttacgttattgcattggctacaacttcagcactctgttgaataagagtggtgaacactgaaatcttcaccttattcttgatcttaggaggaaagcattcagtttttcattattcagtatgtaataatagcaggtttttaaaagaatatgtatgctctgtcagattcaggaaattcttatatgtattcctatgtttctaggaatttttatgttgagtacatactcaattttgtcaaatgcttttctgcatctattgatataattgtgtaagtttttaggtggttagtaagtgatggattatattgattgatttttgactaccaaatcaattttgcatccgtcaaataaaccccacttggttgtggtgtataagtgtataattctttttacatattgctgaattctgtgttaaaggatttttgcgtctgtattcatgagttatactgttttgtagtcttcttgtattctctgcctagttttggtattaggataataactagcttcataaaatgaattgggaagtgatccttcctcttctactttctgaaagagattgtgtagaattgatgtttatatactttaaacattttgtgtaattctcaagtgaaactctctggttgtagagatttcttcttggagggagttttaaaattatgttttcaacttccttaatagctattagactagtcaaataatctatttcatattaggtgaattggtccttttgtccaagttgtcaaatttatgtatgcataaattctcttatcctttgatatgtatagaatctgcagtgataaccctatttcattcctgatactggcaattccccctctcccccacccccctactctttttttagttaatcttgccaaagattttctaattttattgatttttttcaaggaggcagctgtttgttttattgatttttctctctgttttccgtttcattgatgtctgttctt

SEQ ID NO: 133293 - DNA, 1062 bp, Homo sapiens
attagttctgttgcttagatatagatagttagaaggtatatcaataggtttaattagaactgggctttttcctggccagtgtgacataagaagaaaggtcaagggatctttccaagggagtggttatagcgctgcattgtggagcctcagctgattaaggaaagaaatgtaaaaaggtagtggggttaatggattgcacaaccttgtgggggtcaaaagatagagtaggaataccagagtaagtaaaatggaagaaaaggaaatagtgaccaaagaatagaattatggaaatacatttttcagaagtggtatgatttggggggctttatgatctagaacataaccctcctcagctaccttcctctgttcactagacaggtggctgaggaaaggttaaggaaaagatgattgaagttgaagaagtaagggaacacagaggccaaagagttagattgattttctgtagatatgtttaagtcacatgatgacagatataatgatggagagaggaagacagtgaatcagatgccacagtcatccctgaatggataaggttggggaggattttcagggaggtagttaacatagcaacaagggtaatgagtgacaaagtctgaccccaagatcttcagaggaaccaaagtggggctcaattaaaggaggaaggagtacagtggggattaatgagaataccctccccacctccatgtcctgaaataatggcaggaaaaggtcaccacttgagagggctctggggagaacaggtgtcttccagaaatagccaagtttccattagaacaagaagagggaacattcaggcggggcgcggtggctcacacctgtaatcccagcacttcgggaggccaaggcgggcggatcacgaggtcaggagatcgagaccatcctggccaacacagtgaaaccctgtctctactaaaaaaaaaaatacaaaaaattagccgggcgtggtggcgggtgcctgtagtcccagctactcgggaggctgaggcaggagaatggcttgaacccaggaggcggagcttgcagtgagctgagattgca

SEQ ID NO: 133294 - DNA, 1104 bp, Homo sapiens
tatatccatatcagagaacattatgcacaagatgttaaaatttatttatttattttgcaaggacatgagggataatgagaaactgctctcaatgcatttttagtgatgccatttagtaaaaagaatatatattctacaggcagatataagtaggcattaaaacgtaaaagtttaccgaggcaggcagatcacttgaggccaggaatttgagaccagcctggccaacatggtgaaaacccagttctactaaatatacaaaaattaaccgggcatggtggcacacgcctgtggtcccagctacttgggaggctgagacacaagaatcacttgaacccaggttgcagtgaaccgagatcgcaccactgcactccagcctgggcaacagagtgagactctgtctcaaaaaaaaaaaaaaggtaaaagtttaaggacattaagattataagttatttttatttgttataagtctctattttcagtaatgaatgcattataacttttataatgaggaaggagaggagtaaatctgacttggaaataaagctggctaaaacagattatgtgatgtgttaaatttatctattttaatgcaaaattctagttgtaaaatgtaaattgggcatataagtgtatatttgtttatatgtgtgtgtcctaaagaaaatctttactctgtcttaggtagaccatagttttgataaaaatttcactgacatcaagtggcaagttacatagctggttataaaaatgtaatttaccctgaatataagtgaaggaatctaagcatatagactgatgattaaaatctcacaatattagtctgaagtattggtagaaaatatttccattggaagaaaatagtttatttctgtttcagattacaggttgagtatctctatccaaaatacttgggaccagaagtgtttggatttcagagtttttcagatttttggaatgtttgcatatacataatgaggtatcttgagaatacaacccaagtccaaacacaaaattcatttatatttcacatacaccttatacacatagcctgaatgtaattttaaatgatgtttttaataattttgtgtatgaaccaaagtttgt

SEQ ID NO: 133295 - DNA, 1162 bp, Homo sapiens
tgtggtgtcatgtcagcactaaaaaaatttcagattttggagaattttggatttgggatttttggattagggatattcaacctgtaatagggtgacttgtaatctttattatcatttttattatttatggaaactgtatcacatatgccacatgactgttttaattttggtcttacggcatatagtatgtacttcctgtaaatatttagaaatccgttgggcttttaaaatattttgtttattcaggaaatatttaatgagtgttaattatatagtgagcaccacttaaagtatttgagatatattagtgaatgtgtgaaacaaagatacaggtagtctggtagaactggtaatgtgctagtctaattctcacaggacaccttttagtgaggaaaacacctatgttagattgtttgcatgttaaaaactatattactacagaagtcttataaaccaagaggaaaacagtctcaagtactaacctacttttgttttattagattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtaagtttcataaagttagaatgaaatgtttataaaatgtagatacatctctgttgatgaactttcttctgcttctataattatttctataaaatgttcaagttgccttcttgaggaagctcaactcagttcttccaacttcataccttaattatctatatctgtcgtgtactgtaatttgccattatagctgaccactgtcttctatcagattatggcacttgatttaataattctctataaatgcctagctttattttctttacaaagtcactcactattactcatatcaaatttaagctctttattctagcctttgtaaccttctgttagcttagttccttgaaacctgtccaatttcatctttggttttctttttttgtagaccatgtgaatagatctgtgg

SEQ ID NO: 133296 - DNA, 1052 bp, Homo sapiens
aaaatattcttatttcatcatcccccccccttttttagttttgttgtatatacaattctagaatgaaaatattaatttttcttccagaattttgaaggcctattgctgtttgtcttttgataggaaatctagtgttttccttgtgggtttttttgtttgtttgtttgtttgtttgtttttgtaggttacctgttttttatatttgatagtttcaggatcttatgttttcccaggtttttggacattttagaaagatttgttcaggtcacatattttccactatgggagttacttgctgagtggtgtttgtaacctttagaactagggtattcttttgtgttattattagattatttcactaattaaaattttcagagaaacaagactttgttttgttttacaattttaggtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacggtaagaaactttgttcatcttggtagtattggttttattattgtaatcatagatttttgttttaagacattttagtcccaatattaccctggttttacattatcagacttgtggcatctggcatactgctgaatctatacatgagctttttaaaggtcccctgatcaatgagggtaataactgtcataaaacctgtgcttttttctagaaagaggtataaaactggcaacttattgacctagaatcatgtagaaaattagtttggttagctggttccttttggcgcttgttactagattgtagcagggattagattaaaaccctgctgaagaggtagaatgctgctgtaaataggttgattaaaggaaaaaaactaagagaataggcaagaaaatcacctgctacaaagaacgggcattcttaggattttgaaagtgaaaccaataccttattgacatcataaaattttgatagcttttgttgatgat

SEQ ID NO: 133297 - DNA, 1023 bp, Homo sapiens
taattttttttctttagaaaagaagacatcctttcaggattcgtgaaaaattctattctctgtaactcatgtttgtgttatactttattaaaaatcattttatatagttttcaattttttaccatatcttaaattagcaaagttaatattcataacattctcttattcacatatgtgttattagaatatttttgctagatcaagaagagaatttctattttagatgcattgttttgattagtctgatgaggattgaaagaaagtataagaaaaaatattgtgacccttataaaagttataatgcaggtgtaattgttaacatttttactaaaatgccagtgtcagaataatacttcagaactgtattagatttgtctcctcttgtcatttggttttctaatagtagcatatatcaccaagtcagattaatagctggcatatatttccattttaaattgcattcgaatctttgagataaagagatatattctgcttttttacccttttcagactaacctttcacctttcctgccaccttcctacattcacatcttccacgcagtttactcacctttctaggtctagttgaaatgcccctaccatcatacacaagtgagcaatatgcaaacttaaaattttagtcatataaatggtcatttagtagtctatttctatgatttatttttaacaattccaatctagaattggagaagtgtacaaagatttacatatgaactccccacagtagtgtttatgatagcaaaatggtggagcaaaaaaagaaaatttatgaagatgctgattggttaaataagttactttatatctttataatggaatattatgcagcccttaaaatgtttctgtaggtctctttttactaatataaaaataaatttatgacatgttagtaaatcataaagtaggttatggaataggatgtatggaaaaattttgtttaaaaaatcataaagcagaaagatgccatcaaccaccagatcatcacagagtgctgcgtctcct

SEQ ID NO: 133298 - DNA, 1871 bp, Homo sapiens
caatcattgtttgtagaaaagttagtccaatacaagataatctgccaataatgtaagcataactatctcccttctgtatcattttgaagtaattcccagacattctgtttcacctgaaaatattttggtatgtatctctaaaagaagtggactctttttataaaaacacataactacagtattatcacagtaaaaaaatttatactaagtaacatctaatatgccgtgttcgagtttcttatccatcccacgaatgccagtaggagtatggtaactataaatcatttcagtagagaatatatggtaattaaaataatattttcttttccctatattcaggttcgtgacaataaaaaattaagagtaaatgctgttattgctcccaagagttcatatgcagacaaagcaccttcaagatctttgaatgaacttaagtaagtcttgaaaatactaagatttatttaaatattgaattattcaacatttattgttacataaataagctattacaagctgtattatttccttttaagatctcttaagtcgaatataaggaaaaatttaggcacaggaccatgatatagttagcacacagtgagtgtgatgcgatgtgatgtttcaagtctgcagaataatattgaactatttaataaaagatgctaaagtagtgggttagttattgggaaaatgaaatgataaattatcccttcataatgcagaaacaatttccaaaaggactaaatgtaaaaaatgttaattataaaataattataagtaaatatcttaatttggaatataagtaagcattctaaacataatagaagaaatttaaaaagagtagtttgtaatcataaaaagcttaagcttttctggtaagtgaataagtcatatgtgattttaaaatataaaagaaaaaagacttgtcctgtgtcattgttgaaataatgtatgttttacttattgtttattggtggcttatcaactcccagatttttttaatgatattttaagaagaaaaatctaatcaatacttttcctttcagacaatacggatttttctcttatttgagagaattatttgatgcacctgatcctgtaatgagttacctttgctgtcagtatcatattcatgaagttcctgtaggaactgaaaagaccagagaaagaattgaacgggtaggaaagtagtgaatcatgtactgaatcatgtaccaaaaatgtagttttgttaaaacttcttagctaaaggcaagcaaaacgtgtcagaatttaagtaagtctgttgtttttaaccatgcagaaattatatttgtattaattattttccatatgacatgaaacattgactgttaactaatacattgtgagaggagtgatgtggaattaactagaataaatacttaatacatttagggtaattccataaagttaaaacctgaaaagagatacctagtacactaacctgattctgccttgcttggtaaatctatgttcaaacattgtattaatagtttagtcttttaaattattatatttgagattatttttaagacaaattatactttagaatggtaggctggggtataaaactgtttttggtcagccttccttttattaaaacttgtacttaagattatctcagatatgaatgaccacttctcataggatttgtttggctagtacatacagccaaagaaactcctagtttctgtattctgctaatgctgttgggaattttattctttaaagcaatctctgtgactccaaaccgtatgcacttttatcacaggcagaaacagagaggaaatctctcctgcaacaggtttttccagtattaataccaagttgctgtattactgcttatgagcatc

SEQ ID NO: 133299 - DNA, 1996 bp, Homo sapiens
gaggtgcgtggatcacttgaggtcaggagtttgagaccagcctggccaacatgatgaaaccctgtctctactaaaaatacaaaaattatccgggcatggcggtgggcgcctgtaatcccagcttctcgggaggctgaggcaggagaattgcttgagctgggaagtggaagttgcagtgagctgagattgtgctgctgcactccagcctaggcaaaagaataagactcctatctcaaacaaacaaaaaaaaattatggctttctacagttgctacatgaaatttaattaaacactactctcctttaggcaagcttttatgattcttcaaaatgttatttcgctttacccattccaacttatctccctcccctccccaacatactcgtccttgtaccattctggccactctctacagcacccgctgaatttgtttgttgttgcttccatcctttgttcttttctcttcgaggcaacatggtgtagtggaaagaacatggactttggtaccaaacacatcttaacacttaatatctgtgattttaggcaatttacttcacttacctgagccttagtttcttcatctttaaaattgagaacatactattaacttttaggattattgtgttgtgttttttgtttgttcgtttctggtttttagctattaactctccccactttagctccttaagggaagtgactgttttataaacaatattaatagcaacagaaacaacttatattgattgatcggttatgggccaggcactatatatctgaaaagtattgctaaatatatcccagaaaactgggggggacctaagaatttgggatcaattcttatgtttaacactgatttcttcattattatatgtgtcatacagtttaaagctgatggaacaggatacttgcaatcttgaagaggaagagcgaaaagcaagtaccaaaatcaaagaaataaatgttcaaaaagcgaaacttgttaccgaattaacaaacctaataaaggtaaggtattgttttaattttagtcattttttaaaggaaatagcgggcagataagatagtaaaatctttagagggagggaaggttttgattaaggtttttgacattttagttatataagcaagagatctttatcatcagtttcagcttgcttagttgcttgacattttctttagaggtaataaataggataaaagcactcattaagctaaatgtgtttattccagatgactctcttaaaaacaaaggaaaacactttctaaaaaattgttacaagaactgtttgagagagatgtcaggcacaataggaaaattattttttcatggtttataattttgttttaaaaaactatacattttttagttctaaaacataggtaacataaaaattaactcttaggggtttttgttcctagatttgtacttctttgcatatacaaaaagtagatttaattctccaaaatactacagtgatctctgagaagaacaaattagaatcagattatatggccgcatcttcacaactccgtcttacagaggtaaaatttttgcctttactttttattttgaggttctaacctcagactggtttgaaaatatatatcgtgtcatcactagcaatatatagtttgttgttttatgctatttaacttacaaatttaatgcatcatgttgatgaggaagtaatacttaaaatacttaagactggttgagtaacttcagcagtttaatcttttgttaatatctgactgtgaaatgataaacacagaaatactgggtggaggggagagcatgtgatataccatattaacttaaaaccggaaggagagctggcaataagatggtagtggcagtggcatagtttttgaatctccaaaatcttttcccaaaaacagaagagaagctagaataatataacaacaaacctgtggacaacacgtataacaaaactaagtttcagggtatccatgtgggcatactgcagtactattc

SEQ ID NO: 133300 - DNA, 1008 bp, Homo sapiens
tttttgtgccaaccagagtttgagggttagtgaaaagagcaaaccagacctgttttatttctcagaaatctgctagttccgtaaccttgggcaagtttcttaatgtgtctgagccacatctacaaatagagataacccttttctttaagatcataattgggattagaacaattaacaggatagtggttgtaacagtgcttgacctacagaagacatttagtagatgagataccttccctgttgcatgtgaaatttttgcagtctggcccttgtccattttaccaactctgatcttttacatccttacaaattcctctcctccagccacattagattacttgtttcttaaataagcaggtctttgaggctcatatgccttaaaattcataatcacctgtccttggaatgtcatctgctgtatatgttccttatttcttgtcatttaaggctgttaagttgtcatagcttctgtgaccactctgaccttccctacatacatactctgtccaatctgctcctgctgagaggtgccatgctgtaatgaaaagagcatgtgtcctgtaagcagacagggatctgaatcatgacagtctctaactaaatgtgtgggcttgggcaagttacttaattcctttcagtctcttttttttttttttaatgcgctaaatgaggataatattactgtgcagtgtttgtgagaaataaagggaataatgtatgcgaagcacctagccaagggcccagcacataagcattcggtaaagagtatctgtttctgttatgataatgatcctgtgtccttattcacctttctgtgaccaatgcggattataatactggcatttaataggttctcagtaattatttggtgaaggaataaataggtccatgaataaataaatacatggaaggtacttggaaaactatcaagcatgatttaaaggttctaactacatttgagtgctgagttttgtcatatgaagcctgtgtactgtgtatctcaaatct

SEQ ID NO: 133301 - DNA, 4923 bp, Homo sapiens
ctaaaaacacaaaaattagccaggcatggtggtacacatctgtaatctcagctactcgggaggctgaggcgtgataatcacttgaatctgggaggcagaggttgcagtgagctgagatcacgtcacgtcactgcactccagcctgggtgacagagcaagattgtctcaaaaaaataaataaataagtaaataaataaataaatataattacatggagctaagctagactttcaggaaaaggcagtaaaatttaaattttacacctcttatggattagagaaatgccaggttattgatgtgctgatgtattttaaagtttaagttcaagtttaacctttataataaaaagagtcattatttaagaaacagtttcagataatttgattatcattataatcagaattcaacaatatttaatatgtggtagtttaataaaacatccctctgctttaacattaacattcaaattttcaaaataaatttttttaatagcaacatttcattgaattggatgaaaatagacagagattattgcagaaatgcaaggaacttatgaaaagagctaggcaagtatgtaacctgggtgcagagcagactcttcctcaagaataccagacagtaagtataaaaagtatataatgctacaattgccatatttaacatttttaagattatggaatcttagccattgtaacaggccgtgaaaaacatgatgtgtcgtaaaaaatagggagtttttccacatttttaaactgaatatatatatatatataaaataatgttgcttaagagatcaatggtattggtactataacatttattcttccaatacaaatgccttttaatgggtacagttggaacatatatagtttttcatggaaacattgtaccagtaattggtatatcagaaataataaatagaatattttaaaaataaagggaaaatgaaaatgtttccctggaaattggggtgtttaattagggttcaatgagagctgaatatttaaggctaacatctgccaataagaaaaggaaaaaagaggtcttatttccattatattttttatcctgacataccactcagtaaaattaggagatgctgccctttagtcacattccaccgttaattatgtacctctgtgacaagtggggatgatactttgcctagatacctattcagaataatgtcaaaatgaaattagaaaataagttttaaaatatctagtattggtgtgtctttaaaattcttaatttcaaatgttatctatttcagtagataatgaaatggctactaaagatataaacaactggaaaaaaattaatggattataattttcaaatcctcaattgatttattttatgatatcagacacagaaatcacagagaatggattcgactaattggatacatactaggaacttagtagatatctttaaaacaaattgagaagcttgtttctaaaaacagtagaatgtcttcagaatacattgtgttgttataaaataaatataagtacaatctactaattttttttttcagaaaaagcatgattctattcttgataagtcatactgtttttgaatcaaaattaggagatgattatattcattaaaatgtattaattacctcttatatgtcaagcattgtacaagacagacatacttccttctcagctgaaacttatattctagtctggaagattgggtagatgaaaacacaaatcaaaaatcagataatgtcagataacaagagatgctaagaaaaataaaacagggtgaggagatggagtgacatggatgggaacttggtcagggaagcctcctttgaaaagataccattttataacagtcctgaatgaagagaacagatcagtcaagtgaagatgtcaggcaaaagtattccagacagagaaaatagctcagacaacgcccaagacagaagtatatttgggatgtttcagaataaaaggaatctcattggggttaaaaattatccaagcagagaagaaggcagaagccaagattatgtaggccttgtagactatacaagcaattaaggttgtattcttttgggatggactccagtggaggatcttaaatggaaaagtgacattactacttttatgaacgagcactctaacttttcttctagatggaggataaagtagggatacaagaatggaagcagtgaaaccatttagaaggtcatttctttggaccacgtaagagatacatgatggcatgaattagggtgatagcactgaagagagagagggagaagttgacaagtcttaggtatcttttagtgacagagccagcaagacttgctgatggatttgacatgaaggatgagagagagaacccctaaatttttcacctgaacaaattacgatgccatttactggaatggagaagattgaaggagaaacagggttgcttaaagtgatagggaaggtgggtgaaatccagattctgtttcaccatcttaaatttaagatgcctattagagtcaagtgaggatatcgagtaaataaatgttggacacatgagcttacatctcagtaagtcagagattcaacagaggaatatttgaaggtctatagaggttgaactgctttctaagaggttaaaataataagtttaagatattagattaatatgtcaagatctttttcagggtttcaggattcattttgtaccatgtagtatatagcctttgcaggttgtgctaggccaaacaatgtactgattgcctcccctcaaaaaaaaaagtatatgttctaatttgtccccatggcatggactcagaagatagtactgtggtgaaattcaactgtcaaagtaattagattctcaggatgcttttttagttcttcataagtgcagtataaagttctaacttcttgctctctttcaatgccccacatattctggacccattctaccaattcagcaagtacccaccattccaaatggacacaactcctcactccccatggtatgcagtactcattcttttttcccaagctcctgttttccctctgccttgctcctccctagccatttgctttaaggcccggagatgaattctaggcctttgaattctcttaactctcctgtagcatgaactgatacttcttttctctaaattcctagcctatatgatatgtactgcttgttttaatactcaacatcaatacattgccttaaagtgttatccagtacatacattttgttttctttaaagtacaagcttttgaaggcaaatgaccctgtttattattcctttgtattcttgtgtgccagcatgctgttgaacagatagataacttattcagcagattatttttcttttaactatttgaatggaactgttttcattgtatctataatgacgggcaatttttttcttaggttttccaagaccttccaaacacattggatgaaattgatgctttattaactgaagaaagatcaagagcttcctgcttcacgggactgaatcctacagtatgcctgtttctctattcccattctgcatccaaccaccaccaccaccctccccatacacacacatacacacacagagttccctccagtacttgcctcccactctgtactagagctcttggtaataataagctagacagcaggaacaatgtactttaaatgccagattctgaatctattagaattttaaatagattcttcctaaggaacacaatgttctgtgccttttctttataaaaagaatagttgggctaacctgaaatactgcaatgtctattttttcaaggataaaaaatgtcactttcagtatgtaataagagcatatattatttgcatacaaacaatgcagcacaattggcattttcatttaatgttttaatcaatgcaaaattgtatatagttttatcctttggtagatttatcttaaagaagtttttttttcccctgccagattgttcaggaatatacaaaaagagaagaagaaatagaacagttaactgaggaactaaagggaaagaaagttgaactagatcaatacagggaaaacatttcacaggtaattttttagtttttaatctttttatcatgtgattattaatgaaatgggaatgtagaataatggaaaatgagatgacatgcttctaagagaagtgtgttatgcccagactgatactgatataaaatttacataaaattgtgtgtcagaatatagtaatactgcttttaaattgtgtttttatattgcctttatttgtaggtaaaagaaaggtggcttaatcctttaaaagagctggtagaaaaaattaatgaaaaattcagcaatttttttagttccatgcagtgtgctggtgaagttgatctccatacagaaaatgaggtaaaattgcatttgaaataaataatatttctggcaaataattttaattatatgcttaaagtacatataaattatttatttacttttgagttatatctgtgaaaagttttgtttaccaaaatgttgaaagaaaggagaaaaccacctgtgggattccattagggtcactttttttggggggggttatgtttggaattagtgactaataccttgtaactctttttatacatctgagtaatggttattcagttgtattgaataaatacgttataaagctaccacagctggagttagaagactcaaacagattagtttgaaatatagtgtatatcagtgtctttttttttttaataaagaatttaagaattcatggtcaggtgtggtggctcacgcctgtaatctcagcactttgtgaggctgaggcaggcagatagcttgagctcacgggtttgagaccagcctgggcaacatggcaaaatcgcatctctgtaaaaatacaaaaattagctgggtgcggtggtatgtacctgtggtcc

SEQ ID NO: 133302 - DNA, 1840 bp, Homo sapiens
aagttagggggattcttggccctctgcagttaccatacacaaccacttctctagcacaagagagcatgacactccattatgttctaattgctttcacctacagtttaagaacctagcattttggaactagaatagatagtgctttttgaggacagagttcctcgctcagtaatttctaaaaactcttggggaagcctactaaacttgaatagaatggtatagaggaggaaaatgttaatttaatctgaataatttccttatctaaatagttctttgaaaacccttaaagcttttagatagtaactgtttgcttaatatttattatttttaaaaatacatatatatttattgttacatatttaaactagtgtcactaaattttgagttctttactcttactcagttaattcaatccattttcaaataatagaatgacattaccagaggaaactcatttttcatcactttttaaatgttttataggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcaggtatggtgattgttctgttacttggatcttcttatatcctgtaacaggaataaatgtaatcattattgttgccattgtttagggaatggacccaatcaatgaacggagagtgtttgaaatggttgtaaatactgcctgtaaagaaaatacatctcaatactttttcataacaccaaaggtaggtaaaaagtaacctaaaagtggtcatatactcagaaatctcctgtgacataatcatacagtttttgtcccaacatgcacatattagcaggaacactcccaaaaaaggaatttaaaaggttaacagtaatatttacattattaaagggacaaattccagtgtcatgcttaatcagaggaagaaaggtaggaggcatattattatgttctaaaattgagattgtctcatttctcttctagaaaaggtactctttcagcactgaaagatgagtggggaatacaacccttaagactctggctcttcattttcccaaaaaagcctctcttgtcatatactgcccttcctctttatttgccactagtactaagctggcccaggagaaatttaagtatcccaacatcttctattcacaggttaattctgataaaaacagaattatctttgtagataatttttcataatctaaaaccattgcaatgggaaattttcttttgctaaatctagtgctgtgagtaaattacaaagcatatgtattcaaagatatgtttttaatgtaaccagattttttccattttaagtattcatgaaaaattttggccaggtgcactggctcatacctgtagtcccactactttttgaggccaaggcaggtggatcacttgagcccaggagttcaagaccagcctgggcaacatggcaaaaccccatctctacaaaaaaaatacaaaaattagctggacgtggcagcatgcgcctatagtcccagctacttgggaagctgaggcatgaggatcgcttgagtctgggaggtggaggtttcagtgagcccagatcacaccactgcactgcagcctgggtgacagaatgagaccttgttccaaaaaaaaaaaaaaaattgtttttgcccatcctacattcaaatttttattaaatagtgtcatctgtcttctttttttcagtagatagtcttgtggaatagtcacatctgttaatacc

SEQ ID NO: 133303 - DNA, 2311 bp, Homo sapiens
tgcctgtaatcccagctactctggaggctggctgaggcacgagaatctcttgaatctgggtggtggaggttgcactgagctgagatcgcacctctgtactccggcctgagcagcagagtgggaaaaaaaaagttttattaatattgcaaataaaataatacatttgactgtacacatgtaaggttggaaaactatacttctcagtatatagcttatatgacaatttgttttaatacttacagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcact

SEQ ID NO: 133304 - DNA, 1044 bp, Homo sapiens
agtacccacatttacaaaatagtgttcagcagtctattagtgttcgaaagggtagaaaatttagtcccttttctgcctgcagtgaaatcacagtctaatagaagcaataaacactcatgaaaaaaaggtttaaaccatttaaagaagccaagttacaaggccgagtattcatcagagaggctgcaacataggttaactgtttttatgtttaaacactatgtttgctaacatgcccaatagccaattttcacttattactccttacattaagctactatataaagtaatttttttaaaatatatttttgagtcaggcagactttcacttacaagttacttgatagtctcatcattggtgaaatgagaatcatacctaattcacagagttgttgagaggagcaaatgagatcggggcctattgggacacatagcattatagtgagtacattattaatgtttatgtatcttctcatattttaaatcttgaaaaatgtactgtgaattttatacacccaggtctgaaaattctaaataatgtgaaagtagagattattttgtagtctattgataaatagttcaaaggatgccaatacctacagactgagcattggggagtgctgatagttatttttatagatcttgttaccttgttaaattcaaatataagttagtcagatgagcttctttaaagatattccatctcattattttatattgatatataatttggaaattttataattaatagaatttgcacatttgggagatatgactatgttgacaatttgggctttttatttccaccaaaaaggttaggtatgggggattttatttattttttaatgttgaattataactttattgctgcaaaataaatgactggtgattggctggaagatttagatattttcaaaaaagccagctttgtataatcccaaagagagagagcaggtctcctctggttagcttcattctaagctgtgctaagaggacttggtgaagctgagggcaacctaaaaacagctctggccctggccctggccc

SEQ ID NO: 133305 - DNA, 1052 bp, Homo sapiens
agacatttgttaaacatctatcacaagcaagcacaaaactgttcattataacttgtttcgtaagcatggtagaattctagctctttatcatttgggttaatttgatcacacatgaaaggttcacttataccaaaggtgatgacattcccgaggctggttatccttttttttaaattattattattattattattattattattattattattttgagatggagtttccctcttgttgcccaggctggagtgcaatggcacgatcttggctcactgcaacctctgcctcccaagttcaagcgattctcctgcctcagcctcttgagttgctgagattacaaggcatgtgccactatgcccggctaattttttgtaattttttaatagagacggggtttcaccgtgttcaccaggatggtcttgctttcctgacctcatgatccacccgcctcggcctcctttaaatgagcatgaaacaactagaaatccttagacctattgtcggatcataggactcttaagtgtttaggctttagaaatcacccctaaggatgtgggggatattggccttcctggattcttaaacccagatcatgaaataatggggactgtctgaacattttaaccactctattaatacatatcttgaaaacctctaatttctcagaacccatttttaacattcttcatgcttattacaaccatcaatttaataaaaaaccaatttctgatattcatggtgctaattaacaaagctgctgtgtgctattaatcaatattagcaggacttatgatagctaccactctagtatgggctttacgtgagctactaattagggcaactgactgcactagtaatttaacctagcatgtaatatcgtgcttcttatgctggaatattttaatggtttataacaatggctaaagacagtagtaaaaaaaataataggaaggtaagtagcccctagggtggggctaggtaatggaggacaaggtacagaatttcctcttagctttagagttttgttttttgtttttgagaggaattgctct

SEQ ID NO: 133306 - DNA, 5382 bp, Homo sapiens
ctgtcgcctaggctagagtgcagtggcatgatcttggctcactgcaaccttcgcttcctgggttcaagcaattctcctgtctcagcctcccaagtagctgggactacaggcgcacgccaccacacccagctaatttttgtatttttagtagaggtggggtttcaccatgttggtcaggctggtctcttaactcctgacctcaggtgatctgcccgcctcagcctcccaaagtgctgggattacaggcgtgagggattacacacctggcacaaacttacttctagtgttaagacaatatgacttaaagtatggcctttgcaggaaggcagattttatatcaataaaagatgtgacagagatgctcaggaacaaccagatgctgagtggcccctgcactcaggagctcagggagaaatgctcgttccaggtaggaggctggttggacccaatgccaattcttttccatcctacaacaccaagaaatttagcaaaaaggctcagcttttttactcttgaaagaatttatgaaaccagcaattgtgtggaataaaacagaaaaaatactttccaggggacccatagggtaccaaatggcaagctcatttgcttagagatgttagcaactttctcattgtattagtttgggctgccataacacacaaccacagactgggtggctgaaacaacagaactttatttcctcacagttctggagactgggagtccaaggtagaggcaggggacgggttcgtttcattggaggcctctctccttggcttgtagatggtggcttcatccctgtcttcccaaggtcttccctagtcttcacatgtctgtgtcctcatctcctcttataaagacaccagtcgtggattaaggcctgccctcatgaacttgtttaacatcagttgcctctttaaaggccttaacttcaaatgcagtcattttctgtggtgctgggggttaaggcttcaacatagggattttggggagggggacacataataatcatctccgagggatttatcctttgagtcgtagggactattgaccatgaccgcccttcggaatttttttcatgttctttgagctgtatcctttctgattcctttctcttaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggagaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactaggaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagactgaattgttctagccattatgtgttgtaaaagggggctatttcaccataatgaaagttacttctttaacctgtgttcgcaggattttgggatgagtgcaaagatgattttaccctgtacctttcaacacatgcaatagttatatagacttgtgtgtatttactattcacagacctctgaggaagtagatgcaatagaggtcacttgaaaccattgtgttatgctggaggggaatatttatattttgggagataaatcactttaagaggcttttagagctcataactgtgcagggtgtactaggaactggtcagagaaagttgtaagctcagattgtgctcttgagatacgatattaataagaacacacaagttgaggtttcattggctcaacagtagaaacataacaccaagcaaagacaagcatcaaagtgtgtgtgtgtgtgtgtgtgtgtgtgagatttatgcagacatgtactagctattatgtattaattaagcttttattgtaaactactcatggcgttgggtgtttaggtttttcacatttaatccttacagcagctcagtacagtagataattattattatgtacatatttctgatgaggaaattgaggattggataacttgccaagaggcacatctaataagtggcacagacagtgtttaaatttggatctgctgaatccaaccctgcatctttgtatgcctgcatcacagcagcaagggatttactggagtgtaccattcatttgacccattttattgagcacacctattcatgccaggcactgttgtcactgtggatacaaaggtgaaaaaatagacaaggaccctatgttcagggagtttctgtta

SEQ ID NO: 133307 - DNA, 1898 bp, Homo sapiens
gttggggtgttactgtgttgcccagattggttttgatctcctgggctcaagcagtcctcccatctcagcctcccaaagtgctgggattacaggcgtgagctaccacagccagcccaaattcttcttttatctatggaatcctagtgctgtttttgcaatcagaaaccactcttttttttttttttttttttgagacagggtctcagtctcactctcacccaggctgcagtgcagtggcacaatcatagctcactgcagcctcaacctttgggctcaagcaatcttcccgcctcagcctcccaagtatctgggaccacaggcaagcaccactacgcctggctaatttgttgtatttttggtagagatggggtttcaccacattgcccaggctggtcttgaacttctgtgttcaagtgatccatcttgagcggctgagcattatttttcttctagaagaagtcttgattttctacatctgcaagaaactttaattcttaattggcactgtttgagctctgttctgaaaaggaggcctaaatcccttagatttgttttttaccagattggtttacttttgctagatgcaatggaagcttttgattttgtatttttgactttcctgtctccattaaagttagacccatccctggacttgggtggggcagggaagatgagaagaaccaggtaggaaagagacgacattcagatggcaggcctccctgaccccaggcaggacttcagtggcagcctggacagctcagggagtctggggagggttgcctatgtccagtgagcaagcttggcacttggcaagtacccggtctctgtcttctctatggagaactcacctccattcgtttcaggactgcccacaaaaaaatgggcttcatttggcatcatcaactaatcagcagtcgaggaggctccctctcaaaagcagcaagtgtccttttgtgctaagtaggcaagcacatagccagggggccccagtccactgttcttgcaccctccgtaggcccaggagaattctggaggcctgatgactgtctctgcaaaggaagtcttttacacattgtgcgcagtgttcagtagcttttttgatcacatttattttatactctgagctgagtcagtcagcaagaggtgcttagcttgttactgaaaggggcggggagtggtatataaataatgagaactcagagaaacttgtgctgttaacagctctgctccagtaaagtggagtttattgtgtcactgcctctgggtgtgttttcctgtgaaggccagaaataatgcagtggtacaagtgtgttgggtatttttttccctatccccaggaggatggtaactctctcattaatactaaagacaggtttaaagattctctaattgatagttgcattgctgtgtgatttgttcagcgtgaaggctgaccattctcctttagaccttagcaccgagcctcaaagagagggcctgacttggtttcccccaggctgccagacgaaggtggagtgaccgtctctctaggccagtcctctcctcctctgtagatcatctctggtcccattcagccttaattctgttctcgtctacatgtgacttccccattccatgctttcttaagtgcaaaacatctatcattttctaaataataccttattatatgactgtcattaacttatatgctgggatgttagattcaacatcatggcatgttagatccaaactctccactgtattaaaaaggtgggagatttttcaaagggctacaaattgtaggtccctaagcagaatccagcctgcgtacacaccactgggtggcaccataatttataatgttgaaattgaatgcctctaagtaggggaagcaccctgttcagttcaccatggaatcc

SEQ ID NO: 133308 - DNA, 1447 bp, Homo sapiens
ctggataatatttgcatttttagtagagatgaggtttcgccatgttacccaggctggtctcaaactcctgggctcgagcaatctgcctgcctcgacttcccaaagtgctgagattacaggcatgaaccaccacgtctggccagtatttcttactttataaattatttatttgcatccttgcccacttttattaagttgggctgttcctttttgatttgcaagtcctttctgtgttacagattttaacattttgtcatatgcttcaatttcttttaatttattttgattcttaaatttttctacttatatatatttttaacatgcagaagtttaacatttttacgtattcaaaactatccttcaagtaggattttgcttttggtttcatgtttagaaagtctctattccaggattctaaaaatgctcacctatattttatcgttatggctttattttttacatttacatttatagcccatttggaaatcatttgagtgaaaagtatgaggtagggactaagatttaatttttttcttttacctgacatctaagccacttactgaattaaacattttctgtttcactgatttgaaataccccatttaccatgtacagaatccctatagattcttaaggttattttcagaccctactctgttccactgatttgtcttttcctgtgctgctatctcactatcttaattattacagctttaataatccattttaataactagtattgcaagtgctcacttattatttgttcttccgcaaaattttcttggcaagttgggcatgtttattcttccaaatgaacttcagaaataactttgtcaagttctagaaaaagaaattcttacggtgtgtgttaattccgtagatgaatttgtacagaattgccatattcacaccattgagccttaccatccaaaggcatggcaagcattttgtttgttcattttcttttatattgaggctttatgcatttcttcaccaaggtcctgaacttttattgttaggcttattctgactggttatggctggcatataagaaagccagtgctcttttgtacagttacatctgtgaatgcacctttaatttagattagatttttcagttatcttgaattttttcaaagagaaagttgtgtcaactgcaaataattcttattttataacccccccttcttctcaccatttacttcttattttatctaattgcactcattagtatttcctggaaaatgttaaattatagcaatgggagcgggtgtccatttatgctttgggctagactttagtagttatactacctttattttactgttgaccttgcagaggaaaggtttcagagctgatcttttatactgctgaggaattattttattttcctgaaagcttttattagggatggttgttcaattttatcatatactattttgtacac

SEQ ID NO: 133309 - DNA, 1503 bp, Homo sapiens
acttgggaagctgaggtgggaggatcacttgagcctgggaggttgaggctgcagtgagccaagatcacgtcactgggtgacagagcaagaccttgcctcacagaaaaaaagaaaaagaaaatgtatagtttttgctgaatcaagaacctaaagaggcaagaatctgttgtcagctgggcacagtggctcatccttataatctcagcactttgggaggccaaggcaggaagatcacctgagctcaggagttcaagaccagcctggccaacatggtgaaaacctgtctctactaaaaatacaaaaattagctgggcatggtggcaggtgcctgttgtaatcccagctacttgggagactgagacacgagaattgcttgaacccgggaggcagaggttgcagtgagccgagatcgtgccactgcactccaacctgggtgacagagcaagactccatctcaaaaaaaaaaaaaaaaattctgttatctgctgtcttttgtttgaggtctgctggaactgcatgtgctgtctcacagatagctgaggttgggaatgtgtgcacgatatttggatatgcttgcttcttagactctgacatgcttaaatgaggaagtgctgcatacagatgtcagagacacacacccacttctcatttcagaacctaaagcataggacaagttgctttctacagataaacacagagatccggaagtaaaatctcacacctaagccctacactgtctctgttgtatcaacaaatacaatataaacggaagccaaatcacaagcaggattcagtgagaggtcagaagcaaatggtagtaatatgatgggatggcattcaggcaggattattctttcaaagcctatttaacatttttattcgttcagaacatctacatgcaaagcaatatttctgataaacaggagacttttgaatgaatgatttttgagttcagtgttcattgaaatgatgtatgcagaaaaatgtggacttctctgtacccaggaatggcctgcacacctcttccgtaatgtgtattggtggttctgcacatgagggtaatggagaatgggaaaaaagcaactgttcatgtttcgtacctgcatgttgacattgctttttggtgaggagagaagccagatggtgatggacaaatggggtgcttgaggcctagggtcagggcaggtctatgtggatgcattccccaccagtctggtccatgaatgctttcttagactcaaatctttgcacttcttcatgatctgactcctctcacctgctttctaacaaggacactcctttgttgggcaaccctactgttactgtttgtgcatttccacctctgaaggaaggttcctgtctgttcttataagagggccatgtccctttcacatatggaaaaagtaggagaggtggaaatagaggagtgagaagacagatgtagtatattcaggaagtttctgactttctccgttttgtttttttttttagtcagagtctcac

SEQ ID NO: 133310 - DNA, 2022 bp, Homo sapiens
gtttaaatcatttagcacaccattataattaaaaataaagaatttatgtgtgtgttccagaagcccttgattcctagaatttttgtttagaattccagattagtccagcactgcctcattcacttcaattatttattattattattattatgattttgagactgagtctcactctgtcaccgaggctggagtgcagtggcatgaaggatcttggctcactgcaacctctgcactctccccgcctacttccccctaccccctactcaagcaatcctcccacctcagcctcccaagtaactgggaccacagatgcacaccattttttgtagaggctgggtttcactatgttgcccaggctggtctcaaactcctgagctcaaaccatttgcctgcctcagcctcccagagtgttaggattacaggcatgagccactgcacccagccatctcattcacttaaattatttattgagtgacttacatgcaaaaagctgtgtaaaatgctggtaccaggcactttggattttgtggctaatagtgataataatgacaatttctaacatttattatatgtcaggttccaagctaaatggtttacatgcattgtcacatttaaactcacagcaatcctgtgagatagaaaggtgctgttcttctcatttaataggaggaatcagactgggagttagttaacgtagttcaaggttacactggaattttcctagtctgtctctaggtgggtggagttgggcatgaatgcttgctgatctggaccccttgagtttccgccagtgggaagagaccctgtgttttacgtggttctcttgggtttggtcccagagccaccagtcttcagctgtctactcttgttgttctgactctggcttatggttggttttcatgaacctcggttaggagtgtcagcagaaatcttggactctgaccatacctactctgtattttccatagttatccagaagctgcttccttcccattgaaaaataacctggttgtgggcccaaagctgtattagtcaggacaacagaatccaaacagggactggcttaataaaaaaaatgaaactttattggttcaggttacaaacacatctaggggtagctctcatttcggtgtctgtggatacaggcactcagtttctgcctctccatggctcagttttgctgccttttgctacagcctcattcatggggttggtgggggctgtctccaaatagtggtgagatggctgcccgcagttccagactcatatcctgccacttaagcaaaccccaaggaaagacagttttccattcccaaagattccagcaaaagttccaggctttaagctccatgactagttcagattgtgtgccccatccctgaaatgaatcactgtggcacgactgggtcacatccaatctctgggtctggaggtgtggggtcaccctccctggaactacatatatccagaatggggaaggagttgttgccaaaaggaaatttaatgtgttatttattatccagaagggaacaaatgccagacaggcaaaaccaacacccattctctctgtcatcccatttagttagttatttatttttatttgtatttttttgagacaaagtctcgccctgctgcccaggctggagtgcagcagcacaatctcggctcactgcaacctccacctccctggtttaagccattctggtgcctcagcctcccgaatagctgggattacagccacaccccaccatgccaggctaatttttgtatttttagtagagatgggttttcaccaggttggtcaggcttgtcttgaactcctgacctcaggtgatccacccgcctcggcctctcaaagtgttgggattacatgtgtgagccaccatgcccggctatcatcccatttataactaccaacaggattttccaaagaacagagtttgacaaaatgagaggcaaacagtacgatatttttttttctatatatttttcttccttttggtgggaaggagctccgaacta

SEQ ID NO: 133311 - DNA, 2081 bp, Homo sapiens
cccctaaaacaatctgacatgctctagttggagcctgctttctatcccatcagtttgatttctgaatgccttatgatcattagcattcttcattaaaaaaaaaaaaagctttgtcgcatttgttagtcttgacttccaaatcttccgtgttctttttttttttttctctctctctctctctttccctttggctgttctcaggcttggagaaaaagcttgtagcatgccattccttcctccactgctagaatcctcccccacatccgaccctcccaccttttcctaatgtttctccagcaagcccagcgcccactgaagagcgtaaattagtgcctagtaattggtacaaaggcactttctgtttctatgcaacacacgcagaaaggaggggcaaaaggaagacgaagaaaaaaaccccacagatggttaaaaagggaaagaagtgagatcctctttcagtggtctttgagcaatcctggctctctttctccgccccactttttgttgaaagttagtcacaggcctaggcctaactcagagcacttggtggcagcagttgttagtatcaaaagaatagcacttggaggttggaagtgaccttgggaggtcatcacatccatcattttgtctttaagaaagcacatccccaccctttctcagagagatggggattgttctcttgaaatgttttggggggacttgaagggctttgaagcacaccaccaggtttcaaaagctgcctatctgccttgactagcatgtgagtggtcatactgtgtaatctcccagagcctcaccagctcatgagggtactaggtagttggaagcatttgtcagcagaaaatgctaaagcccctagcttcaagcttggctctgcgggtgcctaggaatttttccttcattttgaattctttgcagtactttcatttgaattctttccccccacttgctctcctgggacttcagtctatggttaacatttttctttttcaccttagtttaaagggctgcttcatggaattaaccaagtgaaagggcagaggtggagtgagctggggtggcctatgccctttttatgggagcagcactctctttaacagcccaaggcagagctgctgagaggtttcctaccactccctacctggaatcgtcctgaaactttaatacctttttgatgcattaaggccacgagtaaacatttgttttatcccagtgtcaagcagtcccctcagcaaataataggactaacattattattcataagaatgtgatcccccctgagggagtgagaagcacccattttttttttaaatacatgggaccttccaaggccattcattgccatgtgtgtccaaagcctttttgatggtgtgcccgaagccttctcttttaatctcagtttctagtgtggtataattgactttggaatcctgagatgagaattgaagaacctggatctgaaatctaaaggttctagagctgagagaaccagtttgctcacgatctaagccagagctgctgctgctgggcctttgaatttgtttattttttaatgaaactgagaatgatcacaaatttgaacaggagaaaggaatctaggagaatttgaacaggagaaaggccaatccttaactggccagattgagtctttttaaaaagtgaggacatttatttaaatagattaaagtaagagacgggagcttaagccatacaaaattagtgacaaggatttgaaatgcagtcagtggtgttatgtattcaatgaagtttgaacatttttccaagctgagcctccgtccttgtggaagggagtatctcccaaagggcctgacttgaaccaaagtgggaaccagtggaataggcaatggtcaaaaacacaaaagtctctcttgggagttttggacattttagaaccgggagcaaaattacagatcatcttggcccaaagaaatagagggagaagaaaatgtttcaccatctctgtcttccagagagctagctttcataagacaggcagttagaaatgaagagtaaggcctgacctatttcatattgaacagtcaaactgaggaactggaatg

SEQ ID NO: 133312 - DNA, 1004 bp, Homo sapiens
ttcataacccaacttgcttcatccaacatagatgtacaactaggcctgagtggggcttgcacaggtaactgtttctctaccctttttccataattgtcccctccattactgatcctcctgcctcagcctccagagtagctgggattatgggtgtgtgccaccacactcggctaattttttgcatttttagtagagacagggtttcaccatgttggccgggctagtctcgaactcctgacttcaagtgatctgctcacctcggcctcacaaagttctgggattacaggtgtgagccactgcgcctggcctcccccattacattttaattccacagatacacttgagctgtttatggactatgccccattccgaaggcgacaaatcgttgtaatagctaagacttttttcacctgtcacagaaccaatttttgccccctgggagatgatactgcctcaccccactcagcaataggagtgatatcaagtatcctgttagggaagaataacaatctatgcaaaaggctgcatacacatggcttctagctatagaggatgggtttctaaggctgcaagggtttgctatagggtttgtttctgggttttagacaagagggtaaaactcccttgaatcaagtgaaagatgcccagactgttcttcagcccccagcccaagctctctgcagaaatctgaccctggggctggaggctgttaggaccctatagctcttattgctagtcacaaggtaggagccacccagttgcctttctttcctcatttcccatttgtcctgtgtcatcctccatctatctgccctagcaaagacagtcggggggcctctgagaatcttctgctggcaagattacagtttcacgatagaaaacataagtggagtcaaattacagagtacgcacactgtttcccttgattttcctctcacatcttctgtgcgtggtgagaagagagaggggaggggtataagtgggttcctgggtgagagagggag

SEQ ID NO: 133313 - DNA, 4196 bp, Homo sapiens
caacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggttagcggcgtcgccctctcccccggagctctggggttagttaacctttggccaggcagcgttcctgggcgttcgggacactgcactcggccgaaagggtgcaaacatgttggataagatgcggtttaactctttaaataatttaaatgtgcattggcggaaagctcactctctccttaattgtccccggcctccgggagccacggagagccttaaactggcgggcagagcgagtgcggtgcgtggcttcgcggggagtggtgtccgcccctcccctgtcccgccccgcccccgggactctcccgcaccccgcgacggtggggccaccccacctgggagacgctggcagcggggaagtcagatggcgtatcttttatttaattctcttgtcgggttgcagagaagtggttgaaaccgaggggggacgcggcgcactttacttcgagccttttagggatgactaaggactcatttaactggatgcctgctacttttttgggcttgccaaggtggttttaaatttggctgggagtcccccgagaggtttaaaataacccggcttcaggcagcataggagtctgatcaagtaatggtggttaacttcactcatgagtcctcctgatgagccaggtttcagagctgacttttttttttttttttttttttttttttggccatgtgacttaggtcgcaccctccacccctgaatcgcggtttgcagggaggtgtggtccttgccggaggtcaaggcttggtaatgaatgttgggcggttctggaggcctcagggaatagttcctcccagggagggtgagaggcatggccgtacaaatgaatgtggccagaaagacatctatctgccttttaaaatgggctttggagacttccagggacctgggtcatccaattctgttggttgtgtttaacatgaacggtaaaagttggaaagcattcacatttggacatgctgtcttgaccatcttcggaatggttcttttacaagcgccattcagaggtagcggggcttggtcctctcagataagccttttgcctctgtcttgtgacaccgtgtttgagagggtattgttggagttagttggaaaagtgttgtcattttttggtgtaatacctcgatacttttaagatgaggtcttgggcctgtggtttaaaaatgatacatggaaaaaaatgatacttgattggggttttttgttttgttttgctttcctttttaaaagaaaggccacgtaactgcttctcattccatttcctttggaaacttgttcttgtggaggtggctgctggcaccggaatcagactgaatttcctccatggttaatgcaaaatcaggttctgtttggggtcatcatttaggttgccataaaacagcacattttaaggcttgtatctgtaaggttgctgaaaggcatgtgcctgtgttgggggatgtgacctttagtgtggctctgggggtgaagtaggggtatattaactggagggtgttactcaccaacagctgttgggcgggcctggctgtgtcagccatgttcccggagttcagttgttcccatcgacacccactgccaccttgagcaaaggcattttctccttcagggagctgcccagtcgtgcagccagggaggcctgcagttcctctgtgagctgccagagtctgtccgactcaggaatagggtttccagcgttctgggccattcggctgagtgatttttctcaggcatttatagaaatggctgcttctgtgtgcgtgcatgcgtgctgctccttaattctccataaggcaagtcattcggctcagctgtttcaggagaacctttttcccagtcaggagtggaaaacgaagtgagatgttcattcagctttaagtgctacagtcagtgctttgaacctagggatgtggtgattgcaggtgcctatgttttggggatctctaatcttagtgcatggttgaacaaaacctcagcctgggttaatattgtcggaagtgtattcctgctagaggaggtatgtgttaaggttactttaaataagagacttggaggtctcatgcatttggaagtttcagatacaacttcaatttaaattgactttagggtagggtaaggagcttttctaattttctttctgctggtgttaaatcaagaaggtgggcagagatggcatttggaatgtctgcattctgtgaagattttaggagctaaactccctgccacacccccttgcttagtgctgctaacattccctcaagaaaccctccagcttgctcacttccttatagagacacatacagctgccacttcatagaccacttctacaccagctttagaagttgaatcattcaaacagattttcttctaattcagtgctgctacttctgtagtgtgctgggaggaacgacacagttgaggccagctaagctgggttctgatttgtcctattgttttctcatttgagaccataaggaagttactttaattcagagtttgcaaactggaggcttgc

SEQ ID NO: 133314 - DNA, 1049 bp, Homo sapiens
cgggagcaaagtagggcggcgtgcaagttttcgcgcttgcctgagcgcccttccccctccagcccctgggtgttagctgtcattatggccacgggcgttccaccagatcgggctttacctgattgtatttcaaaatccaggaacatcgccattgttggaagctttatccctttagcctctcccctcctcaagctcgcctccttctctaattcccctgctttcaacaaaatgaacactggtttcctccacatatgttccgtgtgcctaggtggggtcgctggagctggaggggctgggccctgaaagggagaggtctggatgcagcccagaatgaggtccaacacgtgatcctctacccccagtgggccatctgttctcctccttccttcccgcctggaggctggcagttctgcccggcacggtccacccctcccagcaggaaagagtgagaaaagccagaactggcagaacccaatacctacagagtgtgattttagcctgaacttccctggtccttgagcaggggtgacacccggcaatctgtattttaaatcgagcgccaggtgattagctccaccctgcaaggtggggaaaccctgccttggggcacagtttgaataaaaatctccaggggaggggcctgggaatctgtgctgcatatgccaggaagtaccttactccccgctagggtgaaaaatttaccttgggccaggcgcggtggctcacgcctgttaatcccagcgctttggaaggcagaggtgggcggatcacctgaggtcaggagttcgagaccagcctggccaacatggcgaaatcccgtctttactaaaaatacaaaaattagccgggcattgtggcgcatgcctgtaatcccagctactggggaggctgaggcaggagaatcgcttgaaccctggaggcgggggttgttgcagtgaaccgagatcgtgccattgcactccagcctgggcgacagagcgagactgtctcaaaaataaataaataaataaaataatacaatttaccacggaaaaagaataggttatttg

SEQ ID NO: 133315 - DNA, 3056 bp, Homo sapiens
acgtgcctgttctaaaaaactttcatttggagttgacatcgtaggttgagcaaaattgggatctgctgaagtttccagtccatttggtggggaaaaaactcatgtattttgcccactgggaatttcctgtcctcctccaagactggcctaggacaggctgtggctctgtattccctgtgggcttggaaaccagaatgtcaagtacctcgtgtgcagccacactgctgtgtgagttcagtctgccaggtcagcctgaactcacctgggcctgacagctatagctttcttggtcccagcactgccttggtatagtcagtgcatgggatgacatgacttttctcttccttgcagctgtcacccatcaccctttacctctattcttactgcctcactcaaaacaatctggaattgagaactatttcttgtacttaccatctatcttgaaaatagatacgttattctcctttctcttccttttctctctttctctgtttttgcaattgcttctctggtattagcccttgagcttgttcaacttgtgtgtccacttctctctgctctgtcccagtgctccattttttcagattcctctttttactatactgctgtctctgtggcttcccactgcatgtaagtgaagatctgtgagagcttcccatcctgaagaccagtaggaaaactggagggaactctgagtatgagcttcacatgcatggaggtggaagaacgtgattgcaaaacagccttagcattgtaggagctgcaatcccaggagatggtagccattgaaatctcgtatcactcagtggaattgtattcaagactttattgagctttcaatcctacctaaggcattctattgaatagcactgtttctgtttgctcataaattagtgggatttgggacaagatggtgtatgaagctaaaataaaggttttcttaggggtgcgtgatgattccaggaacgttgtttgggttacttaagcaaggatcctcagccagctcttcggtttccagcccctagagtccagtattcatagttgaaccagcttatgatttttttttccccatggaggcacctccctttttgcaaagtttataataggattttggatttactggagactaagaatctaatgacctaagaaagttgtatcttggtattaggctgatttttataaattataaattaaagtagccatactgaggttagccatagcctaagttacatgaacaggggtttaagatgtcagtgttctcatatttcatatgaccatgctggatctaaatggaaattttgctcaatgtggccacttaagggagaatatcacatctgagttatttaaaaaaggcagttgtgtcttcccctaacacttttatccttccagtgtttcataagcatctctgttgcctgaaatggaggcaaacattatcgctgtcatgtcatggatgcagagatggtgcacagacattaattgactttcaccttgcagggcagtggctgagtcattcagggtcacaggtctttttttttttttttttttttttttttttgctgcttattctataggacagcatcaccgcatggtctttgagttaaaacgtctactgctgatggaggcagtctgtcggtgaccttgagtaactttcacattctctctggatgcccgttttcttgctttaagtttggataacaaactcatacttctgattttatcctttttaaagaaaaatcagaaataatggaacaccagtgaatctgaggtcggggattccacattatgtagaagcatatatctctaggtcaggaaggacccaaaaagggcagctggtctactggtcctgaaattttgagtcacagaagacttagtgaaggagttaaaaaaaaaaatacacttgcggccgggcgtggtggctcaagcctacaatcccagcactttgggaggctgaggtgggcagatcacgaggtcaggagatcgagaccatcctggctaacacggtgaaaacctgtctctactaaaaatacaaaaaattagccaggcatggtggcgggcgcctgtagtcccagctactcaggaggctgaggcaggagaatggcatgaacccgggaggtggtgcttgcagtgagccgagatcacaccacagcattccaggctgggcgacagagcgagactccatctcaaaaaaacaaacaaacaaacaaaaaaaactcttgcttgagctccatcccagatctactgaaatggaaaatactaatatagagggccagaattctgtaattttaaaaatcactttgtgtggtctggtgcaggtatagaaactgtggcttaagtggaagcttccaagtgcatgggagaggggacatcctgtggatttgctgaggggtctgatgtgcagtttcagtacacagaccgtgggactaaaactgcaaccttcttaaagacaagtgagtcgataagagatggactgggcagagatgttgggaaaccctggactttgtttttgccagcgagtccctgagcttaagtgtggaagctggaaagaatgctgaatggaatgaagctcagtgccaaatagctgggtaaccttgagaaagtcaccccccgtttcttggtctcagtttcctcatctgtaaaatgagggtatggacttgttgatctctaaattgcttctgtgatactcggtatttattaaatgtccttttcaatgtgaagatggtataatttgaaagctgctcatcatcttaattttttgaaatgctttctatggacccagtgcttgtccacctgaacctgttttcagccatgggcctccccaagctatgcccagccactgagtcagtgtgattacccatagaactcaaatcattccaagatgattctctgcatctcaggctggaagagcaacctctgagaaggtgaggtttggaagaaaaggtggtttggcttggagggagttaagtatcctacaagacatctctgctctgggtgagggtaattctatctgctgcctggtgcttcagaaggtgacagaagaaggctctaagaactggcaa

SEQ ID NO: 133316 - DNA, 1162 bp, Homo sapiens
taagatcatgccattgcactccagcctggatgacagagtgagaccctgtctcaataataataataataaaataaagttaaaaaattgcaaatgtatatgaaataaaatcaaatcttcctttatttctctctttccaatttagattattttttcctcaccttcctaatatggtcaagtgtaggaatcctaaaacagtctttatttcaatatacacagtagtaacaaaatgtgatttgggctgtccttagctttaattgtgtctatataaactaagctgtggtggtttatcaatcacttctgtagctttttgtagcttttacagctgtgagcttagagaaagtccatttatcttaagagaagtatttgcttttttgtaaacagtggtgcgtatatcctgaaccatttaatgggaggaaggagaagagaaaaggctaaattgtagagcctggaagtttaatgttgacttatttaggttctgggagtcattagaggcttgaagagctgtttagcaggccctcttttggaagctgctgtttttaacaggctgttagagttgcgggctctggccttaccttatacatgcaacactttcatttgtggaagaaaggagttgtgtggagagagggcctgcttggatgaaagactggatgacccagatgtctggtcaggtagagtgagcggtgttaggagagtttggttggacgatgttaggtgttaggaagatttggaaaggctggagaattggcaggaaggcagcagcctcccacctctgccatcctgaaggcacgctgggccccacctctcccagttcatgtcaaggtttacaagggtcagtgtgtttgtgctgtacttggcattttcacaaattactctgtagttgtttttattatttttattccaactgttgctccggggactttctggcagccaggacttccaggccagcttggaatcccttgctaattgactcaagccatgaaaaggtgccatcaaggctgctttgaactcttgcctgttctagcgctggacaaatcccaggcatgcaccataggaaaagcaataatgagactcacacctccaagtttacagtgcaaaactttgcctgttcaggtgttaagcgcaggggtgaggtgcaagcccagtggaaccaggttggaagagt

SEQ ID NO: 133317 - DNA, 1202 bp, Homo sapiens
agccattgcttgaggtctgggagacaagaaaatgtcttgtgaggcacaagcaggtatttctagcctgctgcaaggggtagacaaaacagcttctttaccagagaaaatcttctggcaaagaaatatgggttctgctgtcggaagtcaggttagtgagtactgaagtggtaaaggtaaagatatgtggcagatagtgactgctgcaaacatgacccagtttagaagttaatacttctctttcattctttcagtgaataaaccagcagaccaattcagagcccatttcagtggtgcaggtgagaggtgttagagacctggacaaggtggtggcagatgaagatggagagaagaggtgggtctcagatttatgttagacatggtatccatatcttggtgatggtttgaacatggggcatgaggtaaaagggaatttctggcctaaatatttgggtgggccatggtgccatttactgaaatcagataactgggagaaggatgagtttgggtcacatattataaatgacatcagttggcacagttgtgtgactttctccagcaatgctgagctggcataggggaagtgggtctcagatttcattcataagcaaaggtttgctgtgtgtgtgcaataggggagagagggcaagggagttgaagacatttacaagggaatggttagcacaatgttggactaaggactctaaattcatagacaggaaaatgaaagcaggaatgagcagttggtcacagaaaagatggtgggatgtaagctggaggaataggagtgtgtggtcttattcaccttggtagacatagctcctggcacatagtaaaagctcaatgaatatttgcaatgaagctgaagtaattatatatattttatttttttagagataggatctcgctatgttgcccaggctgacctcctgcctcatgcatccctcaccaagcttaacaggtaattactgacctgagggtgggtgatagattgaatcacacatttctccagttctctagttcttggattcagcagtctttttgagtgagtcctttgtatttctctcttcaatttcttccccttaagggtcagcacacaagaaattctctgcttccagtctccagtggggtataaataagagtttctgatgcccactcctgaagttactctgtgcttgtgggaaggtggatctactatggactga

SEQ ID NO: 133318 - DNA, 1038 bp, Homo sapiens
ctcaccacaaccctgtgatagaaagatctgacttaagattcttaaattgtgtttcttaagtatttaccttggtcctgttttcttttcttctcttctctaatgacttcttttcttttttcttttctttctttctctttctttcctcttttcttttctttctttctttctttctttcttgctgtctctctctctctctttctttcctttttctgttttctcctcatgtgagctttttctctccctccaaaaccagtcagatggctacatctaatgggcctgtggttctcttgctagaaacacagcactttgtaaaacttgttttgtattagattcccttaaatgtctacatgtggcacatgagcaggagggcagtgacatccacagaaggcctcaaggctggaaaggatggtcttcaagtgtgaagtgccaagtgaacagcagggagctctgccccaactcttgctatgcatggatggggactcctgaggggaaggcaaaatggctcttggtctctggtgcatgcatttgggtctgagcagcacttattcctactattgttattaataattttttttttgagacagagttttcctctttttgcccaggctggagtgcaatggtgcgatctcagctcactgcaacctccacctcctcagttcaagccattctcctcccttagactccagagtagctgggattacaggtgcatgccaccatgtccggctatttttttttttttaaattttagtagagatggggtttcaccctgttggccagggtggtcttgaactcctgacctcaagtgatccacccacctcggcctcccaaagtgctgggattacagatgtaagccaccgtgcctggcctgtttgttttttgccttgttttgagaacagggtcttattctgttattcttaggctgtgtgcattggcaccatcatagctcactgcagcctcgaactcctgggctcaagtgatcctcctgccccagctgctggaaccacaggcacacaccacacgcccagcttgttattgatg

SEQ ID NO: 133319 - DNA, 1541 bp, Homo sapiens
tcccttccctccatcctcataagtcatctgccttggaggacctaaagccttggattttccagactattccacagcttcttggagataagctcatgagaattgccttgaaacacacacacggtgatttttgtgctagatacttactttttggtatttcctgctggagctgggcttgggtggagttccctttagaagcgccagagttttcctgtttgtgcagttaattatcaaaaccttaaataaactctgttatgtgttcagaataataacaactcaacaactattcattaagcacctactatgagcctggcactgttctagcagctggggatacaacagtgacctcagccgaccctgctttcagagagctctcagtctggtctgggacacagattagtaaacaggcatttgccttccacgtggtaaatgccatgaaggacaaagtccagggtgttggggacgggaggtgtggtacaaatagcaggcagccaacccaatctcagaagtgacagggcttgaaggggggagaggggtgtgtggtgtgccaggagagacttcccagagccagagacagctaaactgcatgctagatataagaaactatttcttgtagaatctgttctcaattatctgcaagtagattattccggtaacttgcaagaaaacttttttcaagtctctttacagtggcttgagcatctcaacttcctctatttatgctgcacgttaacgcagaggcatccaatctaatgtaggtggaggcacaaactggagagcctccttgcaggaaggtttgggattaggcgaatcactgcatttcctgcttggaaaaaggagatggaagaagtgaagttaggcaagataagcaaagtgcttcctggatacaagtaattcaggtctttataggaaactttattatttcattcgaagtgtctttttgggatgtcaagcaggtacatctctgttcaaattacataaagcaacaaaacacattccagggccaccagatgtaaatgacttgtgcattattctctttttagattttccttgccattgtttccctccactagtacacatgataaagaccaacttcttgccaaaagaaaaaacggggtggggttggggaacaacacaaaggcttctgtgtgtctggtctttgctgtttcttatggttagtcttggatctacttttgacctcttggtcaggcaataaaatgcctatttgtttaattttaaaatcaactttattgaggtataatttacatacaataagtgcacccatttcaagcatatagttctatgaatgttgaacaagtatacaccactgtaaacaactccataaccaagacatttattatctttttctttcttccttccttccttcttttctttctttctttctttctttcttttctttccttccttccttcttccttccttccttcctctttctttcttttcttttctttctttctttctttctttctttctttctttctttctttctttctttctttctttctttctttctttctttcttt

SEQ ID NO: 133320 - DNA, 1366 bp, Homo sapiens
ttctgtcaccatagattaattttgcctgttctagaatttccaataaatggaatcataccatgagtattcttttgtgtccagctcttttgtttttgagattcatccttcttgttgtaggtatcagagttcattcctttttatttaaaatgcagatttttgaagtagcaaaccaattgctcagcaagatgaccagacctaggaggtccctctggtctaaaaattctatcaacttgcacaggaaatgaaggcctgagaattacatcaggttagtacagatcacattgaagaagcagccgagcacatgaatttctgagctccaggagcccaggaggacagggagagatgaagccccggtgaatgatagaatatattacagaggatgacagggctatttgttcagttccgttatgagctcagcaaaatgtgacaatcctgggaaatataaatatatattgctatatttatatgtgtgtttgtctcgggaggcctggcggggagtggtgggtggaagagtgggtttcctggaggatttgagtaggcagagataactgggcagagcagagtctgtgtcaggctgcatcgatacatattcaataaataaacattacaatgagagctaatactgcttgagcacttattatgagtcaggcactgtgctctgttccttacatgcattgtttcattacatctgtacctccctatgtaccctatgtaaccagcgtctcagtgccctgcccacacccccttgtgtgctcttgcatagtcctgtacgccctcattactttgtgctgtgcacccagcagccagcatcgtggctctgtgttggaggatggtccttgagctactagaattgctttgcttctcagtatagagagcagaagtgcctgggacttcacctgtgactaccaggtactgtgggacgaatgctcccagctccccatgtgacctctcctgtctctggcacacctctgcgtggactttatttgattgtcaatgttgcttggacgcctctcttcccttcctagtcccactctctacctcctctaccagtttcctttaaggacactttttgtttttttctttgttacccagacgagagtgcagtggtgccatcttggctcactgcaacttccgcttcccaggttcatgtgggaacacttcttttttttgtttgtttttgtttttgagacagaatctcgctctgtcgcccaggctggagtgcaatggcacaatctcagctcacagcaacctctgcctcccaggttcaagccattctcctgcctcagcctcccaagtagctgggattacaggcgcacgcctccacacccaactagtttttgtatttttagtagagatggggtttcac

SEQ ID NO: 133321 - DNA, 1421 bp, Homo sapiens
ctctccttgccctcctgaattgctgagattacaggcataagccaggaaacccagctactccgcttatgttctcagattcttccttgtttccctttatcttggtgctagatttacaatgatctgggtgattatcccatcaatgaccatctcccctactagagtgctggctctgggaagccaggatccatgtcttttgctcttagctgtatctctaggaccctggcatagtttctagaacatagtaattgcttagtaaatattgactgactgaatgaatgatctgaagtttctccagtttcctcacaggcgctcactggtctcctggataaatacttttcagcctttgctgagaaatgggctgggaatgcataatataaaacccctgagagggacacaaggtctccctcctactgccagtcttctgggggtgtttagagagatgcaatgtccagggcaatgtgacagtattttactccagaggaccaaaatttagcaactagaagctgattctagagggtgggccttgaaagttatgtagaatttgaatggatgattaggaggaaatatgaaaaacattttaatgaaatactatgtcatttaaatacacacacattctgaattaaatacacattcttggatccctgttcttctcaacaaaagtacactgagtctccagttctcattaggaagctgataaatatctatttccttctattcctgccacagtaactccccagctatataaaatttacaaactgctttggaagcatttgtggaaaaaagtgccagagctctgtatgtgattattgaaataaatgctgattgagagatttcccaggtggatacttaaaacagacatgggcacatatgtacactcacaccccacacacaggatactttaggctgtgatcaatggagataaattttcccacctgacagttgactgtaaatcaatcagtggttttaatagtcaccagatttctgctcctgtttgctgctgtctcaggcaatcattcacccgctgggacacaggacctcaaggatcttggctttttgtcatcactgcacatggagacatggtgcttagcagcaaggtaaatattgtcatactgcgtatgtgagaggcaagaataagtaagtcaggacatccttagaaaagtttatctctggatccccactttccttaccaatagactaataggaagtcatgaatttcccaggtttttaccaaatcaaaagattttcatgacactgtataagctggaaagtagttgagggtcagtaaatatcgaatgaatagtttcgaaggtgaacatgcactcctgatttttgggttagattcttgaacttgcccctcctgactttattatcctgtccatcaaggtttgcttggagttacttgaacaagccaggctgttcca

SEQ ID NO: 133322 - DNA, 1047 bp, Homo sapiens
gttcattcattctataaatgcccccctgaatgcttgctatgtttaagttggtgactggaatctaggggttgagagatgagtaagatatgttgactgccttcaaagactttattgtccagtgggagaggcagaaatacatactcacacacatgatccataacatagtatttaaaatgcaaatgacatctgggcatggtggctcacatctgtaatcccagcactttaggaggctgagatgggagaatcacttgagcctaggagttccagaccagcctggggcaacatagtgagacccccatctctacaaaaaataaaaaatataatatttataatacaaaggaggttgatacatgctcagtagagatacacataataaactctgatggtagaggaacaggatgaggattctgatacgaagttgaggcaagagtaagctaacagtaaagaaaggaattatagtctttgtcgttaatagaattgcatggtatatttgggtaatgataagtagttcttgtggctgaatggttggtagagttatgtgggaagaagcaaaaaaaaaaaaatagattgagcctagatcagggatacccacgtccccctgttgtgccccttgctaacctttcttcctgaatttgaatgaagcctcagaattcttctcaacatagttctcaatgaatcagttgggattggcacttgggatggaatcatttgtcattcctgacttgggagttaaatcccatgcttacatattttatttattttggttattcttgggagttattgcatgttattaagaccagaatgatatgagagaatgacacgattcagtctgttttggtgaggtagctgatggccatgggaaggatccatgggaaaggtgagaggctggaaacagggagaccactaagaagatatacaaatcatctgaaatagtacgagtgggagggaaaagtagactggacagatgaggcactgggacagataaatgactcaactcagcaatgacagagggagaaagaaaacttgaccataactgaattttctcac

SEQ ID NO: 133323 - DNA, 1050 bp, Homo sapiens
ggtgactggatatggtttggatatccaaaccgtatctgcccaaatctcatgtcgaaatgtaatccccagtgttggaggtgggtcctggtgggaggcaattggatcatggggtcggatttctcaggaatggtttagtacgatcctcttggtacggtcttcacaataatgagtgagtcctcacgagatctggtcatttaaaagtgtgtggcacctcttccctctctctggcacccgctctggccgtgtgatgtgcctgcttcccttttgccttccaccatgattgtttaagcttcctgaggctttcccagaagccgagcagatgccagcatcatgtttcctgtacagcctgaagaactgtgagccagttaaaccttttatctttataaattgcccagtctcaggtatttctttatagcagtgcaagaacagcctaatacagtgactgctaggagagaggagccaagagaaggaatacaggaccagggtcttttacttctctttttataaagggaaaataatgagttgggtttcagacaggttgaatttgaggggtctatgggacatccatggggagaattctagccatcatttggaaatacatatctggagttaaaagccaaagaggtagttcaggattcagtcacacagaggaaccaatggaagccttgggagtaaatgctatcacctaggatgagagccacacagggcatttataggcctgaaaaaggacagccaggttagaccttgagaggtgcctaatgaacaccagaggaagagaatctgaaaacaattcctaacaatgtggagtgtcgttagttaaatccagacctctacttctgtgtctgattcttctttaacatagagcaatgactcacctcaatgtggcctgttggtgtttgagaatgaacaacacaggtagctttctcctgtacatcatttatgggagtgtttctcaagatctcctgatagttgaccatgactcacagtgagaaatatactttattttgggaccaacaacatacatgtctatataattatttaaagcaaagg

SEQ ID NO: 133324 - DNA, 1034 bp, Homo sapiens
tcatcttgtcccaaactgaactcttctctcttccttcagtgccagcttttcctttctgccccctcccagcatctacaggatacagttctgggtcctcagatggccaccccagactcatggtgggccctcctaccttcctccactcctctcccattatttgcccacgtgaagcccagcctggcaagttttctctctgtccctggattcatggtacttgtctgatctcagtgctatgcccacattgtgacttttcatggaacgcattcccctccccttttctccccatccttcaagacccagttcaggccttacctcttccctatggcatcccctcattccttcctttatttttgcatctttgcttttatagtttacattgatcatatcaccaaatactgtggaatatttaaatagttcatgttttatgctctcaactagattcattcattgattcattttaaaactatttattcaattgcctattaagttttgggcacaggaaatttaaggagagtgagggtaagaataggtgtcataactccaggatccacaaagtgggccagcaccgtcaaggcagtggagagctgttgtttttaaccctttatttccattctcctgggaaaacaccctgattttcttttggttactctattctaagtcttagtccttgtggtatgagcagcgctgacctttcctccttgaatgagaagtgggcatgaggccgaggcctggcccatgagagaactgcattccctggtcacagatgttggttcacagatgagtctgtgactgtggctaggccagtgagaactagccctgggctcttgctagaactgcctgggctgttaagctggtaggatgtgatcctggagctctggcaattattattcttattttatttttttgacacagggtctcatctgttgtccaggctggagtgcagtggtgcggatctcagaccactataacctctgcctcccaggctcaagtgattctcatgcctcagcctcctgagtagctgagattacaggtac

SEQ ID NO: 133325 - DNA, 3031 bp, Homo sapiens
atgagttgggaagggccatcttatcagagaatatgatttaattacagctgcttaggagcgagacttcccattctggctagttcctattaataaagcttagaatcctgagacagaacaacaccttccttcccccagatatctcaggaatcattagactttaaagatccagcaacaattttatttttcctctagttgggagtagggaagtgtggcactcaccttcctttctccactggggttcagcagacactgattttatggcagactcaaaggcagtgttctcagccttggggcacactagaataacctgggggcttgaaaaactattgaggtcaggtgctcacctctcaagattttgaattacgtggtccgggctataacctggcatcgggatttaaaaatcttcccaggtatttataacgtgctatagttgtttgatctgatcaggtccaggaaaagaaaaaagctaaatccagactttgcttaaacagatcatcattgcctaaaattgtttttctatatgccagagaatatggaataataagaaatatgactttgtaataaagacagctggaaaattcttttgattgttttttattgtaattggggagagtaaaaatcttgactttggcttggcctggtggcaactgtaattccagtgctttgggagatggaggtaggaggattgcttgaggccaggaatttgagaccagcctgggcaacatagtgagatcctgcctctacaaaaaagttttaaacatacctctgtcctgtcaagatatcttccccaaagtgaagcaagtttgaaatgagtgaacatcagcaagtaccaccattctcaaatttccctgcctcccatactgtctacttggttttcctgttttgtgtgaggagttactagagttgtagcatattacagtagatagggagtgttgatatccttgattgtgttctcttcaatttgcaggcaaggaaccgaggcccaaagagttagaggatatgcccagggtcacatggtcaagtagtggttgtaatgacattcttgattttacccaacacctagtccctatttctttctttctttctttcttttttcttttccttttttttttttttttgagatggagtttcactctgtcacccaggctggagtgcaatggcgtgatctcggctcactgcaacctctgcctcccgagttcaagcgattctcctgcctcagcctcctgagtagctgggattacaggcgcatgccaccacgccctgttaatttttgtatttttagtagagatggggtttttccatgttggtcaggctagtctcaactcctgatctcatgtgatccacccacctccacctcggactgccaaaatgctgggattacaggcatgagccactgtgcccggctctctagtccctatttctttcttctcagcggaatctcagtttggggttctattcctcttattgtgactcagaagaagctgacaccatttgcagctccagtatagatcttggttagtctaagccaatgaatgaatgtcattctcctgccatctgctgttgatctaatggtgagtacatgacccaagatggatcagtcagactgaaggggacgacttatttcccatgcttgaaggagaagattcttgttctgtctcttgcataaacctccattgccactgggagccatcttttcactgtcaggggtccatctgatgcaggtgtccaagcacaattagagcaccgctcaatgtctactaagtgaggtgtaattcttagtacattacacagttgcctcacaatgtctagcaggctaggctactccattgggcatctgggcaaagcggcgttccttaacttttccaggctgctgaggagagatggtgattagccatatcatggcactgagggaatttctgtgcgttagtctttggcaattaaaccttatgctgttccccagtgctgtgagtggcattgcctgtatctgcataagactagcaagacagaagaagaagaaactacctgactcagccaagtgacagacaatgcaattttagttgcctggtgacacttttagttgcaatgatgtactttttgtttcaacttgagctgcttaaataataaaatattggctcaagtaaataaaaagtactggagtgtgtgcctaaaaccagaggttcaaatgatttcacgtgtaccctgtctcttggcttccctatcatccacattgcctttctcgcattccacatgggggcaagacggcagccaatgactccagacacaccttcttccatgcctaagaccaatggaagagagtcgggcctccctcctgtctcaagtactgcaagtgtctcctcacccctcatgggctctggttggattgcatgcccattcctgaactagccattatggcaatgctttgaatttccaggcctcaattgcctgtctctccccaggctgaagaacataaacggagatcggcagcatgtccccagaggaaaatcactgttctgttaccgaggagacaggaaaataggctctggctgtccaagctgatatacctagaagcttttctgaatgtgtagtttttttttgttgttgttgttgtttgtttgtcttgtgcaaagagcagggaatttgcaatcagaagactgagatttcagtcccaactatctgagtctcagctccacaatttttaaatgggaaaggctatctttacccagtttgaacctggtattgctctgaggcttgaatgagattctggataggaaagtgttatttaaaatgataagggctaaacaaaaaagagggattgttgttattactattatcatcttttctgagtttctcccactcatactttggctatgtgcaaggttctcttaggcaagacatgaagattaaatgcagctaggcacaatagctcgtgtctgtaatcctagaactttaggaggctgaggcgggcaaatcacttgagcttaggagttcgagaccagcctgggcaacaaggcacaagaattgcttgagcaca

SEQ ID NO: 133326 - DNA, 1050 bp, Homo sapiens
aaatcaaaaacaaacaaacaaattagtcaggcatggtggcatgcacttttagtcccagctacttggggggctgaggtgggaggatggcttgagcctgggagtttgcagtgaggtgagactgcaccactgcacacacccacctgggtgacagagggagcctcggtctcaaagagtaaatgcattattagcaattaggaagactttggccagtgttgctgttagcacagatagcagctttcttacaatcagaaatagacctctccttccacctctaggcagtgcagtccccagggaacatggtttgccaagtggatagcatcattgtgcaaataaaaagtcatcccttcctctaggcagacccacctgcatgctagggcacacagcattgtgattggagtgcatgctggattccaattgttgctaccctttttgcaggaaagtggggcagttgggagaggggggctctgtgcagtgtacaacctgcacagctctgtactcggggcccttactttggtggtaaatcactgggcagactgaactctggaaggcttactcctcattttcctggcaaagtgcagctacccctctaagaccaatgatcactttgccttttttgagccttttcacttcatgctgaatgcagcagtctgtgctgtctttcttagttaaccacccactagtgatccagattctgctggtcttttcagatgttcacctgcataccgttccaaccacaaggaagaattcttcctttttaactgtcctcatgagtgattttgcagaggacagttaaccctttaagataaatgcaatgcgttggttgactacaattggctgttgttggaaagtcggatgctgatttctccaaagtgcctgggtagaagggctgaaaagcacaggcagcttcacctcaactgaccaccactgtttgctattctaaatcttcttggcaacagcaactccggaaagaaattatttgaactagatccagccagcctccagggatcccaggatgcaatacggtagcctttattttactatgacgggaag

SEQ ID NO: 133327 - DNA, 1163 bp, Homo sapiens
caacaaaggcttacttctctctcacgctacgtgtccactgcacgtattaccgtatcagggactcaggctcatgggacatcggccatctttaacattgccagactctgtaccagagggaacaagagctcacagaagatcttgtatcggggccagagtgacttatacttgcatcttgttggctagaactagtcatgtggcctcactcacccagaaaggcaccaggaagtacaatcttactgtgtacctagagaccctagagatagggtcttgctatgttgctcaggctggttttgaacttctgggcttaagcaatccttctgccttgcatactaaggtgctaggattttaggtgtgcaccactgtgcccagctaccagctactgttttcttaaaagacaattattgtggtaaattacacttaacattaaattgccaatttaattattttagagtgcacaattcagtggcatttagtacaatcactgtgttgtgcagccatcactgctattttgttccagaccattttcatcatcttaaaaggaaacccctccatgaagcagtcaccccccatcctcccacttgctctagcccctggcaatcactaatttgctttctatctctatgaatttgcttattctgaatatttcatataaatggaatcatacaatatgtagtcttttttatctttaagcccagctattttttccaagttgtcctcctgacccacaggaagctgacacaatattgtaccaagtggtggcaacataggttctcccaggtcccctctctctccacctgttgtcactcttatttcatttttcctggctcagaaggagataaacacctgctgcctaagcagggaatggatttcctgcctctcctctttcaggttcctcgatctccatgtgtgcgtctcctggagtccttgtcaacaccaggggaaagagggtgtatatccctggctgcccaaaggaggaaaagccactatgttttcccaggctcatctcttctgactctctgacccctgcccagcagaagtgctcatatagtttgaggtggtggcattctaatgggacccatcaataaaccacaggggcatgtggcatctggccccatattttttgtctttttgaaagagggtatcactctgttgcccaggttaga

SEQ ID NO: 133328 - DNA, 1038 bp, Homo sapiens
tttgtagcagaagttccctttgggcatgcagccacctggaagtgggcatgtctccttttagggtccccaactaggcctctctaaatcaggccaggctagcagcattctgttttgaggcattttgacttttacaaatctgtagctcccttaaaagcaaaggcagatgctgcagaaagtcctgacccttgggcttctctaaggcctgtggtttgacttgcattaaggtgagggtggcctgctggccccgtctctgcactcattcccattcatgagcactcctcacctggcctactgtagcaaatttccaagaagtgttcttgcctttatactctcccgtctacttcattctatgtgcagctgctgggttagttctgttaaagatcccctcttatcttgttccttcacttaaaaatcatcactggctcccattgctcatgaaataactagtttgtgcaatcaagtttctctgcttactccagaaggtacaaaccccatatactcttccattcttccctgagggcaggctggggagctggggagaagtgaaggaccacatgctggggccctgagaatctacgcatatcccattcccagttccagagggtaccacttgggttgctggtgctgagacaatcctgtttttttggcatcctttatactcggggttccctctttttgcaggctttccatcaagccttttaacaatgtttacttatatgttgtggtaaagggaggctctagatgataacagtaagtttgcaaataacagtaaaccagtgattcttggcctgcatgctatcacatccctcctcccatatccatggcagatgtgctgaatccgtttttgcccactgagcccagctgaggcctcagccttttcaacactactccaggcagtcattccaatcaatcgaatttgtccagtgagataaaatctatttgttatccctgtactctactctttcagggtgtgaagcatcagaccttgttgtttgatggatttaagattggatataagaagacatggacagacccttg

SEQ ID NO: 133329 - DNA, 1064 bp, Homo sapiens
gagcccagatggcgccactggactccagcctgggcaacataatgagactccatctcaaaaaaaaaaaaaatcttctagttacttcagttatccagcactaaattaatttcttagctgatattttgagttctgcaatcatagtaatggcaaatctagctagaggtccaagattttaacatgggtcaagattacagggtagtagatatagatagctctttcggaaaagggaaaaatgtctccttttagctttagagaatggcttaagcagaacccagctctctatcctcacagacactatgatctcagggttttacgttttttgttttttatttttaaatcattactttctccaaagtcttgccttttctctggcttgcagtatacattaagagcaattaaaatcaatgccctgctttttgcatggtattatttatcataaatttgcttcctttgatgtcttgccatagaaaatacaagattttcctctgtcaccattgatgtataagatgatcaaatcatagcttagcattttttaactaaggattgtttgttattttaggccatgctcccattctttttcatcccgttttttgatttcgtatgaatgtgcaagaaaatggccaaatgataaaggaatatttggaccattggctgacagacatgtttcctctttctccctctttcaagtataagagatcctgagtcttgcacgataaaaccacaaacggaactaaattatgctgagcaaaaatacattcttttactgagaatttcccaggagttttgatatttttgactcttgctcactaaatatggaaaagattgagacactatgagaaacaggggagctgttctgccatttttagacctttaagaaattgtttcatacctttaatgctatgttaacaatacattggaaatctccctgctgaaaagtcacagccctctgaatggtaacagtttctggagatgttctctaagcttccattttaatataaataataaagctctgtgagttataatttatatttttgagtggtctaaatgttgtccaacatatggaa

SEQ ID NO: 133330 - DNA, 1285 bp, Homo sapiens
actgacacaaaaaagatcagtttttttttttctgaaatagagaaagcactttatttgatgaagcattgctaggcttaccaaataagataagacagaacggattctttaaattatacattgagaatgataggggtgggtgtgggggtggagaataaatataaccaagaataatgccatgtaaataatttttgagaggcttcaagcatcttgggtgcccaatggaagggactggtgagtccggaggccacctctgctcccagttgtggtatctctgggtcatgtgggatgccacacttttcctccaatcttcctgtcaccttctcttgcttgattcaggggcctccagtggagcaccctattaggagcatcttcccatgacaaagttagctttgatgccaagttctaaatatttcttaggggacatctgttggatatatatatatatatatctgttcctgctagattgggaactcactgagggcgtattcagacataccacatgggggaaaaataccttggtgggcaaagcatttggggccatggtccccaaaacacttttcagcccagatttaattttgagtaaaaggtcccatgtatcttctgcctcagccttctgtctacttgccactgtttgggcaaagaaccattattcatttgttcattcattcaattcgtcactcatttgttttataattcatgtattcactcatccattcagcaaatgtttatgagattgcaattgcaatatacaattgcacactcaccagactatttctgtgacctacatttgagactagagacttcagagtcatctttaacttttctctttccattggttgtatctactctcaccccattgtgtctgcctaactgatccttcctgctatatttaacccattctatggcccttttactccattagcaagtcttgtctctttcccattttcgctttgaggggaaaaagcacaaaccatttttcctctgctctcacaccacaacagtcaacacagaagacatctgtgaccagatgtgtggaagttttcccccctacaccaggcaagcaatcagttctgcagtggccaccagctgggtgtcctctaattcaattcaattctgacactgtctacctggagatagtgtcagatcccacaggttgagggcccagtctccaagactgcccccacactctgttcctgatgccaaccacaagctccaggttgttttccctgtgcttctgactgactggctacaaatctgggtgcccacaattccctccctgggtttg

SEQ ID NO: 133331 - DNA, 1049 bp, Homo sapiens
gctttattatattacaaaggataccaatgaagagatgcatagggtgtggggcgagaggggtgtggagcttctttgccctccttgggcatgtcaccctccaggaacctccaggtgttctgctatccagaagctctccaaaccctgtccttttgggtttttatggaagctttattaagtaggcttgattgactaaatcattggccattggtgatcaacttaccttcagtccctctctcttccctagaggtgggggaggctggagctgaaagtcccaaccctctaatcataccttgttttttccagtgactagcccccattctgcaaatacttaggggctgccaaccatcagtcagctcactagaatatgaaaaggtgtcactttggagattctaaggattttagaagttgtatgctaggcaatggggtcaaataacaaatatttcacagtattacaggcttcctctatcatttccactttcaggtcatctttagcttttacctagttcaaattttccttagctcatatctagagcattccacttccaatatgttggcatatgctccagtcacaataaatctctcacctgtcttccagcgctctgttgtgttttcatgccattgtgattcttgttggtcatgctatactacttttcctgaaatctcttccctgctccctcttttctgcttcttgaaattccactcattcttcaaggccaacatatttgagctcaaatatcacctcttctgagaagcccctccaagctttctttcaacccttctttccagttattgcaaatttgaatgtacattaaaagtacactctgtaatctagaggactctgtttatataatctgttaatggtgctttgaaaagtttgattcgtatggtaacatatgtgtttctaccagattgggaatttgttgagggcaggaactgtctattcatttatttcttcattcatgctatttgcaggcactaagctagggaccagggctctcactgtctggctgggagataaacaggtgaacttaccagtattgcgtagaagg

SEQ ID NO: 133332 - DNA, 1080 bp, Homo sapiens
taaatttttttcaaaaggaacaagcaatttagaacaaatcattacatatagtagtatgtaaaaattggcacctttgaagcagatgattaaaccgaagctattacttccttgagctctctatgactttatttacggtcctcagtaacttgctgctcataaactgcttaattcacaaagacaggtaattaacgtcccctcgatcagggatgtggtggaatcaatgggctgagcataagctgactgcacaaggccacagaatcaatgccacattgctgcacagagaacccagaaatggaaggaaatggactgaaaaataacacacatacatgtgcacaggaaggaaatggctcatggaagttacacagtttgtgtctacagtcatttaagtttggcttatatatttcacacgtttcacagacgttagaacttaattttcatgcacaacaaaagaatcaggtaattgcaagatcaggactgttgagtatttcgtttcccagttcctatccttttctctctgaaatcacgatgaatggaaacacttgagctgaaaatttctttccctcacttccaatctggcccagaatgaggccttggaggtgtttgatgtcaatgaataatgttttcacctccttcttggattcctctatagacccttcagggagacttcagcattgtgattgtgcttgatacttaaaatcatcaacatgttaggatgtaagtgcattaaattggcaacatctaatttaaagaacaaaaataacaaaatctttgttcaaactctggtgctgagatttggccttcctgagaatcacagagagatggtctcaaatgtaaagtgcctattacaactgcattaactacgagcaaacatggttcctttccctcataatcaatatagaaccaggggctcatgaaccctttcaagttatattgcaactttgcattatgtacattttttttttctttctggagagagagcctagagttatcgtagagcctcgtagggattcatgactcaaggaagtttaagaacgactgatttattctcagacccagtgcatgtttgctgagagggaaata

SEQ ID NO: 133333 - DNA, 1919 bp, Homo sapiens
tacaaaatggtcatgtgatgagtggtgtgaaaaattggcagttacgtcttggaggtgttcaggaggacgtggtggagccatgcaaatgatgacggtcacacagcagcacaacacacgacatgaacggtgagaacagaacatcccacatggcaatttcaggctagttctgtccactgtttttttttttttttttttaagttcaatattacatattcagtgaatgaattcatccatgacaggtgagatacaaaataaattaaaaaatataaaattatttaattacattctcctgagcttgctcgactagacttgaacgcccactgtatataataaatcacttgacttttgtttttttaacatcaactcttctttcatttcgattgcaatacaaaaaggcatttctgttcccttattttcttcaaaaaaggataaacagttgtggcaccagaagtgaatagataagagacaggtgaactatgactgttaccttgttttttctttataatgatcaattacagaagtgttggcatgagaaggatgtgggacgttaggtagaactgcttgctgccggcttatactgaataaagaggatgctcttcatcagtcaccagtgatggagccaatgtgaaaagaaaacagaatggaagtttagaatatctcattgtgtacgctggctattttattttattttgcaatttagccctgcatcctacaactcttgataatggtcagaaatcaacagatgcctcctggcatggagcgtgctcgaagccccttgtttcccctgctctcatggctttctgctgtgactgcggatacacattcatctctaacccttccttctccctctcttccccctccctgcccagcaagtgtgaacatgccttaaatcccctgtgtctggcactgggtcagatcaaatgctttcttgatctgtggcccagaagtcacctttgagttaacacctcccaaagcattgcttgttttgctcagctaagaataaagcaggtatgattcaaggaaaggggaaaaactggagttggagagaattttagggctggattcttgagccttctgtggcggatattaagaaggtttagttgtgcttgctttcaaagctttggaaagccgatgttctggacagtctcctcatggacaggctgtcccctcggccctccggcttggaggacttgcttctctggaagggatttcgcaggcttgctgtgttccgctgcctgtcgagtttgtcactgatggagaagctcttcctggtgtgtgcatatggcgcacttggctcctctgccgagtagctgttggcgcgctctatcttgggaacagtgatgttgttggacagggttctctctgagttatcaccctcctgggaggatattgcaatggtggctctgcggcctttggcctcattctcctcactgtcagagctggggtgactcagttctgcttctcgctctggatggcagcaagttaagtcctccactttgtctccaagacctccagggaaggcagctctgtccgcaattgcttgaggggcattgacacaccttgtgtcaatacagtctgtaatacttgtgtattctgctgtttttacaggcaccccaaagttggcataatagctccttgagggggaaaacataaagctatgagatttcacaatgggagcctcttctagaagaaagggtgtggtggctaggtagcggctacttttggaacgctcaatggtgtggtacatcggaggctctgagtcccaggggttttggcattctgggaggtgggtgtagtctgaagaaaaagatctagtgtccatggaggtgatgtcctcaaaatcaatgctccggcttggaggtctgtctgtgggtgcaagtgttgcataggcactacttgaaggggctgtggaaggtact

SEQ ID NO: 133334 - DNA, 1044 bp, Homo sapiens
acgatcatggttcactgtagtcttgacctcccggggctcaggcaatcctccactgtagcctcctgagtagctggaaccacaggcatgcaccacaacacccagctaatttttgtacttttggagagacagggtttcaccatgttgcctaggctggtctcaaattcctgatctcaagtgatcgatcacccgcctcagcctcccaaagtgctgggattttcacaggcaggagtcactgcactcagcattggtccagaatcagaacctggttgcctggacgtaggcagtaaactggacacataaagtgagtagtagcccaaggagatgagaggaaagcagagaaggtacaggaggaagagtctcttcagggaaagagagaaggtacatggtgagagccccaagagtgaagaaggatggctgcagggcatggaaccaggggagggaggcctgttggaacagggccaagcaactattcttgtcaaaccttaactgtcctatgggctctgagatgggctgaaatgtaagacttgactaaaacaataatggactgttttctccattttctcccagaatgctgggtgtgttcaacaaacttaccatgaaatgtgtgatcacttaggtcatggacctagctgataggggtttaatataggggctataaaagaaataaaaagtcctagagtcaaggttacctgtgtttgtttcataactagactggttcctttaatctttttttttttttttttttgagatggagtttcactcttgttgcccaggctggagtggagtggtgcgatctcggttcaccccaacctctgcctcctgggttcaagcaattctcctgcctcagtctcctgaatagctgggattaaaggcatgcatcaccatgcaaggctaattttgtatttttagtagagatggggtttctccatgttggtcaggcttgtcttgaactcccgacctcaggtgatccgcctgcctcagcctcccaaagtgctgggattacaggcatgagccactgcacctggccttcctttaatctttaaa

SEQ ID NO: 133335 - DNA, 1078 bp, Homo sapiens
ctctctctctctctctctctctttttaatacgctgaggtgtatccttcagactgaagatttttcttatagctctgctggctatactatttggcccatgagatctaaatgtatataaccattcagtagaaaaatctgcttttattatttttttttgctttcatcttgttctataaaaaggaaaaacaaaacaattctggggaaaaatcctaattattattttagctaatttacaattctgttactgtcatttattcagaaggtgttgggcacccatataaggcaggcactagggctgttcaactcctctggaaaagacgtgcaatagtctacacaaaacataaactaatggagagcctagagtcaggttgagtctcatttggtttttgcctggaacagaacttcccaatttctgatctgagccagcaacctcaggcctgtcctgcactcaaaattctcttctgtctgggaggacagctgctactgcctgctagagaagtctaggatctgtaagtctgggattttgatctatagatactttgggcaatgttctgttctctcataagctccatgatttctcagacaataaaaacaaacacaaaagatctctgttttgtgaccgtgtgaataaattcgatggataaagcatgccttggcacaacacatctgcaggaggcaggtgtccacagaacacacctttctgaagtcacccgtatcctctcatcattagatgagttgaaccgatcatccttttctctgaagtattcttctatgcattgctcttcaaagtcatgtactttcttgagctcatcatcggttatgaagagttctgtggaaaaaaaaaaaaaggaagtcttgagggagagaagtaaaagcgatggcatctgatttgtgggcctagtgacattctcagtataaatctaggtgggaaaaggggcctagattccttgttaagtctcaaatgaaatccaaatccaattaggcaacttgcatcactgtcttctttctgaacatgaaatttattatgggtctctgaagttcacctgagcatatctggtttactgcaggagctgagtagaa

SEQ ID NO: 133336 - DNA, 1063 bp, Homo sapiens
attcatacaatgcagggcccttgtctctgaccttcacccttttccacccagccacagcactaaaatctttcttctctgagaaagcagacatggctgttcctcccttctgagcatccagtaacctggcaatgctttcgttgctaccattggtgataacgacaagaaaaccctgaacagcaactgcatggagctggctcccatctagcccaatgtctggcttattcaggttctctggccttctttgagggggtgggcactggaaaggaaatggatctctggaccatcctacttcctgcattgtatttacaaacaccaccttcctaagctctctggataagtgaggttcctcttctaccacaaatgactcatgctgtattgtaaattattttgggactctgagctagccctcagcatgttatccactgcaggctatcattcattagagcatcccgctgcccctgattttgtatcccatgctcctccacattggctagagttcctgagtcgagaagcttagggtttatttcataggtcatccaccccgacccctccaacttttctctttgcttaaatttgtgtttcagatggaagcagtgaattctggaattcccaggtctctctaatgtaaatgtctagaaagaagttgggcattgcaaggtcagggagggtgttaagagcttcagatttagagaagctgttgaccaaatcgttttggtttcaaaccttagatatactggtgaccacacagagggaagtagactcctgggctataatcccagaggctcttgttcagtagatttgatgtaggtggcctgtttgacacactttgagaaaccataggagcttgctggtatgggattggattcccagtggttcttaatggagcgtggtacccaaagggtatttaggaatctgtgggagtcaccagtatttaatgtgtggaggctggatatgccaaacctcctgcagtgtgtggcacaatcctacacaacaaggaattgttctgcctcaatgctaatagaacctccttttagaaacactgggctggaaggtggatggtgaa

SEQ ID NO: 133337 - DNA, 2013 bp, Homo sapiens
ttataggtccagaagttattgcttaaattatatataatgtagccttgggtggcatattaatatcattgatgtattttgggttgagatctctggaaagcaagaaacttagaacttatgaaggttctaaaatagccctgctggagactgattgtatctctctaagaaagacatgaggctaagagtgctcaatttcagcctctaccatcttctttctgacattatttctcattcaagtcaactccctcatcccccaatgctctccaagccttcagagctgtctgcagcctgcaagaggtaggaggaactaggtgggcatgcgattctgcgtgattgcctataggaagtggtagggatttctgatttgtggcagctcggctgtcgcttgaagcttactcaggccgtagtccctttcatccgggtcgctctcgtgtttcctccatcggcagcacaggtgctggaatatcatggtcatgtggctgaagatgatcagtggtgggggcagaactggcctttcatggaaagtcatgatgagctgatacctctgaaacttccagacttggttggatatcgattttacttcaaaaaatgtattgctaaaatagagaccaaagagaatcaagtgagaaaaacccactgttttctgaagcatcgactccccttcacccctgctgtcctcatccatcccacgtgctccaaaggacccacttacttaaagacagcaatgaggaggttgaccagcaagatgtttgccactaagaggtagcaggccatgatggccggcacgatccaagctcctgtcttgcagggaggcagctggattattttaccatcctctcgggtctcattctgtccacagggagctggagggagcaacacacacaagaaatgagaaactggctatttgagttagaaaaaaaataaaaagatggatttgtaggagggttttagatggaagaaatatatagccatctcaaacagaaaaaagttccaaacaagccaaaattgaaaaatgagagcttcatgaatatctcaaggggctgctactgtggtggtggggggcctcggttccacagtctccccaagttatcacctgaccagaagaggggggtggagccaccttcttgctcacactgccgctaggcccctacaccgggtgaggggcacttggtgctcttctgaagcctgattgagaacttttcttgggtgtgcccagggagaagaaagtcccaccactggcaagttactttcaaaatgtgctgtagaggctgtcagcctgacagctgtaagagcagcagcatctcgggactattgatcgggaattaacaacagggcagctgttaattgctgcaagaaacaacctgggagctccagctaacgatttgctgtctcagtacagaaggaacaacacagggcagtgccttgggaagtatttagagggcttgttgctctctgctcctgatggatgggatttcattaggagggcaatgaggggtgatcggccgtgatcatggagctcatagccacacctgttcttccagcagcatttccattccaaaagtgtgcttttcagggcacaggaaacaaaacctaactgcagtggataaatgggcaaatggggggaaaaaaaaagcctggaggtgggggtgaggaggaaggtgatatgtgggattggctgtgtgtgagtaatgtgctaatgaggcctgcttggaatttccgggtaaatgcaagaaagaaaaaaatccctgacaaagcttcttagtgctgcacagacaatgtggctcaggaagccagatgatgccgtgaggtgccaggcatgggtgaggtagccctcctctccagccccctataatggctttagaacaaggctctttacatctacctgtaaaaggtggttggggggagtgggaggagcaccaagaggtctcagcagttgccacaggctgctttgatgatcggccaggaagatttgaaaagttgacccagaatctactcggctggagtacttggcaagag

SEQ ID NO: 133338 - DNA, 1048 bp, Homo sapiens
ctcaatgaacattagctgagtcatgattggtatttttatttctgtaattgatagactttgagcttctcaggaactatgttttattcccctttgttttgcaatcactaagaatagcgcttactctacaaacatgtattcagtggttataatatgctgaatacagggtatattgggaattagagagatgcttcctgttcttaaagaacttgtaatttggtagagacatagaaagggtacaaagctttgcattattgtgtgatatgagcttggatggggtttctgaggaagcactcacatttgaactgtgatagtccctctagcctggccatacagagcagtctggtagtcaggaccagcctgaggaacattatctagtttctacagcagtaacggcaatatccgtgaattagatgatccttgttaccatgatgatgatggtaaaaatgaatagttaagaaatagccttcatttggtaatatcagcaaagaaagagcattatatgcagcagttaatgcaaaatgttgttctataatggtttctaatgatgtccttgttctgggtagttaccaacctaaaaagtgctatgactcaagcttacagatgtctaccactgatgaagatgaactggtgccttaaaaccctgataagcagcagattccaggatggggaataaattatctggaatgtcatatagcaccaaccagtatctggagatttatgttcccagagaaatgcccccgggacatgcacccaagatggcacatgggtggatgtttaggaaacgtaggctggtgacttcccctgggcctcctccttccttgcttttgggacctgacatttgggtggcttttctctcagtccttttgcaagaggcaaatgcatggtcagtaccacctccataccaagtggcatgttgtcacctccctctttcatggtgacagtcagtacagagtccttctagtggatattgactggttccaactgcccagtgtatatttccccatcctagtttccttttgtggaaccaccccttgtccagtctcagtcc

SEQ ID NO: 133339 - DNA, 1041 bp, Homo sapiens
tagcaggatgtcgcaaatctaggtatgttgtgtgtgtgttgggcaggggggaggtatggggggaagagcgtcctgggggagaagtggggagaattcaattccctgttacttggttccatgttcttcctatcctatatatctagctttacctggaaacaaaaattatttatttgaagagggcttcaaaattctaaccttagtatttcattattttgcatcaggaattaatatcagaaatattttatgcaaatcttgccttggaagaatatatatctaaactagcctattgtacacgccagtgggtttgctgtcatgattaggagatcgattgcattaacagccccaatttctctcccctccctggatccacactgctttgtcatgtgatgttagagtttctatcactaaacaggtgggatctctttcttcacctcttgattctgagtttggccatgtggtttgctttggtgaatggaatgttagcaaatgtgacccacacagaaccttggaaaagcccttaatgtttctgtttccactttttggcttccgccattaccataagagacatgcatgagctagcctgttggagaatgaaacacagggaacctttgcttctaggtgcttgttttctgagctgaggctgttctggaggaggtgatagcccgctgacctcctggcaggtgattgagcccagcccagaccagaagaaccatgcagccaactctcagtcttctgagctcaatacgtgcttatggcgttaagttctgaattctagggtggtttttcctgtatcatttttgtgttgatagatacctgataaacaagctaaatttcccttgccctgctcacagctggaagaggtagccctacgtccttcaggctgacaaagtcctttcctcatttcttcacttctcctttcacccaattcaggctacagatgattggagcagattccaccattgaccaagaaggagtgagttcattgaatggccagtgactaatcagactctttgtgtttagaaataaaacagaagtgcagag

SEQ ID NO: 133340 - DNA, 1544 bp, Homo sapiens
gagtggggatgctaactagtctctgctcctgctcttaataagctatactacctggttatgcaaccctaatccatgtccacagtccagggctcagacggctggcctgtcagcaaaaaaatgtctgaaaaatgttaattcaacaatgttggagggatgttatttccagaactaaactcctcaggggaaatgagaaatcattgctcctgggattcaactcctccacactgaaagatgtttctttaatgatgctttcttcccaaaaaatttcccaatgcctggtgtgtcctgacatttggtcccagtaaaatcctggaacagactcctaggatacaactatcttcaaactccatacaaaaggagtgtttattacagagaatcggcatctattagggcatgaaaccttgggggcttgctggcattcactccccacactgaatcgtttcataatatagatactattttctttttggcatttatagcaagcaactcagtttatgacctaaggcattttccatacttccaggcaatgaataccagcttcctatgagtctcaatagcacataatttaagacagtgggaaagggagttggagaatagtttccagtgcaagaaaaataccatgcagatgtttgcccttactcttgaattctgatggtgaaatcgagcattgtttatttgttctgaagtccaactcaagaaatttattttctaaaggctggggtagaggtagggaggtagtgacataaaatattcctgatactgaaatattcaacacatggccctgggagtttgaatcataaagtaatttagatctttctaagtggttcattgtttgatcaaatttggtataccagatgtcgattcgtgtcacagaacatgacatacctaaagaaatacccaagaactactttgctaaaattgtgtattcaccttctgtaatttttgtttcctccaagatagcaagctaggaatcagtcctctatcttgagccatttattgagaacaaacaaatgaacttggaaaagacataaccgaattgaatttaaatacctgactttggtgtatgagaatcataaacttgcttacggtctatctggtccgcaaacacttccccataaatcatccaatagggcatgtagaagatgttcttggccagtttccatgatggctcctcattgggaaaaaggatggcttgcctggcgaccccaaagctcatcagaaccaccagcataatgatgacaaagtacatcatgtctatcatctggaagggtggggaagcagagggagaaacaagagaaaacccatatgattgagtgttcttataattgctgacaatgatgggaacctttggaggaggtccactttctagactgctgggaagggatgtttagacagggagttgtgtccagataagaagatgcttggtctgttgaagccagtgtccacagaattctatcagtgactcaaaaaacatttcaaaaagtgcacacacagatgaagcctcttcgtttttcattgctgtctgtgggaccgagcataggtcc

SEQ ID NO: 133341 - DNA, 1121 bp, Homo sapiens
atccaatctgattatgtaatcacagaatgcagtaattctcaacagaggccaatttcattccctgagggacacgtggagatgtttagagacttttttgtagtcataactgcgtgtgtgtgtgcacgtgtgcatgctactggcatccactgggtagacactgctaaatatcctatgatacacaggacagcttcctaaaataaggaattatacagcccacgatatcagcagtgtcaaggttgagaaaatgtggcctaattttatagctattatagttctttgctttcattgggtccacttgaaaatacatttgagaatctcatgaaagcttgtcccctctgtccagaaaattcacacacccacacatttttatatataaattgcagagagggtccacagatcctacctcctgagccctatcccttgactctaaatctagactctctgcttttagacaggaattttcaccacaatctcaaattcattgttaaagtgcaaagaagatgatataacaggcagtataatggagtaagatacacatttttttcctagtcaaaaaatccccaattgaactggggttccgttttgggtaagtaactcaagctcatgaattcaagtgttttttctctctagaatgagtttggtgatatttgtcctaaacaatgctggtgttataaataccatttgtacagtagggttaggaatacagcataataactatactcaccaatttttcctttctttcattgtatttaaaaaatgcaatttgaacataatgataacagatataatttgtcaaccaccaactatgagccagacacagctggtcatttagtatgtattatttctaataattacaacaataaccctataagatatgcatttattatacatcactactttagaaacaagtaaaccaagtctcaaaggggtttaaataaattgctcaatgtgttatacccaattcattttgaatttgaattcttcctctctttgcatgagtttgttagtgattttgtaagaaaagtcgtgattatttaagattcatttcagtagagatacacatacatacatacacagagctgttccataaatattgagttagcaatgatacatatagtaaa

SEQ ID NO: 133342 - DNA, 1021 bp, Homo sapiens
gtttgttttctggtctgctgttctccattcttatctgcttctcatcttccatgttagaaatgccacacatcacttctgatcacatcccattggttgaagcacactcacatggccccaacttctctgcaaaggaggctaggatagttagtcttccagtgtataataagagaaaccagtgtggtgagcatgaaatatggtttctgccctaatccttttaatataaaactggtcatgcttgtttggaggggtccagaagagaatgatagtagattcttgtgtttagtggactatatttatctggtactttgtctgtattatttcatgcatcaagaaaagtttagtcatcattgactgtcccaaacatgtcaaacatgggggtggtccttaacagtcgatcatggccatcgatgctcagaatgcagagcaagtgtcctggactcagacaaactgggttcacgtatagattccatgaacttctagcatgtgaccttggccaagatacttagcctctccatacctcagtttcctcaattgtaagatggatgatactgctagtacctgccccattgtggtacttgtgaggattaaagtagttaatatttagaaacatagtaacttctgggccgggcgcggtggctcacgcctgtaatcccagcactttgggaggccgaggcgggcggatcacgaggtcaggagatcgagaccatcctggctaacacagtgaaaccccgtctctactaaaaaatacaaaaaattagctgggcgtggtggcgggcgcccgtagtcccagctacgcgggaggctgaggcaggagaatggtgtgaacccgggaggcggagcttccagtgagccgagatcgcgccactgcactccagcctgggcgacagagcgagactccgtctcaaaaaaagaaaaaaaaaaaaaaaaaaaaaaaaagaaacatagtaacttctatattagttgttattgttgtatgttagatttactgttatatctattttttcatgcttagccaggagga

SEQ ID NO: 133343 - DNA, 1030 bp, Homo sapiens
gactacaggcacctgccaccacccctggctaattttttgtatttttagtagagacagggtttcactgtgttagccaggatggtctcgatctcctaacctcgtgatcctcccaccctggcctcccaaagtgctgggattacaggtgtgagccaccacgctcagccaaaaatatcatcctcttttaactttaattagcagtttttgttgtaattttttatagtcaaaatatgcaaaagcacaatctatatgggatctacaccaactgtgaacaatggctgattatcaaagaatatgagtttatgcacataactagtgcagaggtaaagaattaagtataatttttgatcttaagacgttttaaaattaaaactttaaaaattttaagaaatatttagaaatggttaagaaaatagaagtctaaagagaagttttgtattttatatgtagtgttatgataaaagtgtgctcttgctccaggaaagcaattataaattcatcatgataaaatgaaggcagaatgtttctctgtgccacctgaataacttcaagaatttaatcatgtttatttagcttgataagaaattgtctagccacacatgtgcagccaattttaaaaatcatttccaaataacattatcttgcagtagtgtgctttatgttaagagaaaaaaaaaatggcccacctagaccttattcaccaggaaggatttcttctttgatttctaataaagtccaacagtgttggaaatgtttcactacaaataaatgtaaatctacaactatgtgatcatataaacaaatctatataaatgtgcaccattgtacaaatagaattggatatagagaacacatacatcctgtttatgaaacctttacttcagggctgcatcagtatcttttcaattactttggtaacttaaatatgattaaaaatgttttaagttaatttaaagattcttaaataatacagatccaagaactattcagctatagagacttccattttataatcttaaaggagtaaaaaaaa

SEQ ID NO: 133344 - DNA, 1028 bp, Homo sapiens
cttctgttacctctctgttaattaactcattaacttaagtatccattcattcacctaaaacctcagctttgagcttattgtaggcatgggttatatactgtaaaataaaaaagcttggtccttgcccttttggagtttatgatctaatttaggaaagacagacaataagtagaaaatatatcttaatcataattgggataaataataagaataaaaataatgctgacaaatacccaggcagcgtatgctacttcagaatagcagttctagatgaaatttgaactttcctttgagaaatcactcattaaattgatctgtagtcactgatttgccaagaaaactctatgaaatttaaaactgaggttagaaacctccctagccaaaagaagaaaccaccagagaaaacacattttgtaagagaaaaatataaaggtggtagaatctttaatattataattggcctttattagttttaattttaaagtcttgctttaaaagatttctttctgaccccagagagaagttttctagaccaaagcttaggctactgttgatgcaggagatgcatttgtttattcacccactttcaagatagcagagcttggcaaagactgtagattttggtgcccagtctgaggaacatgagtatgaatacatactcttctggaggtttccagcgtgaacttgaacaggttatttactccttccaagcctcatttttgtaaacattttagtcaaaatacagcacacttgcaaaaagcgcacaaaatatcaatgcatacctcgaagtgttatcaccaaacaagtctgtgttgccaccacccaagccaagacatggacaattgccagcccctcaaaatctcctcttgggcccctccaatctctagtcctctctcctctccagattagccactctcttgaattctaacattaaaatttgatgttgcaccccctctttaaaaactatatttgtatggaataaaatggtatgtattgtttggtgtgtctagctgcttttactgaaccac

SEQ ID NO: 133345 - DNA, 1001 bp, Homo sapiens
taaagtgctaaagtggttttcagatccatggccaggcctctgtggtataaaaataattccccaaggtatggtgttcaatgaaaagtaagtgttaacgtatatataaacaacaaaaatcaatctttcttaagttggggtctggagaaatttagatttcccttttcaatttatttgacttttctctggaagttaatagttaaatttatctagttttattacctttagaactaatgaaacacagttcactggttaaataacataatcatctgccaacataaaggagaaggatcttaccccttacttcattaaccaagacccttcacatagttaacaagaagctggcaatacaatgtacatatgctacttagtctatagagctgacactgaaaagtgaggtggagtcattttctaattttttcattagtatccataaaataaaaatcttcacagaatcaagataaatcacaattacaccattttccagtctattagtcctgccattcccatagaaggaactgatattagtctgataagttttgttcccataaattataatgccagctacataacaaccaaaacaccttttctattagaaaagtctcagaagattacatgcaggatacaaaatgatagtttggcctactaaattcctcagtactaacgaattgtcttcattctcatacaggagagattggtgtagcacttgttcaagtggtagttcatgggtgggtgattaagctaattctgatttttaatgctctttgaacccaaagccagttccaagtagctccagtcctgaggaccagagtctaggctggggcaggtgatgtgtggcccaggaacccttgggtctgcccaaccgtaagcccacatggggctcatgtctataaccaattcagtagtcatatgccttctgatccagtttataaactctgggataactaacaaatataaagatacagaaagagacatacacatgtaccattttccctcaggttttt

SEQ ID NO: 133346 - DNA, 1177 bp, Homo sapiens
acctgtgtaacaaacctgcacatcctgcacgtgtatactggaacttaaagtaaaataaaatatttaaaaaagaaaattcaaagcacaacaaaattaataaaagaggccaatcattaagcaagcaagacgttaatattaagactacaaaacactgaagcaaacgaaagtgtctacaaaggctcaccactgggcttgttcctggtttttcccctggttgcttaaatatcatccttctgcactaggtgcactacatccatatattagagcctgaaaatatatgtacaattgatgtccagatacctatgaattttaatgttgtaataataaactctgaaaaattacattgcaacactgttattttagtgttgtttgcagaaaacacatttcagagggaggcttttgagttctctgtactacctggtcactgtgtcatttcctttttgttttcttaggttttcatgggtcagctccttttacatccaaaagatataaagaagacagggtgcaaagtggtacaatactatattgagggtgctatgacttttgaagagaaggaacgtggtcttcaaaagaaagaattcagaagggctatacaatggccgccttgtcagtattgagaatgagctcaaatttcatcatgattctttggtttcgtatcatttacacagaaaataaaaagggaagataatcagtggaaagtgggcttttctgtagcacgggagagaattagagttggctcaaaggcaggctttggaatacagaaatctgatatgccctgcttgctattttttaggatactgaaagctagtatgattatttcagagttttaagcctgctagaatttgttctgcagatatgtagacatctacattcataagatttataagtaagcactttgaatttgtgagatgctaatatctggggctgggcttgctcctctctgcttttttttttttttctcattagacctctctctaaaactggggaaggcatcttctatgtgaaaatataatttcttgaaagtagagagaagggtcttgaaaacccttctttagatgttttgatagcaaacaattctggcacaaagcgtccccagtgatggaagaaaaactgcctctcatgcactgtcatccttctttgatcttttacctcttttgcagtgtaatctccaaatcaa

SEQ ID NO: 133347 - DNA, 1052 bp, Homo sapiens
tgtgctgtggtcatgggtgttgcctcatttcctgtaaccagtaatggcgtctagggcacatataagtcaggtgctgagtgttaccaacctgacagaatggttgtatttccagaagaatggagaagaaggatgtatgttaggacaaaaaaccagtctccactactgttattaaggtgctccctggggcataattgagctctaagaggaggctgctatgtctccaaagactgatgtgacagaaaagaaatgtattcttttaggacaattgtagcagaaaaattctagtgttaggaaacagaatctcaagttaatggctcatagattggaacaagttgcttcttgaggtttcaaaatttcgtctttgacatgtggtggattgtttactatgcagggtagagggggagcttctggaatgtatagtatgagcctggcaagctaggggctttggctgaaactgcaaacggcaccacggtgattcgaaagctccatcattcttacctatggcttgcaaaagctgactttatatcactgtgtcattgtgtacccacattaaaaacgaaggaacgtctaaggagtatctacaagataaaacatagtttgggaaaattttctcccattcttccaaatacacaaagataatatgtgtttgttattcattttgtctgtaaatggaaaattgatctaaacagtagaaatatgcctaaaagaacaaatatgtacctaacagaatcacagagtacctctgtcttcagatgacttcttcataaagaacgatgctattaggcagattatttttcttagttctttagaattttttttttttaaccaaacttgatgagctgaaaaatgtaatttagtaatgaggggggaattttaatgtttaattttgtactttggaatttccttcttgattttaatcttttattctaattagtttataagagtttcctttgttaaaagacaattttagttacacttggaaaactttagtctggaatttactcccatgttttcagacatgtttccttcaatttttttttctcaatcattac

SEQ ID NO: 133348 - DNA, 1030 bp, Homo sapiens
tttttaataggaagtctaagtgttaatctaaggaacttcttatgctgcattttttattctgttcaacaggtgtgtgcacagtctatatcaggaacatataaaatcttcatataactatgttataagttagagtaaatgattgcaggtttgttacctagaataaaaatgtgggaaaagagcctaagagggtaccatgacaaccagagacatctggaaaagtaactatgtcctcctgtttgctaagggtgatgatggtgctgtagttctctgtagtacttgttaattgaaacattagtaattcagttaaaaaccagttaaggcaaaagcctgtgcttattctcacattgcatggcaagtttgatattgattttcttctaaaaccctaataataagtgcttctagctataatttttaattatcagtgttttaaacaaagatagtgaggttttgtaaatcttagagctaagatggtggttttgaaccaaggtttgattctatagttgttaacaaagagttttgacttcatttgtaagtgagacacccaacttatctatgcaaacaggaggaaggaaatcataatgcttatagcagacatgcttataaaagtttttaatctttaatgtaagattttttctctcccttaaagtgagctgttaaaaaatagcctaacctgtaaagattaaagcagttaatatgattaatgctgttctttatttattcttatgaataaataagatattccataatgtagctgtgaatcttattcattatgtgttgtccccaaaatattgtggtatccatcctgacaaagaaaatatgaggggttcactctgtcttttgaagacaaaatagaaaaatgtggaaaaatttgattaatagtaaaacatgggggctttcataaatcttttttcttttgagaatataaaataattgtttttttaatgtgacatttgttactctcttctctgctttagttggattcttgaaatcacttccagttaaagttattccgagggaatgatatagtcca

SEQ ID NO: 133349 - DNA, 1044 bp, Homo sapiens
agaacaaagttgccccttcctgtctttttctaagtcaactgcagtctccacccatccagtgcgggtaacctaggcttccacacgcagctcggggtggggggaagtgggtcccctggtctggggtcctgggcagggtgaggtgaccgctgggagcgctaccctgcggcgcatcaacagcctcaggcgtgggccctgcactctccagagaaggcggcggctgccgggtggagagcaatttggggacgcaaaagaaagctggctcgggcgcaggtggcgctcgcagccccagcccacagttgagccaatcgcgggcgcaagcgcagcctggtggcggcggcggtaacggagcgcggggctctggcaggagccggcggaggcaaaggcagcgccaaccgagagccgcgcgcaggctggagggagacccgcggcgaggagccagcgagagcgctcggcgctgggctgtttcccggccgagggaggcgaacttctcatggggaagaagtggagggatgcggcggaaatggagcggggctgctccgaccgcgaggacaacgcggagagccgcagacgcagccggagcgccagccggggcaggtttgccgagtcgtggaaaaggttaagttccaagcaggggtccaccaaacgctcgggactcccgtcgcagcagacgccggtgagtggccgggggagagccccagtctttgctttcttttctcccttcgcacgcgacttgagccctttccatggtgctgaacttgcctccctaagggtgagagccagggaacttgtggcgccgcttctaatgaaatagagtgctgggggctgtgaggaagggcgagaaggaacgtcttccctcccttcagcaggggagggtctcctgacgtctctggcggctctgcaaaaattgaaaacatgttcgagaggcgagggggctcgctgttagatcataagagttttgcagttaacagagcgtgtgagacgttgtcgagtgtattgtgactcctgtgtacgttcccaagggtctgtctgtgcagcatgtcgaag

SEQ ID NO: 133350 - DNA, 4085 bp, Homo sapiens
cccaggggttgggaagccctgcactaggtgaacgtacgtaaatgatttggtttatgtatgcgttaccccttgtaagagcaacgtgtgaagcccatggtggtggggtggaagagtgggaattggatggaaaatcatctagacttttttctttttggagttctgcttttatctaatatttctattcagcagtcagttcagaaagatactcagtagaaagatactcatgctgaaggattgaaattggctctgactttctaaatttcacatacaggtccattgttctgttgagcacaagaggagaaataaagcagttaaacatttcacacttactagtacctctgggattagccaaaccagctcatctttatgacaaaggtttgtatttgtattatttcatgaagttcttacagggccagcaacataggtaattttatggtgcaattcagctaccagaccattttcatgagcttgtttgctggagtgggtatcattaagatgatttctaaataagggcacaatgtgagaggaagtgtgttgggatgtggtttgttatctggggcaaaaggtgggtggtgagagttcatttgctgatgtaaggaagtgcagagttttttaatagctgcctttgttttgctcacctccgactcacctcctatattctcttgctggaatgtagctataaaaattgattttttttctttttcttttttttttttttttttagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtattttatatatgtgtgtatgtgaatttatttattatttattttattattattgttattatttttgagatggagtctcgctctgtcacccaggctggagtgaggtgatgcagtctcagctcgctgcaacctccacctcccaggttcaagtgattctcctgcctcagcctcccaagtagctgggattacaggcacccgccaccatgcactgctaatttttgtatttttagtagaagtggggtttcaccgtgttggccaggctggtcttgaactcctgacctcaagtgatactcctgctttggcctcccaaagtgctagcattacaggcatgagccaccgcgcctggcctgtatgtgaatttatatctctatctataaatttaaaattccagattccagctgtaaagaagttactgacggaagtgaggaagacacttggtggacagaatccaccaagtaaatattgtaagagtaagcttcagaagggcagggactgtattctccaaggcagaggttctccatcttggctgcacactggaattacctgaggagctttaaaaaaaaatatagaggcctggactttactcccttccccccagattcagatttaattggtgttgggtgcagcctgagcactggaattttttttaaagctccctggatgattctaatatgcagccaggtttcggaaccacggcactaatataataggcccactgtttaactccagtctgtaatttttttgtgactaaaacaaaattgcatttacctattatttttatttgcatttcctatattactcacaaaactcccagccctaaacaaagcatttctctattgtctctttttaatagaagcttttaatacagtttttagtcctcagtcctctcaaatcattaaattggttctatacactgatatatacatttcagggaattgggagctagcaatctgttctatttctaccaagaaaatatattcaaaggtgatttataagttcataagcattttccatcaggtgaggcagttggttgagctccaaaaatgtggtcgtccacaaatcagccagctgacgagcaacacagagggctctcatgtatccacagactagggtttaagtctttgctgtgattcctgcctctccacctgagtcagcatgccatatattatcttcagaggctggaagagagtgctggcaagaagatgaaaggcagacgcaccatctcatggactatgactgcaaagcagcctctaagctgatgtttagactcggggatgggaagagaggatttatgactcctctgttctctaacttcatcaagagacaacacatcctcatgcc

SEQ ID NO: 133351 - DNA, 1050 bp, Homo sapiens
gagacaggttttggagactgggagtaatttggaggagtacagggaaaagggaagggcattcctgggaagggaacagcatcagcaaaggcagagtggcaaggaagagggtggagtgcttgtgggaaagtgaggccctgcctgagtgtaacagcacagggaaaaataggggcctgtctataaggcacaactctgtttatggaatgccttgcaggtcacaaagaggagttgagacctgctcatgttcaaagttagtaaacgtttcttaacagggtagtccttgttatctacacttctttcctcattcctagagtgactgagggaccatggtctgaaaaaaactttaaaaaatatttgtgcctgtttttccataaaatgtttacaaagatttaaatataaatataaagcacatttatttaatcagttatggaactgaagtgaacaacaagaataatatttatttgaaactgggattgctccagaaaatgaggaacaaatatatacttactgtgttaagaatatcaagatggaattctaggtcatgaaatatgtacaaaaagttcagaataagaaatacaaccactggctttaattataattaactttatattgagggaaccttttggaggaaggtaagagttgccataaatatggaacttcttctctgtctaggtggtgtttactagtgatcctcataaaagttacctccctgtgcaattccagtcacctgataaagcagaaacccagcgtggagacccgtctgttatttctgtaagtaccatctggtgttgtcttagtctgttctaggtggtataacaaaatgccataaactaggtagcttataaacaacagaaattggctgggtgcggtggctcacacctgtgatcccagcactttgggaggccaaggtgggcagatcataaggttagatcgagaccatcctggctaacatggtgaaacgctgtctctactaaaaatacaaaaaattagctgggcgtagaggcgggtgggtgcctgtagtcccagctactcgggaggctgaggcaggagaat

SEQ ID NO: 133352 - DNA, 1074 bp, Homo sapiens
taccaaatcctaaactcaacacattatgtataaagtgttccaaggaatttttgagccaaaccaaatttcatccccccaaattacctatcgaactaattcaaaccagaaatcagctttgatatgttccacaacaatggaagcagggtatgacatatttcctaaagtgttactgcatttgacttaggacccttgaaggatagaaagaaaacagaaataactattcattttgtaatttatgttttaaggaaaagttactaattggaggaatatcccttttggccatgagctgatttgaggaattttgtaagtttttgagaataagtctaactacatggattggtttctgttttgtgcaggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtaaacaaggatgaaaagtggtctgtggccaaggagaaaaagtcagagggtttctttgcaataggagcacttttctttgaaacatctatattgcccatttatggacattgcatggcatctcctgaattttggcccatgctaaaatgtgaagcgcgtaagaagcaaactagttcaaatttatgacagagatacttgcccctgtgatacgtcagtttaccttgaacaactgcagattttccacagtttaaaattagaggttgctatgttggtcctcattttttttctttctcagatgtttgattctgttgcaatatgactgttggatttacatgccagtgatgtaaaaaagatactttgttttgttggcacagtgtgaaatttcttttcaaaaatacagctaatatgaaaattgtttcctttttataaggtggaaatccgctcttatttttgaagcatatgctattatatctatctgtaattaaagtacagactatcaca

SEQ ID NO: 133353 - DNA, 1050 bp, Homo sapiens
ctgggaggcggaggtcacagtgagctgagatcgcgccactgcactccagcctgagtgaaagagcaagactccatctcaaaaacaacaacaacaaaaaaacaaaaacaaaaaaaattgtaaaggctcatatttttgctgtatatctattgatatgagaaatttgagcaacagatgaaggtgggtgatttgttagtatgccatggttcagaacttccactgtcagtggcccaacacacagaagaaatttaaggaggagaaaactatgggcaggaagtggaagaagtggcacatgaaggacagttatctgcatacgctatagtacttaacagataatggctgaagtgtaaactaatttttttatgtttctcctttaaaggaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggtaattcagtgaaaccagggaatgagaattattcctatttttctttaatggtgaaattgctagttcttcagcatcgcggctgtttagtgaagcagctgatgtgggtaattctctgcacatcttctctattagaggtttagaggggaactagaatggctcgtaattatagttggcagtagggatcgagtgaagatgtttgctgtatacgtattgaggcaatttagagaaagaaattatcccttgtcgatgaagaatcagtaggcccagttggaaattacaataattttttcccataataatgttcttcatatgattatttacatgtgatatagttcatatttcagtgaaagctcatttttctcttcctgacttaggctatcttacaagttgaccttgagtttttgaaaatcactgtgtaactgtggaatatttgctttcaactttctctaggctgcatctttccactttttaattccaatcctgttcttctg

SEQ ID NO: 133354 - DNA, 1056 bp, Homo sapiens
atactgctgaatgctttaattccctctagctgggatgggaagtagttttctatgctcttccagtggagcatttgcttacctgaaaaattaaaagatttttgaggctgagtttagacttggcagaagaaagtagtgggatggattagtaatgcctgctaggggcaagaagtgaaagagttgggacatgaaggccaggtatttgctagccctgcctgaaagcactattttatcccttcttgatttctcagttgtctgttctaatcacaggcaatccaaggggctatttttataattgatttattcaagtgtttattgtgtgtaagttgacataaaggtgaatgagagaagtacttgccttctaggagttcagagtagacaggtagaaaaaactcaagtagatagataaaccaaagctattttttagtggacaaatgatagagcaactattaaataattctgcctaagggagttgagccaggctgcagtgaggaatgattctgatgaagcaatctgtcttgttatattaataaaagcacagtgttgggaaagggccagttctcctgggggaaatgatggagtcagtgtgatggggacatagagtgtgtcaggggaaatgacagaaggtgaaacaaggaaggtgggatgggactatttagaaagggaggggtaaaccacatgtatcttatcaatctagatacatgtggctattaacccatgcgactccatgaaactgctgagatatgtacctgaaaaattgaaatggcttgttcacctgagtcgtcatcaagccctgacttgtcagaacactcttaaaacatccagttgaaatgaacatagaaggactagagcatgtaggaattcagctttaagaaagtcacttccaaggatgatgaacatcgtggcagatgcccttgttctgagattgttagggctctggcatgtgctctgagctgaaccgttaccattactgttactgttttcctgtaatccttgctgcggccctctgtgccccacccacacagtcaaccaagccccaaggccagtactcattcctgt

SEQ ID NO: 133355 - DNA, 3381 bp, Homo sapiens
gcgcccggccaggatttaataatagactgtcagaggagataaaggaaatagatgatcagaacatggagacgagaattagaggaagagcaagggattttccacatagaattgggctgtgatagccctaaagacaggaaagaagcccctttctttgatttgctgctagatgttcttttcgtagcatgggctcttcctggggaggatccgtgctgtgctatttcccctctactgagctctgctcactttgccggtcaaaggtgtgttttcgggctcccgcttgtcacttctctgagccccctgaattacatgttgtttccaccacctgagctttcaataattggagcttcttggatcagaattcttctttgttcttctgactttgaattacgacaattaaagcaggtgatttttaaattttaaaacttaaaaagtttagatccttatctatagactaaacaaagggcttaagaggaataaagacgggagagactttctggtttattttagtgggggtattagcttctttattgctatgggatttctcatttccatgagcaaaaataaaaaatactaaaaaaaaaaagtaatacttgcctaagtcccagaagggatggagaattaactacagtagaataaagaagaaaggaacatggtttataatgtgatttattttttccatttatcttattcttaatcagaattgccttccccaaattaagtttacccatcaatgcctaggaactatagacgttctagaactgaaacaaaactagaaaataaaaactaaggccgggcatggtggctcacgcctgtaatcccagcactttgggaggttgaggcaggtggatcacctgcggtctggagttcgagcccagcctggccaacatggtgaaacttcatctctactaaatagaaaaaattagccaggcgtggtggtgggcacgtgtaatcccagctactcgaggggactgaggcaggagaatcgcttgaacccaggggcagagtttgcagtgagctgagatcatgccattgcactccagcctgggcaacaagagcgaaactctgtctcaaaaataataataataataaataaataaataataagcttttagcctttttgtagctacagttttggctaaagttcttgccagccatgagtattcatgcatgtgtgcgtatatctatctgtctgtcttaaagtggcaggtacacactaatgaaaactatattttttaagtgatcataaatgtttctataaatatgtggttatggtagctcttttataaattaccattgcaactaccaatgtgacatatttttcatttattcaacattcactcagtaaagcattcagtcctttgaatatctaatgtatttgagaatattaacctgatctatattacaaatcagagtagtaattctgtttatagatgaagaaagaaataagtcatctaatactcctcagggggcactgggaatcgtaggactatggaccagaaatttactcctgagaatttgaaatttgggccagaagcccagttctgcagccatttgttgttacttagaaatgatgtagtatgccaaaaatgggagcaattggatctcaagatagaatgatcatgatttaactatttgtaaatattttttagtggaatatgtgctttttttttttttcctttttttttgagatggagttttgtttttgttacccaggctggagtgcaatagtgctatcttggctcactgcaacctccacctcccaggttcaagcaattctcctgcctcagcctcccaagtagctgggattacaggcacccgccaccacacctggctaatttttgtatttttaatagagacgggatttcaccatattggtcaggctggtgtcgaactcctgaccgccagggatctgcctgcctcggcctcccaaagtgctgggattacaggcatgagccactgtgcctggccgaatatgtgctttttaatgacctgagggataaaggtactcagggagaaagatggtgatatagggagagttaaggttactaaggcaggggacagatatgcagtgtatgtacagcctcctatatatatatacacacacacatacacatatataaatgtacatgtaaatatacatatacataaatatatataaatatatgttaaacataagtatgtttaaattaatatatattatatattgagtatatatttaaatgaagacaatcaatagtcttaaaaatgtttcctgtctattttaaatctttaagcggtgtcagtagagtattaaataattgaggtagttaaaaaggacataaaattgaggagtcaatatggataagattatagaaatgacagggaaaaatacagaagtattgtagattaaatgtcaatattctgctgctgctttaatattctggagaatttggttacagatactgatttgttttaggagatttgttctaagaattttcctttgtaggatacatttggggatggctttgttttggcatggcaagtagctctaatgccactggaatacattcaggactttcaaatttgtctcagtttaatgttttttcagttgttgcacagtactttataactttttttttttttgaatgggtgaaaaatggctttgtgggctgacgtaggtcatggaaaattgaaagccaaagctctaagatatataagtttttcatctcttggtttagaagaaagtctcttagatttgagtagaggatatcagttttcacattagtttactaatttttttttgtatgtgtgttctttagactgagagatttctttgacaagctgtataagccacagaagttttatattctgatgaataagctggcctgtagtggtggaagcgatgatgaagatcttggctagcagagcacatggtctgtttttaccatttctagtttaagtaggctgcactataagtggctgaggatgtagttggctgctgctcacttagtctggcacagatcacagaatctcccttttcaaagttgagacacttgactttgtgctgaaaatgtctttttagctgtttaaattttcattctcttccctttacttcttgattattttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagtatgtttctgttactgttatttcaaatagttgagcaagtagtaatttagtggagaaaaag

SEQ ID NO: 133356 - DNA, 1034 bp, Homo sapiens
attttttatttcattgagatataatttacatgtagggaaatgcacagatcttacatgtacagtttataatttttaacaaatatatgtgactgcatagtctcccttcccacaactcttctgctttctctccccacaaatgagttttgtctggagaacaggtaatagtttttaagtggggaaaagaagaatacaaataacgatgaagtttaacatttgcccattaaacaccataaggttttgggaaattccccccaaccccagcatgtcattaattgagtagaaaactcaggctgacttgagtgccatagctgacaactatgaactgtaactcagaactgctctaaccttaaagcaatcacaatggacctgcagttgagtcattgcaggggatgctgagatagcaggagccctcactttgtgatgtctttctttttcactgtggtcaggtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtaggcttagcaaatgtataatgctcaagttcctaccagctcctgccagcactgcttctgtgagaagtactcttcagcttttcagtgtgattgacattttccaaagtatgatctatcttcctgtcctgtcctgtcctttcttttctttctttcgattcattaggagtcatggactcctggaatttttcttaaaactccccaactccagatctgtttaagaggtgaaagagtgagtcccagagaggagagctgatttaccctgggttaaatgtggttggaacgtagttgggacaagaacccatgtttcttgactcttaggttttcttgccacactacagctatgccctctaagagggatttttatcctttgct

SEQ ID NO: 133357 - DNA, 1003 bp, Homo sapiens
atttggatccttcctgctattttacttgtctgagggctattcttctgggggactagagaataagaggttgtgaataaagcagaatactgtggcagtgtgatacaaattaggttatttcttttttcttttctttttttttttctttgaggcagggtctcagcctgtcacccaggctgcagtgcactgatgtgaacggtggcaaagtcatggctcactgcagcttcaacctcaattggatggatggctcaagccatcctcccacctcagccccctaagtagctgggtatacaagcatatgccaccacatctggctacttaaaaaaaatttttttttttttttaatagagaaagggcctcattagcctgggctggtctttaactcctggcctcaaatggtcctctcagcttggcctcccaaagtattgggagtgtaggtgtgagccactgcatctggctgaaattgggttatttctgatataaactgttggaaggtttttatgaagattgcagatagactgtaaaaattaccatttacagtacagtagcccacaggaatggttttcttaccaatttcaccagtattacctgtacccataactcacaggacaatctgattacatgcccccaggctttcatcatcttgccagttccatggtggcaatggcacaagacagagaagtctcaggacatctagctgcctgttcccacaggcagccacacctgggaaataagtcatcattctttcattcacatccacccacaaacttaatagttgcccaatttaaaatagagcttgataggtttatcaaagtctatgtctggttttctacaacagcttgggtgtggatcagaggcacaagtacaaattggagtgtcagcttggttggctggttcttttttaggccatgtgactccaggggatgggtaggactaggctggtagatggcacccacataaatcagcaggatgagtcttggatcccctgtccagtacggagacttgc

SEQ ID NO: 133358 - DNA, 1002 bp, Homo sapiens
acgtcttcaaagctttaaggaaactattaactaataattcatatctcagttctgaggcacagtttggacttctcattttacttgtgagaaaaccaggtagaaaaatattcaacagtgtttttaggcctcacatctgagcccatgtcataattctttaagaatcaactcccctagaggagtgctgtcgcagaatgttgggctagaacaaggcagaggaatgggacatacagactgtagctttggggagtggtggcgcagagtgaggactcgggggagagctgtactattttctggaaaaaggtcaccatgcttggcttctcaccccttgtgcttgttgttgtggaatatcgagcactgctatgtgctacactctgtgtggaactcgtgttagcccatagaagccattgggaaaagaacttcatggattttttaattgctaacatgtattaaatgcttatgatatgtcaggccctgttgtaaatatatttatttaatcctcacaaagctcaatgagataggttctgccagcatcctgttttacaaatgagtatcttactaaaggtagagaaggtggaattcaaacccagttaggttgtcttcagtgctgtgctcttcacaattaggctcttgctgctgtttctaaggtgtagattttttaaaaagctgtattggttgtcatatgggctgcaatgtgatggtcgccaaatcaatttcactctgtattttatattgacctccagttttatttcaaaatgctttttgctgtttggtaaggaggattttccaaaatcaaactttctcattatttaatggaaacagctttaatatgatcatatctttacaacttgtattagtccgttttcacactgctgataaagacatacctgagactgggcaatttaaaatcaaaagaaagaggtttattggacttgcagttctacatggctggggaggcctcacaatcatgacagaaggcaatgagagcaagtcacatcttacctg

SEQ ID NO: 133359 - DNA, 1049 bp, Homo sapiens
tgacatacttcctgatctgggtttttttggaaatgatttttatgcaataatattctgcagtgtccattttaattgatttttcaaaaacaaactaagaagatgtaaaagcagttggttctctggaaacttgtggttaaataaatgtaatttcttctttgaatgtttaaaatgtaagtaagttgtatcttaagaatttttcatttgttttggtcaaatttaaattctgcttcttgacacttaaacttataactagctaattcctatggcttttatgttatattttttaaaattctttttttaacccctagatttcgacctcatcaggatgcaaaccccgaaaaaccacgtgttgctgctctaattgacaggctcattgcttttaaaaataatgataatggagcttgggtcagaggaggagatattatcgttcaaaattcagcgtgggtattctctaccaagttattatatgatgacactgatgtattatttttcagattttttttaaagccagtagcatgaaagcacagtgatgattcttggaatcatattattattattaagacaggacaagctctgaggaagtatgctagagttaaaagaccacaaatgtttgaagttgtctcattctggtgcttttattggaacagaacttatccggtgacatgagagtttttgatgaaattgaacagaaaccgggaatttaactttatataacaagcatggtctatgtcagagcgctaaataaaactacctggatcttttcccttcctcttgaaaactccttagtttttctgatgctcttctattgccattcaaaataaaagctttataattccaactcagtaaatctgttgacttatatcttaacatgacttgaggcagtaagtatctcactttttttcccatttgtataattttaggagtggtctcatgcatgttgagctaagatttagtgttcaacagtctagaaaaatgtgtgtgtgtatttttttttctggcactgaaattagcttcttggcatttcacatcatttctgagttttttcatcc

SEQ ID NO: 133360 - DNA, 1096 bp, Homo sapiens
ctttctgctagtttttgtgttagcaacaacaaggatcatatttttcttgttaactaatgtataacactgggtgcctaccagtaagtatttgttgaatgactaaatgagtgaaatgagttaaatgagtagaaaatatccaggaaagtagctgttttttttttttttacagtacctttgctgttgattccctgccccactttttttggtagaagtgataagctaaaatctattttcatgaatcattgtatatgttgttgtaagttgggattcatattcattccagtccattatttatatttttcaggctggcttatttattgacaaaggtgtcaaaacaaccaactctagtgctgctgacccaagggaatacctctgtttggacaatagtgcaaggtaaagctggctcttttaagtcacactcaagctatactttgccaaagcaaaactttctaactggagtttattgtgctctttctgtggtaatacatttaaaataaagttttagaagttcgtaaaagggtttttggaaaaccacttattctgttgtcccaggtcctgtgactggtcttttatcttattgaaatactaaagaggttgatgtttttctcctttttcattgctataaatagatgctagagagagttgcagaaagagaaagaaaaaagaggagatatgttgagaaagtttccaaatttggtgtgcagtatgattcattgaaaaataagttaaactaagatgtttagtctcatccttgaaaaaccaaaccatatagaatttattctttgtggtcaaaatgaatactgcatttaatatttcaaaaggaatgatcccaaatttgatgagcaacctggttctggttcagccctttgtagcctcagatttacatcatagccaggctctaggttactttcttttgtaatcacaaaatgcattaggtatggatcagcatttcagcagagttctcttacatgctatatatgagccaaaataaagaaaatgtcccagatgaaaataaacttttctggaaaagatggtgacttaaagtcatattcagtagaacctgtgtacatattattattttccatacttcaaattg

SEQ ID NO: 133361 - DNA, 1055 bp, Homo sapiens
ttgacatttttcttttcgtgttttaaaccaggagtcttaaagcagattttctggtttttaaaaattgtccctttgcgttgattgcttttggtcacaagtttgagcatgtctctcagatatttagtatcagaaatgtttttaggccgggtgtggtggctcatgcctgtaatccaagcactttaggaggccaaggaggtcagatcacctgagggcaggagtgcgagaccagcttggccaacatggtgaaaccctgtctctactaaaaattaaaaatacaaaaattagctgggtgtggtggtgggcacccgtaatcccagctacttgggaggctaaggcaggagaatcgcttgaaccccagaggtggaggttgtggtgagccgagatcacgccattgcactctagcctaggcgacaagagtgagactctgtctcaaaaaaaaaaaaaaaaaaaaaaaaccagaaaagaaaaagaaataatggtgttttcaaacacattgctgtcaacaaatagacatatagtatataaaatttaaaatctgttggatagtgattctacagctttgatttaatttaggaacgttaagaaatctctgctggctgcggtggctcacacctgtaatcccagcactttgggaggccgaggcaggctgatcacctgagatggggagtttaagaccagcctgaccaacatggagaaaccccatctctactaaaagtacaaaattggccgggcgtggtggcacatgcctataatcccagctactcgggaggctgaggtgggagaattgcttgaacctgggaggcaggaggttgcggtgagccgagattgcgccattgtactccagcctgggtaacaagagcgaaactccatctcaaaaaaaaaaaaaaaaaaaaaaaaaaaatctaactcagttctcaaccttgcctgcacacctggagactttaaaaaatcttgacacctagggtgcaccttagatcaattatgtcaggaagaaggataaaagaaggataagactcccaggctactgaaggttgatgatcactactctaacctct

SEQ ID NO: 133362 - DNA, 2222 bp, Homo sapiens
tcagtacttacttcatcattcactgtgtgcaagaaggaacttgtgaagacctgatcaatgtattatttagcaattttcatttttgatttaccaggatgttgtgaacacatttcttttctaaaacagctttctagtgtgaatcccaagagaatgtataattttgcctcttactattggtttatttccagagtagatgattcagggaaactttttttttttttttttttttttggtgaagtttgtcctgaactagatgctagcaatttagttttgtggtaaaactttaaaatggaaatgtgatgacaaattaaagggtaagatggttctctgctggtgggaaggcgtgggatttccattctaatggcaggaaatcaacatatgttagcacattttttgcagatctgcagtaaataatggtagtgcttagattcggctatattattcctgcattttaatgggttggatggaatatcaatgtgtttatagaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggtaggtaatggttcctgcctatgggaactgcaaggttgctctttaatgtgggggatatttgatgttccttatgtagaagactatttttaggcagaataggctttagtttgtggtgtcactctaaccatggagatttggaaagatcatgagataaaaccagagaatttatccagagataaaaaacatagaatttaagagcttagaccttaggtatcactcaaatcaagacccctgatttatagacaaggaaacagttccagagaggtgatctctcagagctaaatttttgtcacaattctgagagtgattttgtcacaattctgagagttaacatgagtaaacatatacaaaaataagattcagatttgtagactcttagatatttttaagagaaatgatttaacctctaaagtgagtaggttgaaattcacagtcatgggcattgagagtatattaagatatgaactcttcatttttccctttagttttctaagcagattcttagcgaattcttttttccgacctaattgcggaagtgtatttaacttaaggtgaaatctatttccttgtatctcagaaagatgatttagaagttggcttacagggtggtgttccctgcaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggtaggcataccttcttcccagatccctatcagagtccgtgtctgtgtgagaggagagtgagggtggggaaaggagccacagccacagcatgactcaggcatcagaagggccactctaccatttgcatgtctggtagctttgagacatggggctggaggataggacaccacatacaaaagctattttcattggctttggtttacaaagccctttgtgaactggagtgccagacttgtgaaaagttgagagcagaagtgtggtactgaaaaacagtcaggcagtttaaggacaatttgcctctgaagatacttcttcctttcgttaccttctgaagatcatatgaaactcaggctaattgaggcaacttaatgagtttaaaggttagggcagaatttcatgctaagttctaaac

SEQ ID NO: 133363 - DNA, 2424 bp, Homo sapiens
atgggcttgggaagcagttccaaaggaaaagtttcaaatatttttgagtaacaatatatatcctggaagggaagcatcctttaggatatataagttctgacacctttgtctaaaaatcagtcattacttcatagttaaatattatgcagggagattttaatttcttaaatggtattttcttttcaagttaatgatatatcaatattttgaaaagttttgaagaagatggttgcaagtcagccttattggaataccaacaaagaattgcctcataaaagaataccatccatctgtctaaaatcaaaggactcggggctgtgaagagagaagactctaacagcctggactgggtaccatatttgtctacaacagatttttgtcaagttaaatgcttccttaagtggctgtaacagttcagaggcattttactacttataagacttacaaatactttattatttagttttcttgggtgctttcaagggatttttaaaattttaaggttctgggagaggtagtgctagtacttctaagaaaataaacctcaaatgagagagacatgcacattaatatccttatggaccaaacaagtagaccacattatgaacttataacattgatttccattgcatgcggtatgacttcctctctccttttcccagcagaataaccaagttctctgtgctgattcataataaccaagttcactgtgctgattcatacttcccaactcttctgcagtaaagggatgctagaccagtgggaaatcagagctgaagtctatggctttgattggtgttttcatattccatctaaaacagggcattgctgatatggttccttgaaccaacattctttagtttcacattttggcagtgtaaagtgcagatcatcagtggaaagatctggtatgctgaaatatttcagggtcagcttgactgtggttattgctgttacataactttgataatatactcactgctcttcaagtgggtagctgggaaggtggggttggctgagctacttttcagtgctttgtacagactacacattttctcattaagtgcattttactggaaggaaacagactggaatttttggtgatggttctaatgaaccatgctctcctgggaaataattaaaaacaattaagagaaattatataatcattgaagtaggctccagatctcaaaagactggatttccttctttatagctgggtacagtgcttgttataaaactatggagaatttcagctagatgttgtatgggaagagggaggtagaaaagttaaggaatcctcattattaaggcaaaacaaatttaagagtttttttgtttctttgatgggaagaaaagcttaaagattgtttttagtataatagtgatactcattgacttatcagaagcattaaatatcaacagttatgatactgctgtgagaaaaactaattccatgaaataattgccaaggatataactggtgaggctaattgtagctgtggttaataagagaaagcataaacctagggcattgtgagagctcagaaacaggaagatgtttgcattagtgttatgcaagttcaaaatgaggaatcatttttttttctgtatagaacaatatgtttgtgtagcaccctacctctctactttttctcttgttattcctaaacatgtacctgccaccttaatgaaaggaatttcttcctatggtttttcaagcatatcttgcttattcttaccttagctgagtttaaataaagccaccttggaattctgaacaaccaaatggactacttggatctcaagggataattgcattactagtgttctcatgatcctcttatttaaatactgcccatcctttggtgtccagctctcaagtcacctgttcatgaagctgcctcagttactccagccccatgcctcctttgcctgaggtcttttgaacctcgactgactaccatattgttcagtgtttcattatttcatacttggtgttttttccctccaaagcttgcatataaactctgaggaaatgtgagctgattctatgctttataaattttaaaatatctggtacagagtggataaattgatgctccacaaatacttggccataggttgatcaaaattgaaggcgtgattttttttctcccctcttcaaaattatggcggaccttaaagttttcatacattaaatagctatggctattttaattaaatactgttatatttttgttattataatacctattcaagaggcaagttctaattccagtaaaggaacactacaagtcaataatctcattttctaaaaggggaaacttgcgtatcactcagcttgctaagtaatctttggtttctctaacctgtaatttcctcatctctgaaaatgagaagttatgtctttagccacttgcc

SEQ ID NO: 133364 - DNA, 1079 bp, Homo sapiens
ggagttcgagaccagcctaacctacatggagaaacattgtctctacttaaaaaaaaaaaaaaaaattagctgggcgtggtggtgcatgcctctaatcccagctactcgggaggctgaggcaggagaatcacttgaacctgggaggcagaggtggcggtgagccgagatcatgccattgcactccagtgtgggcaacaagagtgaaactccatctcataaataaataaataaaagaaattaaaaaagaatttacacatactgaagcttaatttttttttcttttcacagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatggtaagtgtgtgtatatgcacatagaacatattctagaagacaaaagaggaggaaatagtagaatacttaaaaaaaaatttatcttaagttggccctagctaactaatatgtagttaggtaatacgaggtgtcacttcttatgaatgagagcaattgttcaataatctgttggaaatgattaaatggttgctcttcctgtccattgtgccactttgttgcagcactcagggaggtcttggagtacctcttttggaaatgctttgagggccttcactaaattcttatggtaggtatgatttttggactgctgcaattttttttttctttttttctttttttgaggcagtcttgctctgttgtcctggctggagtgcagtggtgtgttcttggctcactgtaacctccgccccctgggttcaaatgattctcatgcctcagcctcctgagt

SEQ ID NO: 133365 - DNA, 1023 bp, Homo sapiens
ttagcttcaatttgaagagcttagaataatgatactcaaagtgtgacctgccaagatatatttttttaaaatgtaaaatccagggccctgtttgcaccagctgagccagaattatagggcaaagaggccaggaatctaggtttttagcaagcttctctgatgattcttaggcacagtgaaaattgagaacagttggcatagaacagcggctctcacctagatgttcatgagaatcacttggggagcatttaaaagctgcaaatacttagatcccagggacagcaatcctgattgaattgtttagccgtggtgccctgagcattcaccttagcgggtgattacactatgcagccagggttgagaaggagtgacattagaacacaagtaatgaaggtgattgtcaacatggtttattagatcagggatgtaagctgacttgatattttcaagaagtcattatgatggttaccaggggctgggaaaaatggagagttacttaatggatatagagtttttgtttgggatgatgaaaaagttctgaaaatggatagtggtgatggtcacacaactttgtgaatgtacgtaatgccattgaattgtacgcttaacatagttaaaatgtaagtttatggtatatttaacacaatttaaaaagtactttaaaaaaaccatttatgattcatacattccagctggatactggggctcacgcctgtaatcccagcactttgcaaggctgaggtggaagaatcacttgagctccggagtttgagaccagcctaggcaatatagcaggatcccatctctacaaaaaatttaaaaattagccaatcatcgtgggatgtacctgtagtcctggctacccgggaggctcaggcaggaggattgcttgagcccaggagtgcgagactgtagtgatctatgatcatgccactgcacttcagtctgggcaacagagtgagaccctgtctctaaaaaatagaaattaaaggcgagttgcggtggctcacacctgtaatccca

SEQ ID NO: 133366 - DNA, 1077 bp, Homo sapiens
gagaatagctcaattttattaaaatcatgcctctcctttatttatttaattttattttttatttttttagagagtcttactctgtcacccaagctgggctgcagtggttcattcatggctcactgcaaccttgaactactggtctcatgcaatcctcctgcctcactgcctccgcctccggagtagctagggctacaggcatggaaccaccacaaccagctgatttaattttgtgtgtgtgtgtgtgtgtgtgtgtgtgtgtgtgtagagacagggtgtctcactaggttcccaggctggtcttgaattcctggcctcaagcaatcctcccatattgaccccccaaagcactgagattacaggtgtgagccaccttgcttggccaaaatcatgcctctttttataggtaaaaaaaaaaaaaaaaaagcatgatttcctttaatgttattgaaatctcaaaataattgctttctatgtttagttactgtaatttattaccaaataaagtggatgctcttaccaattatacaagtctctctcactttgaactgcttttgaggtaatacaccagttttttttcccaagagaagaatttaatttaaaataacagtgagtttttaaggtatctttttgtgggggcaactgagaattagacaaaagcactagctactttttggaatgcttatgtttttccagcatttgtatttttttttaacagcatttgtatattttaagtagatatgttttcgtagtctgagtcacttctttattatttaatttaatactgcctaaattgcctgtgcaattttctaattgctttgcttacttgcttgcttgattcataaccaagccttttgggctactactttttataatccagtaaataaatactcacaaaacgactctctcaaggaatatctaaataccaaaaattatgttttaaaagctttgtagagtacattgccaattttaatatgaatgacttagattatccccattttggattatctgtcttattttaggtgttgtcacagtctgtagtttgtctaaaaatgtgtcataaaatactcatatgct

SEQ ID NO: 133367 - DNA, 1072 bp, Homo sapiens
ggcagttagaatctggttaaatattttattaggtcaaaagtacaaataattatagtatcatctgttttcatgataattcatgctcactcctctttttactttttgctgcatgtttttactttttgggcatactagtgaatgtgttagatcttctaagatcgtaataaaagaaaaaatgttcttagccaaattttggccagttgtactgaaactctccgaaagcaaaaattgtaacttgacccttaggttgagtattgtttaaaaaattatgtccttgatcaaaaaagaactgacctgattagatcgtgccaacttcttggctcttcccacaagcctgaatcttccattcaaaaattagttttcttaaaaagcctaggcgtgatttgagagagcttaaatgaatcaaaagtattgtattttcattagttgttcaatatgaggggatgatggggccaatatgcatttcttggactgtgtggctgtggcaccttctctgcattgggttggaagggctagattatttgggggactgatgatatagcctagggggcaagtgtcctcaaccaccatgtaagtgataagtacctttgtcttgcatattaacatctcagcagctgaaagaacactaaaatcccttttaaagagctcctactagttttgaactgctgccgctttctctgtgttgagaagcctttctctttgatcacagcattgaatggctgtcaacataacaaaataaagtggagtggaatgtttctttttttctgtgtgcctactgcatttcataatgtgtagttaaaactattacaaaatattgtgaaaggttgaatttatctaggtagtttgctgctctttatctttagaattccttcctgcagttgttaataataccttttagtcacctattagttttcatactagaattgcattttataagaattaacacatagactttttttgctttaagtagtattgttctcaattttctcctgaatcagagaaactgatatagaaattagtcaaattgcccagagcctcaaggatgtcaaagaaggattaaataggaaatttc

SEQ ID NO: 133368 - DNA, 1029 bp, Homo sapiens
ctgggaaataaggaactaagtgtaaaaatagcattagctttacttgtattttctataaacaggatggaaatttaaagtactgtagatgtgcacattttttagaagaagcaagttcctggaaaccctgttcagatttggcttgtgaatcatagaataaaagcatactagaatatgtttgcatgttcttttttttcttcttcaaaacttatggctgtaggtcatgtttgcttgttcttttgttttcctggtacttgctttgggaagcctttaatattggttgtcaggaactatgttcagcaactattttattgcattcctaggatgtgcaaggcactgtactggttgctgtgagcaatacagagataaattaagcatagggtttttattaaaatgtctttaaaaaaagtgaaagactcataaactgtatgtcttaaaacacagaattgctatctcccaacaaatcagtcctttgatctataaggcaaatctgctttgaaattgttaatattagggtaacctagtaaccagatttgtaacaagacatttattttctttacacggtgaaaagtgataaacctttttacatttgttgtatcaagggtccattgtagtttgaacaataagtaaaagttcaatatttgataagaattttatgtgaaaagtttgcctggtagagattgtggcattcttaatcctcatattttttaataaggctttaccactggttagaagtgtcattaggatgttgttgcctgaaagagttgaaatttaagacaatccacattgagcccatgagaaaagaattgacctctgactgagtttcatgtaagtatcttaaaacatatgaatatccactataaatttgatatcgtggtcaggtcagattaagtccccctccagtgtgaaattgttatcgatttgggggctcttacttaattattggtgtgcactttggagacagcaagccttctgttgtcttaatggtctctgtaatggtgattcacttccctgaagaatgaatcatttttt

SEQ ID NO: 133369 - DNA, 1759 bp, Homo sapiens
acatgctttgggcaagtttctgaaattgagaaagacaagccacattttagaaagaggaaacttaggccgggcacaattggctcacgcctgtaatcccagcactttgggaggccgaggcaggtggatcacctgaggtcgggagtttgagaccagcctggccaacatggtaaaaccctatctctactaaaaatacaaaaaaaaattagccaggtgtggtggtgcacgcctgtaatcccagctactcgggaggctgaggaaggagaatcgcttgcacctgggaggtggaggttgcagtgagccgagatcgtgccactacactccaacctaggtgatgggaacgagactccatctgaaaaaaaaaaaaagaaaaaaaagaagaaacaataatcactaccaaattcatggtcttagactcacatggagtgctgtatgtaaatgtgtgcattgtgatgtgtgctctaaaatatgtatgagcattgcatcattcacccacccaccatccattcagctagcacttattaatcacctattgtggtccagaccctctggaagcaattgcaacacctgctttgtggagcattcatgttggtaaagagaaggagttgaagtggttgcaacccgggaggccacagggattgaagatacctgtgtcacttgcaactagagagatgacaatctctgctattgaagaaatgagcctagccccggacataaggaaatgaacaattagaaggtccaataagtgcatgtctgggagaattacgcacagaacgctctaagaagccagagaaggaacagttgggggtgggggagcaattttgtgagaaataaaatttgttaaatcagacaaaatagtagggactgaaaactagtgtcagaagtactatcttaaaatggtgaagattggaggacttgaagtcagacttggatttaaaacaaggcttggcacttgctaaacatttgctgtgggcaaatcccctaatccttctcacgttgtttcttcacctgaaaaaggagttttaaaatgctttatgggaatgttttggggattcaatttgagtaagtttgctatgtattaatatatgataaagtactgtacaggctaatgctgtctggtatcaaaaggtactttcaaaagttttttaaagctataaatagatataaatcatagcttaatcaggtctcagctacagattttcattttattggccctttccagaatgatctgaatcccatcttgagagcaagtctttagacttttaagctagttactgtcatatggtattgctctcttgtccaggcttcttcccatcccagccacaggaaatcttttcatttctcttggattgtgagcattagtgagaagaatgggctgtctagtacagtacatcaattgaaaaggtcttgtctggttttgtacggtaacatccattctcccctctgcctcccaagccaagctagcccttctgttttcctctctctcaatatgatgaatatggaaaaggaaaaaaaaaaaaaggaagaaaagctatgcatctgcctttttgagagtatgaaaatccccattactagttttctccatttgtaaagaggtataattttcatctagattgttaaagtctattctctcaatagcagcagctgctgtctaggcgaatctgttagcaatactcgctttagttctccacttgaaatggacttaagcccatctgacattttaataaattgcctttgatagaaatccaaactcagatattta

SEQ ID NO: 133370 - DNA, 1233 bp, Homo sapiens
ggcggctccgggagagagcgagccgaggcccctgcccccgaggctcggggcaggaggaggaggaggaggaggaggcggaggcggagggaagtgcgcgtcactctcgggaggagagtatttcacctccaggcagaggctgcggctgccagttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaaggtaagaagcgactcggtcacccgcccccccaccccgctccacctcgtttgctgccctcgggggccactgcggggacgcagacccgggtctcgcccaccttttctgctcccggcggcctggccggctccggcgttgggcatttctgccgaaaaggaaaacgtcctcccgcccttcccccgtgcgcctcctttcccggtttcatctctggattgggactgacccgactccccaggagtcagtcctctcttcttaagaaagggtcctcgggaacggtgtcttgatttctttctctccactctctcttttcattacgtttacggggaagggaacaatggacctttcaaagtcggtgcgaacagccttaaactttctggagagggatggggtgaggggataaaccccacagtaagccgattacagtgaaaggttgatggaatgtgctttgcagtccgggcttcagtgcgcgcgcgcttgtgcgtttggggtcatctttgtctccttacaattcccctgggttggtgggtcctccgccctccgccccctgcctctctgttagctgaggtaaggtgaggctttaaaatcgtgtacagcttcctttaaatctggggaatagccttagccctggaccctattcccagcttttctctgcagagttgggagatcctggtaaaggaggggggccctctctgtgaggacccagagtgctgctgttaatagcactagtggctacacccttagcgataaaaccaaggtcctgaattccctggatgctctctgctgagggttgatgagtgtcaccagacttcgacctggagcggaaacagctcacttgaattctccgcaggttaggaaaacagactttgatatatatctccttttatcagcagttgggattaaggatagactgcctaataatttttaaaactttc

SEQ ID NO: 133371 - DNA, 1026 bp, Homo sapiens
gagactcacttgaacccaggaggcggaggttgcagtgagccaagattgtgccattgcactccagcctgggcaacaagagcaaaactctgtctcaaaaaataaataaataaataaataaattactagcacattaataagatttaatatcttttaaagcagatttttaaatgtaaaacttttaatgtcttaatattttatttatctttatgataacacaaaaatatgacatacaggaaactctgtatcttgactaaattcttataatctgtgtcattagtttctcattcaagtgtagtggcagcagagtcactcctttgcattaaccaggaatcaatgaatttagataggagggttttttaaaacagtctaatccattagggataatcccttgaaagtggttgtccagagttgccattcatttagctgccctgaaaaacaagctaataaacagaaaatctcctacttatgactttcctggagcttttccatacttttcagtggtggctgcattgaagtaagttcatctcaccagaccttggagaaggggaaggaaaaacactttgatttacactactttacgaagaaaatatttattctactgtataatgtgatgtaaaatgtacataagtgaacaactgaatagcaattgacttattgatttgaattgatttgacttaatccatacgttgtttatgttttctgattccagcagctaattaatctttttttaaaatgaggttataaagtgctatactagcttgtatagttctgaaaaagaggttttagattggggttttaaaatgctcttcatcaggccgagtgcagtggctgatacctgtaatcccagcactttgggaggccgaggcaggtggatcacaaggtcagcagtttgagaccagtctggccaacatggtgaaaccccgtctctactaaaaatacaaaaattagccgggtgtggtggtgcacaccagtagtcccagctactcaggaggctgaggcatgagaatcacttgaatctgagaggcg

SEQ ID NO: 133372 - DNA, 1052 bp, Homo sapiens
atttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactagaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgattcactgcaacctctgcctcccgggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatt

SEQ ID NO: 133373 - DNA, 1650 bp, Homo sapiens
gtggcgggtggatcacttgaggccaagagttcgagaccagcctggccaacatggtgaaaccccgtctccaccaaaattacaaaaattagccaggcatggtgatgcgtgcctgtaatcccagctactcgagaggctgaggcatgagaatcccttgaacctgggagacagagatggcagtgagccaagatggtgccactgcactccagcctgggcgacagagcgagaccctgtctcaaaaaataaaaataaactgtttgaaaaagataatatacttctttttattttttattcaagttttaattcctctaccgctgaacatctttctgacaacagatagtaaacccaagtatttattcttaccaaatgcagccttagattatttcattgatggttttttcattgtcaacattccattttcattttatgtttattataatacctttctctaaagattcttaaaaagaattgtctgtgtagtttctgtgtcctccaagttgccttttaaaaaagtgtttgttttgattcctctgttatttgaagtgttctcctctcatgtctgataattcttggttgcctgcttatatgtaagtaaaggagctgatcaactctttactcttacatataagcagacaatcaagatttagcagatcaactaaagggctgatctgataataatctccaaagaaggctctttctttctttctttctttctttttttttctgagacagagtctcgctgcgacacccaggctggagtacaatggtgtgatcttggctcactgcaacctctgcctccagggttcaagtgattctcctgcctcagcctcgcgagtagctgggattacaggcatgcgccatcatgcctggctaatttttttttttttttttgtatttttagtagagacggggtttcaccatgttgatcaggctggtctcgaactcctgacctcaggtgatccacccactacggcctcccaaagtgccgagattacaggcatgagccaccgcacctggcccaaagaagactttctaaaagtccctcctggaggacagtggcctgactaccagcattctgggagccacatagggaaaatgggttcatagtagccagtatgtaaatgtatatgtttccattgtctctatgatacctctgttctaaactctggcagtcttctagttcacagacattccagtcttgggggcaggcagtttctgggtatatgaacaggcaaaaggaactgggaaggggaggctaactttcttacacagactttgcaaaaatcctgtatatttcaatcacccccttcatcaccatggtaattccttagctttctggggtattctgttgtataaattggtttcgttcatcactttaccatctatctgcctaaaattgtgttttcttcttttaataaattgtttcacacattaatcttctttccagctccaacattttattatattttagtacattctccttgtttttgtatctttatcctcaaacaagaacaaaaacataaaacattttgctgtcattttagtaggagactaggagaaagaatatagtgagtgcagaaagtgaaattagcgcatacttgaaatggttcttaaattttctcttcttctggacacctaagtttctctgtgcca

SEQ ID NO: 133374 - DNA, 1164 bp, Homo sapiens
actaagcaaagatcaattttaagaaaaatcgtaaaatcataatttgccctttactaaaaccatacatatattcatttcataccataactatatgtaacagttcatcaatatgaccaattttggaaattaaaatgagccactcttgatgtgtggagaaataaataacttttgttacactgaacggaaaataaatatgacctattcattcaacatcagttcattaaaatattagtgatatgccccaagcttagtcagcagtaagctaggttgaaatattatagtgtaataaattatttaataaatttatttcttaagattgaaatcttaaaatacctcagcaattattcttccaaaagatgaagtagagaaacacatgaaataaactgatgatacagactttattgtaatgttaaaactaacagtaatagctaagaaacttaagtttaaaaaatggattagttgacattgtcttattctaagatcaaatcctttggaatgatggaacatttcatatcactccaacttttttggtttttgtttttaacgcctgaactttgtagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaagtaagtagcaatattcaaaatagttaaattccaagaaacttgggaattttttcatcatttaaagtattcatgacacagttcactcaaccataaacttcattttatatatattagcacatagaaattatgaaaaattaatttgtaaagagggtattagcaggtgaccagtcagaaggctgaaatgtttgaggagtagtaatccagatgaaaattgctgagggccttacacctcaggtggtggcactagtattggagacaagggaattaatttgaaacataaatttgacagaactgagtatcagactgggtgtaggatgctaaagagaaaaacttgaacatgactaccatgtttctgccctgaggtgctaatggatagggccatccagtgagacacttgatgttagagaagaacaggtagaagcta

SEQ ID NO: 133375 - DNA, 1576 bp, Homo sapiens
taaaatatttgctatctccttttctttttcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaaggtaaattgtggttggaatttatttttcatactcgtggtggttagctaaaaatatcttgtgtaagaatagaataaaagctgtttttattatacataactgctatatagaggttatatttactattatatacctgtgaataaatattttagacagcaattttaaatttcacataatagcaaaacaaagtttttaaagacagtttcaggtttgtttgtctacattaatacacgtatatatgtatgttttttttaacttaaattcttagctggaagtccatggtgcatgcctatagtcctagttacttaggagacaaagtcaggggaatcacttgaggccaggagtttgaggctgcagtgagctatgatcgtgccactgcactccagcctgagtgacagcgtcagacctcatctcttaaaaagttaaaaaaaaaaaaaaattaaatccagtgacaaatgtttggtttttgtaagctttcttattggagtgtgatataaaaaatgtttattcaaagctgcaacctttcaaggaaatgagagaaaatactgacatagctaattattcacttgatctgtcattaacagtatgaggctggattgctttctattaaaatcttaagccaagatttgcattattttatgtgattacttcttgggaagtacaacttaaagataccttattggaattatttttcaagtattcattctgtaaaactgagattttactttatattctgtgttcctaaaattgggagagattatatcaagtttaaaaaaattttttaggctgggtgcggtggctcacgcctgtagtcctagcactttgggaggctgaggcaggcgaatcacaaggtcaggagttcgagaccagtctggccaacatggtgaaaccccatctctactaaaaatacaaaaaaaaaatgtctgggcgcagtggctcatgcctgtaatcacagcactttgggaggctaaggcaggtagatcacgaggtcaggtattcgagaccagcctggccaagatggtgaaaccccgtctctactaaaaatacgaaaattagccgggcacagtggcgggtgcc

SEQ ID NO: 133376 - DNA, 1613 bp, Homo sapiens
ggaaggtgggggtaatgagataatagccagaagcaggactttacatatataaagggcgttctgatacaaacccctagggtaatggctttccatttttcattagattctataaaaaatacattttgcttcataacctagttcatacacatgcacccaaaaaccaaaataagtctcactaaagagattatctaaattaatcagcatgggcacgggtcaggggagactgtttttgccccctacggaaggaagtacagcttaaacagaggtttaaaaactagtaaaagtttcatttatttgaagggggagtgatgagttggggagattttatcaacaaaaaaggaactatatgtgataaggcacagaagcagaaaagaacctctcttagcgaggaacagcctgttaaattaaataaatgaatcggacagtgctcagaaataaggctagagaccaaggagggtagggggaatcatgtatagcatgccagagaatttagacttatttaagagggcttgaaaggcccattggaacattttaaacaggaaagtgacatcacctggtggcagtgtagagcatggattaggggggtatgaaatagatattagtgagtgattttataacattcattgaaaagtcgttgagctaaaaatgtggctaagaggtttggagagaggtccataggaagtagaccttgattgaatgagaggaatgaagagggggatggggaaagagtgaaatgcaggtggagatatttcagagtctagagtttaaggggagagacctgaaatcttagagatttagatttttagatctaggtaacattgtagtataaagggtagttaaagcattaggtttaggtgcgataaaaagaggaaaacaaaagaccaatctataaaaataaataaataggttaaaaaagagtttgaagaaaccatcagagaaaccaagattgaaggttaatttcaagaaggaaggaaaggacaacgatgttaaatgctataaagtgatcctgtataaattgaagattgaaaaacacctgttatacttcgaaattgttaagaggttgtcagtgatcctacaagttgatgatagatgttatattacaattcattttgggcctgacagggaatattggtaagtgagaagtaaagaggtttgattctgaaaaaagaaaaacaaaaaacaaacaaaaaaaacaactcaggtacagtaggtagaatctagatacagatacatgcaaaaaaaaaaattatttatttatttatttattttgagacagagtctcgctctgtcttccaggctggagtgcagtggcacgatctcggctcactgcaagctccgcctcccgggttcaggccattctcttgcctcagcctcctgagtagctgggactacaggcgcccgctaccatgcccggctaattttttgtattttttttaggagagacggggtttcacagtgttagccaggacggtctcaatctcctgaccttgtgatccacccacctcggcctcccaaagtgctgggattacaggcgtgagccactgcacccagcccatgcaaacattttttaggcaagtgcatgaactctgatgtggaaacagcttcatgctttc

SEQ ID NO: 133377 - DNA, 1008 bp, Homo sapiens
cagtccctgcggtccgtggagcggccggagtcagggggtgggggagggaggaccgaccgacactctaagaaggtctttggtcctcctcggtgaagagaagggttccatttcatttcctttgcttttctctcagtggatgaaaagatggggtcaggttcccattcccctcactggcgcactgagagattcgcgggtgcctaaaagctttctcctgaatgtccttatatctctgtcgggcgcgattttagattgaatctgcacggggcttggcgatttgtgtattccggtggggctgtcgtagggttctttttctttagatggttgggctttaatcttatttgttttcgaactctaaggtaggcttatcaggaatcgtttttgaattggaaaatttaaaggttttgtttgggattttttttaaccccgaaacaaagttatgtcaaattagattgtactgtgtgggggctctcgtgaaggaaagagtgtatttaacctggggtttttgtttaaaaaaaaaaaaagttcagatctttgatctttggtgagatctctgccaatgccagaagagaattttttgtaaatgatgctttaagtcagtgtgaagtagatttggtaagcaaaaggatgaataacggaatacagagggtgacctttaaatttcgctgtttatgaaatgtgttcctgtttaatactttttgtgatatatgatgcttgatctatagatgattcatttggaatttttttatgcctctaataaatctttggagatcttgtgccaacatatgaaactataatacctaatgagtcggagtagaaagccagatacatgttgtaataacgttaatctgtttagattaacagggaaatttacattaaaatgaacttttttccgtaaagagtttctctacatatgtttatagcatgaatttcagttgggtgacatctaatgatagccagtattttgaaaattgtcatgattgctagtattctaatttgagactgctcaac

SEQ ID NO: 133378 - DNA, 1174 bp, Homo sapiens
aggtagtattttattacaggtaatttgcattcttcattaagaatatatattaattttatcccttagatttttatattcttgtcatcaaaatcctctttctgctgtttctaagagtgagaaaatgctctcaactgaagttaggcaggtcacatgtgaatactgagctttaaaccaaatgaatcatggtacaatctaatttcttcctgatgtgagttgactcttgaattcattgttaccataaatagggtattcttgtgacatattaatatgaccagagcgaggcacctatctttgaggaagttagttttaagatggtcattgtcctcttacacctgccccaagtaaatgacttacgaagcagattttttttaaagacaaaatcatttggtttgtggacattaccaattattatgtttgtaagacttaactccatacatccctattaggaaatctcattcttcttttttgtttaatacatgttaaacaatagtccatcagtggtttgtctcttttaagatcactaacttggggcataccgtaccggttggacaagatctcaaatggtgacttaacttttaatgagtgcttataaaaacatgtgtgttgcctcatgacactatgcaattgctgctttagtggtgctttttgcattccagttgaattgtacataggttggcccatattgctcaccatttagttagatcttcattgtttagatctcagtatgttgaaaatctgggaacagcatcatagaaaactatatcctcctctcttagaacattgcttagcaaaaattatgttttgttctctaaatgaacttttccaacttcgaaattttgtgacttttaaataatgtataatactctaatgttattctaggaacaagccagcatgtttggccttatttacaaagcagttaatataccagtgttagaataagtcaaaacactgtaccaatgaaaatgtgtgctcttccaagtagtatatgtgttttattttaatatttagaagatctaaaaagctataggaacacatgttccacttgtaacttaatagcatgccttaaacttaaagatatctttttatggattctgcctctgctgcttctgattaattttgtgacctcaagcaaatctcttaattctttgagccttaggtttctcatctgcaaaac

SEQ ID NO: 133379 - DNA, 1094 bp, Homo sapiens
ggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaa

SEQ ID NO: 133380 - DNA, 1532 bp, Homo sapiens
acaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgcatttacacacctcggtgaggaaactgccagcatcaggacaccccagtgaggctctccctcagcaaaagttcatctttcttcccatagttggcactattctgaattttgatcattattgtcttaatttttttactacccatgtttgtactcctaaacaatataaattagcttggtctgggttttgttgttttttttttttaactcttctttttttattacgtttcttattttatttctttaattttatttattttattaatttatttttctgagacagagtttcactcttgttgcacaggctggagtgcaatggcgcaatctcagctcactgcaacctccacctcctgggttcaagcgattctcctgcctcagcctcccaagtagctgagattacaggtgcccgccaccacgcccagctgatctttgtctttttagtagagacggggtttcaccatgttggccaggctggtcttgaactcctgacctcaggtgatccacctgcctcggcctcccacagtgctgggattacaggtgtgagccaccatgccaggccatattttttattttttattttactttttttttttttgagatggagtctcgctctgttgcccaggtagagtgcagtggcatgatctcggttcactgcagcctccacctcccgggttcaagtg

SEQ ID NO: 133381 - DNA, 1047 bp, Homo sapiens
atgtttctcgtctctgcaacacttgtggctgccagctgacacaaggcaggtgcagtgtgagtggctgccagtggacagtgacaaaaacaagacttactgaaacaaacaagtgtttcataaataatttggaaacaattttggaatccctttcttggtcatggtaatagtacacttcagatcctattaagtgatttatgtgtgggaaatcctcaactggtaatgctggaaatgcttaatgatgctatactactgtccgtaaatgtgagaggatatccaacagaaaatgaaaatcccagaggaagcaagccacagtgaggggccaggctgtctctgcaaggtcatgaacatctgatataaagtttgcattgtagctgtgtggttacacaagcaggtacaactgaaatgggccctaggggatagattagagacaaatcaggaatccacaaaacagctccatagtatgcttggaccagcatctaaccagtcaacctctgtatatttttccagtcatacagcatcctctttttctatgatccacttgtcaagtaaattttgcccacacatgggacatgcttctagtccgaaaaataaatcatgttcttcccagctgtaaactaattgcagagatgactaaaaacatcatggaattgaacttaaagcagcaatttttcttttcttggttcactgctgcattaaggagttggaagctttagaaggagtttcaactcaggagtcactgtcccttgagtgagaccccacctgtatggaggagctggtgattctatatctgcacttaacattgttagtagactgactactatatcttgctatttatattctatttttatatgtagtagatgtgattagttaagtccaaattcaattaaaattatcacagtattcctgaaattatgtatttcctcaatttatgcttaaggttcaatttaactattgtggggctatgatttttttgctgttaaaaaggaattcttggcctggaaatggttgggaattactgagaaaaataccagccttcattgtgctgta

SEQ ID NO: 133382 - DNA, 1048 bp, Homo sapiens
ttataagaaaagaggtataattgactcatggtctgcaggctgtacaggaagcatagtggcatctgcttctggggaggcctctagaagcttctaatcatggtggaaggcaaagtgggagcaggcacattgcctggtgagaacaggagcaagagagagagagagagagacaggtgcctcacttttaaacagccagatcttgcgagaaatcactatgatgaggatgggaccaagaggatgttgctaaactattcctgagaaatccacccccgtgatccgatcacctcccaccaggtcccacctccaacactggagattacacttcaatgtgagattagggtggggccagcatccaaactatatcaactgttaaggaaataaaagctttctgctattttatatgtatgttcctcattcaggttacacagttcttgtgttgtattctgtgtaacgctctcactggctttgttcctgtgaaggccagtggataaaacctcttatgttattcatgaggggtattcatctgccctaaagcagggagctggggaagaggggccaattctcaatcagaaaaccagagctcaggtgattctcagagctcagaggcacaaagaataagcaatattatatgattgggtctagctctgttgtgtgtgtgtttttttccaaatgtgtatgtgtgtgtgtgtatatatatatacacacacacacatacacatttggaaaaaaacacttggaaaaaaacacacacacaacagagctagacccaatcaatatatgggtctatgtatatatacatacacacatatatattatatattttataatatataaaaataatgagaatatatattatatattttataatatataaaaataatgaggatatatatatatcctcattatttttagtaaggtttccttttaaagttctggccctgctcctgaagacataaagaagggccttagatccttgggagcagggttcttacagtgtggtctcagggccagcagcagcagcagcagcatctccctggggactcgggagtaa

SEQ ID NO: 133383 - DNA, 1094 bp, Homo sapiens
ctgttgcccaggccagagtgcagtggcgtgatctcggctcactgcaacctccacctcctggattcgagcaattctcctgcctcagcctcccaagtagctgagatcacaggcatgcaccactacacctggctaatttttgtatttttaatagagacggggtttcaccatgttggtcaggctgatctagaactcctgagctcaggtgatccacccgcctcggcctcccaaagtactgggattacaggtgtgagccactgtgcccggcctcctgtgcttcctttaaaagcccctatgtctcatttctcagaggcctgaaacatacactgaagagtcagagtagcagcatcccagatgctcagcttcttggccccccacgtggttctttcaaaggctggcatttgaggaggagtgaggatcactgcaagttcctctcagccacctgtcagctctggaagcttcagattccttatcagtacagtgggatagccggtaatggctatctcagttgtaaaaagtgtgcttcttggaacttcagaagacgtaactgagtgctcgcaggcaaatgttacatctctcctttgctaatagaatcatttcagtctcttccgtgccacatcctccagatgcccctaatgtattgactgcagagacatttaaataaattaggaggcattaaccactgacatttctatttcagttgcaggaaaaatgtaatcaacaaggaagccaacctagtattcagaggatcaagggaggttcctggatccacaggcccttcgggctgatgtctcataaatagatcacattcaggctaatctcatatcacgttgtctttgggtgtgaaggacttgaaaaaaataaacttgttagctaaataaatcctgaatggataggggcttgagtgggaggtgtcagctgaaaagatgtgatcccatgtctgtaggccatctgtgtgtttcgagggaaattatgactgagaggttgtgagaatgaaaggaagaccatatgacaccgaggtgtctctcttgaaattagatcccacaaaaatccagtatggcctgtgttaaccttgcgggaagagaaatgccacacca

SEQ ID NO: 133384 - DNA, 1051 bp, Homo sapiens
ttgaaagggctatttctcagatgagttggaggtggtgggggagatattgggaatattgaaaaccaaagtcaatttcagatcaaaattccttctacctacaagggtctgaggtttctgaagtgggctaattgacaatagccatcattttgtgatagccaggtcaggcttcgagactgattgatctgccaagcattttagatatgggccactgactcagaaattgcacaaagaatgattgcagcagtgagtagttacaagttcatgcagttgcagaattctcttgacgagagtactcttgaagcactctgatgtgttctttgtgcagcctttgactgaataccattgaatgccacctgacggagagaaaagaggtaaggaaatttcttgggaggtacaacctatgtggcctcagatgctaataggttaaaaagaatactaagcaaaactttagttttatcaaggtacgaatctagcatttccaccattaagaatggttcatttcattattttacctttaagaactcccacttagactattgtagttgggtacattgcatacacaagatttgaaactgtaaaacaaaaaagctttcaaactcagattgtaaaagccatgcaattgccattgactatgtagaatttctgaagtgcaagctgttttgaagcttcctgataatcatcccccagttttatccaggttgtgagttattcaaagggctgaatgtacagaaggatcctttagatgtgttaagggcctctcagaaatggaggtgtatgtatgacctcacttaattccttccctgattaaagaagtaatgcatgatcactgtagaaaacacaaaaaatgcacacaagaacaaaataagtgacagtaacatcctgtaattctaccaccccagtttcagttgtaggtaggaggacaaaaggagctattccccaaagacagcaaaatgtgatgactggaaacttggacaaaatggtgggttttcagctggggatgattttgctctccctttcccagcacatcgggtaatacccagagacattgtta

SEQ ID NO: 133385 - DNA, 3116 bp, Homo sapiens
tgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttgtcactcagcccagtccatcagtttctcagcccagtacttctcagagtgaagaaaaagctcctgaattgcccaaaccaaagaaaaacagatgtttcatgtgcagaaagaaagttggtcttacaggtattacaaaacacaagacaatgtatgttttacttctgcagttaacaaggagcttttggtcactccctaagagactagttggtcttacacataaaaaaaaaaaaaaagcctgactagctgtagtctaggaaaggtggaggaggtggtattggggtggaaagaagttgggttttacttccatttgtctcctaatcatataaaactattaactcaggccctcttattttattagattgataaaaagtttttgtatacctagggaaaatgttactgaactaacagtaagcgccacctactttgagctatgcagggaatgttcttggtgctttttttcttgtctccttcaaatctcagaccttgatggttgttttcacttgaggaagcattacttaagatatggtaggactgtgttttgaatccagcttagcctaactccagagcctgtgtaaattttatcctgcgttgcatctacaggagtcgatagagggagagcatctgggagaaattagctggcagatagcccattttgttttctccacgtggtttggcttaccaaacacttcgctattgcccttgcaaggaaagactgaacatagttatttgaatttctcaccatgtcaaaggaagttaaaagttccttttccaggttaacgtgatagactctgtaagagttgactgtgtcttatcaccaggaagtggaagaaaagagttcactgtcttttatgttacaaagcaatgaaaatctggttccttttctatagtgactaaggcttttttttcttttaattgcctcaagttctcaaatgactctacttcttcgtttgtacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaactt

SEQ ID NO: 133386 - DNA, 5630 bp, Homo sapiens
gtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgagtgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccaggtgagtgggaattcatgccatctcatcacatcatgtgcacctgaaagaactgtattccataggtgtaaaagctctttgttcagaattggaattggagaattgttcagttacactcgggtgtttttttaagctgtaagttagaggaagccataaactttataaaatctgcattctagctatacctgatagagctgacacgtgcatgctcaagttgctaattactttaaaggcaataaatagtaatggtatttttttctaaaatacaaggggaatgcaatacctaatgggaacacacatcccccacttcatcccctaaatcctcactaaatgaggattcttttttacactgtctccactgtgcttagttttttatcaacaaccttgaccattttagctttgactatgctttcatcttctagattgagattgttctgtagtttttcctacattaggaaaaaactagcagccctttttttgttttcttatgttagatatatgaacgctgcatccttagttcttggggttgtgtaggagttggcaggctttgagatataaatagaagctgatttcagaggcccctgttgactaggctttatgtgagagcctccatccagctcagcttgtcacattgcagccttgtgacaggctgaagcgccctcccatgtgatctgagcttctgagaaatattaaagcaagctgtgcacatgtgatggcatttaaaagctggctttctaggggaaaaaaatctaaaagatgggaacccatgtagaagactcatgtcctggtacctcttgtgtgtctcgcagttgaaagttatttataatgaaatgaaggtagacatgttctctgaagcaaagttggaatactttgttatctctgagtgtgtgaaatctttagatggagtatcctccattttatctaaaacaaatattttaagaatcagattaactaaaattacttaggtaggttgatcgcttggccttaaactttaaagccaatgtcacatgagactgggcctcagtgtagaaaatgtaagctagcatacttaaactggttttaaggagtgacccaactttcatgcatagggcaaacattcacacatattttgtgcgtggtgggcatgcaaatacatacatatttatcatttgaaagcattttttgctcctattatgctcatttaaaaacccagctgaaagtgtttattaataaacttcctaagtgatgttgaaatgtttacactaccctgctccaaaatgagtcagctaaattccagttaatatttaaagagacagtgtcaactaaattaatactgttgttaaaagtaagttgtggatcttggtcactccacacaagctagattgtcttaatatttgtatggtgcacttttacttacaaaagggaagataaaatgttttggggaataattaccaggggtctggccaggtcaaaattggttagtccccttctcccatcttctaattttggtagttaatacttgttaaaacatcgttttttaataactcactaaaaagtgtattctagtatgtagttggaaaaaatgactgaccacaagttacagcacacgaattttcctttaagcaaatgctctcaaatatgctttttgtacatatgcttatacatgtttaagatgacatgaaaaccctccacaactttattttaaaataatttttctttaatatgtattttctcatccagaggaaaacttattaataatttagcacagcgttttaacaagacttttagaaaagcaaatcttccttggaaacaaatgcttgctatgtaaagctttttctggtaacccagcattgaatattaaccattactaaaggttatgtgtatatattgactttaatacattgaatttgagcttggaacggttttattattttctggtatgaggaagacaagcacttgttaaaattaatagtgcctttggctgagaaatctggttcataatttgtgtattgcaggttcctaggcactggctttgacatactctgaaacttcaaatggagaacgtaaaaggagtttcgtaaaccagctgaccctaaattcttagagatttacttgttggtgccagggtagcaggaagggctaccagttctcttttcagccttatatgaagatgtttcagcattaaaaagtacagatgctctgcctcagcagatttgtcaaattactgatgaagcccagatatgtacaggtgttttaagaaaactttattcatccagtttaaagaactacctataaatatcaagactcagtgataattgtgattagccaattaagtaaaaacatttgaaatggtctgcctgtagtgcagcagagtgaaaagttaaagataccagtttcccaaattgattaaaacataaccctgagagctaacagaccttttcataaattgaaaccaagaatagtgataggtaaaaataccctaataattgataaaatttctttttgggtttttttttggtcctaaaacagtttgcttttataaaggcaacaaaatattgataattatctctgcccaccctttttaatgattaacggaatttgggcttttgttaaaacttgcgtagcaattacaacggtataccgatgattatattagactatattttggtgataacactaatttctgaaatttcgtttcatctatagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagcttttcagttttcttttttggggttattttgtttcacacttgtgttcattggattgactttttaatattttttgtttggatactcaagtataggattacagcacagtgaatgcttatatcactaacctaattaaatgcaagtatttattactacgtcttgatactaagtgagtttttgtagtgttcattggttccttacaaatcctttttttaaataggaacagctagtggttccaacagtcctacctcagattctgcatctgtacagagagcagacactagcttaaacaactgtgaaggtgctgctggcagcacatctgaaaaatcaaggtaagattgaacgtttcagagtttttatgatattacaaagaagaaatcaagatgtctgtactggtccaataataagttaatagatacccttggctttgcaatcgaggatttcagtgtcttttaatacatgactcttaagtcattgagtaaagatgtgtgttacttacacctgactccctaaccccctcaaggatactgtgttggaaatgctgtgcttttttatttctttgtaattgaggtttagggattgtcgagtgagactgtagaatattattgggccagacaaggtgttttggcagagctgcccttttgcccttaaacaagttacaggcacagctaaaaatccctagctggttgtaaaatatggtaacctatacaaaatgcagcctcgagttcatgagccatttatcaaacttttttctcaaccatttgtgctgggcatccaatttttttttaaactttagattatctagctccatttgctcattttggaaatattctataatttaaagttgaactgacaacttattcattgtctcaagaagtacccttaacacctttaaaaattgtttgcttgaactcaaatagaaatgtgcctgtggctgccttgcctgtaactcagcaaatgacagaaatgagcatttcaagagaggacaaaataactaccccgaaaacagaggtgtcagagccaggtatgtttttcatttaatacttgttcagttctgaatttgatagtgcaagaaatggctggtggggggattctttccttcccattgaaggaccaaagaggagggagagccataaaatataggccaagcaaagaactactatctttaaaagtatcttgagtatgagtatcttgaagtgtaaaatagtcatatttattctcagtttcttctctgctcatcccctgcactacccttgtgcataatgggcaaagtctgtaatctggagattggatgtgttaaaaacttgatgaagttaaatttcaagggtataaggaataattttataaccaaaagcagtaactttagttttgatattgtcaatgttgtggaaaacttttaagtagaacaacatatttgaacactagaacttatttgaagtacaatattcctatcatattttgtgggagtttgaaactcagtgtggaaaggcattttggttttcatgagatatggtgactttggaaactttgcttatatagcacaaccagaagtgccctgatggtggaagaagactgacttgaattacctgtactaggccctagaacaaaaagatttctgtgctttatatagtgcacgtagcttattttatcaatttgttcttttttggcagagtgctgattaaatgcaatataaaacttctgttgtgaaaaaatactgtcagtggttatacagtctgctttggaggctggcttttgctaacagcagtcaagtttgtttattgtattaatcttacaaagttaaggccaaattctcaagtttggcaggtgaatctatatttggcattttgaaatgagctccatccttaaactgaccacattagtttgcccgtgatgcctttgtttgggtttttgtttttggttttggtttttaaatacaaaattactctgaccttggaagaatagtcttgggttagagctagtctgcatttattattacttagta

SEQ ID NO: 133387 - DNA, 1012 bp, Homo sapiens
ctgaaaataaaagtgcaaaataaatatcccatctggaaataaaagtgcaaaataaagagggaggaaaaatcagcccttccatttcttttcctttgtaatgccagttgaattggtttagtgagtagttttgcaagacttgtttcactttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttaaaataagaaggtccgcttattacttttttcatttaaagagggtgtggccacattccttttcttgtaggctctgtgtcatatacagtcttttcaagtgctggct

SEQ ID NO: 133388 - DNA, 1048 bp, Homo sapiens
cctttgagtgcaagatttagctctgggcctcttggaagtgaaggcgatggaaaagttatgacaattaccaaagttcaccatcttataatagtatactgatttctactgttaaatgtaagagaaatttagtgcacaggtctttatataagggaagatccatttgctgtggctcttagaactgctgtaggaagtgctatagttgtcaatcacatgccgtttctaataactgtcaacatttgcaaacatttcgccaaaatatataggaataccaaaatggccaggtaagttacattcctaggagaggatgaagtattcacgttatgattaattgggtatattgctttaaaaggtgtagccaaagttgttattctaaaaaattctttgagtcagttgccttgattttgctaaagctttctaaagaaaaggatgttttgcatgtatcttagtttgaatttaatattcagtgtttcagaaatacaccaagtacagtaagcatgacatgaacaaagttctggacctggagttgaaaggtgacattgagaaatgcctcacagctatcggtatgtagtccagcagttgaaagagttttctaactagaaattgtattttcaaagctatcctatacttaacaagaacaacagcaacaaaaccaataaaagaaaacaaaaaacaatcagaagtagtgcatctgtttcaattgaagcaacgtaaaagattggcaaagtactataaccttaataacaatagatattattccccttttcaaaaatagagagagatagactatacttattgagcacctacttatatcaaacaatgtaccaggctgggcacaccacagaggcaattcagaatggtcactgagagcatgggatctggaataaatgtaacatctggataaatgtaacttcaagtcctggtctactgcttgttaattgtacaatcttgggcaggtccaggagagtctgattcagtgggtccgagttggcctctaaaaatcggtactttttaaagatctcccaggttattcagacaaccatcagggttg

SEQ ID NO: 133389 - DNA, 1036 bp, Homo sapiens
tgaaaaccttgaattctgaaaataagtgtctttctgccctacttatgttctgcatcggctaggatcgtttacctactcctcttcatctgtttcctcacctgtccaatatgataccaatgacagctacatcattgaataggtgtaagaattaaataaggcaataaatatcaaatctactaggttcttttttaatttttttttgtttattaaattcagatgatagtgagataaattaccaggttcttaactggttgtatcattatttgatacatagcaataatatacaatatttcaacttttaaaagttggcttcaaacagctacctagaatttaatatgccttttatatttctgggcctggctttttttttctgcacattgtgaacctgcctgtggttctgttgatcttgcatcttgcctgataatgagctaaccattatcactaaccttagagtcttacatattctatagtctatttcctatctattgctccacactattgcaggcctgttagacatgaaaataaatggtaaaattctgtgatttaacagattaattaaccagatcgaggtgttaaattgaggcaatcatcttcatgtggctaaccctgtatttagtttattaggcaaccagatgccaattggcattccctatcagctagaaaaatacataaacatagcatcttcctggtctctaaatcctgctgttaactaaaacttcattgtaccactgcattaatcaccaagcttgagctgaaacttttgtttttattctggaaagataatttattccaaataatgtttcacttaagggtctaatcgtaagtccaagatgattcagatggtgaagtccagctgtaacaacaacagtatcatccagaaaaataaccacatgtatattgaatcccttgaaagttttccataacagatctgggggtgataaatcatgcaaactcattctataattaactaaagtgtttcttttccttcaccataatccaaaaggattagcccatgacatttagctggataaatcag

SEQ ID NO: 133390 - DNA, 1041 bp, Homo sapiens
tttttaccacgcttgtcctggcagaaacaaatgcacaggttcctgtctccttcgtgtgcacaggaatcctgaggggaaaaaccttcctctatccagccagctcgatcagctgagtcaacccccacctgcagaaggataacaaatgtcacagtcaggttcccatcacatctagaggagtaaacataaactttgaaagcagatctttagaatttgcattcagcatggccactgactggtcaggcacaaatggggaggccatttaactcttggaggctcattcacttcatcctaaaatggggattagcaatatgggatattgcagcgcttgaatatggggatgtattgaaagttctacgaaaattgctatgtactacagaactgcaaattttctcttcccttctatgttcactgcgagcaggtttttttttttttgcggcgcttattggggttgaggggtcttccttctgttttgccaagtgatagctatctagttaactagtgttaagttgcatggagttcatggcttaatttactcacaggccctcccttccaattttgtgcctcaaaagagatcttctggtacagtgtttaacccagggttatttcagtcatggggatttggagcacgttggtagttctagttggagtaagattgcggtgcctttttgtatccatcaaatcactccattattttacacaaacaactggcccacaggattttcttgagatagcccaagtcatttatagtaaatatatctaacattatcattgctaactcattctctgtttcagaaatgaatgaatccaatttcccagtgtaagtgatcagcagtgtttgtgaaataggtaatgtctaagaaaagtctttgaaaatcagaaaaagaagcagagtaccctcaagaagaaaaacaagcaaaggtgaagacagaaagatgagaaggttggagagaggtggtagaaaactaatctgattaggctggggaaatttctcaggagagaaagaagttcccaggtcaattacatttagaaacacttcaaaca

SEQ ID NO: 133391 - DNA, 1049 bp, Homo sapiens
gtaagaatgtgaggaaattgcatatcgaacaactgttccaaaattagcaaattgtagctgaatttgagacggtaattttcactcttcagaatcttttaattgtagatcacaaaaatcttatcttctttgtattaaactattttggtaattcggtcaggtgcccattttcccaatctactaagtatataacttgaggtaaaagtaacaaaagtttcacacatacttcaattactgaagactagacagttttcaaacgtgtttttttccacatcttaactccatggacctcacttttttgaacaaagtatgtggtgccattttggacatttaattaactggcacatcttgtaaagaattcacacatgatctgtagctgttttgagggggttgcacatcagatatcaatgaggggccaatcagccacttgtgcatgtcatttgtacaagtgtgttttcccattcaattttggctccactctaaatgacaacgtcagtgcttgaattttttccacagaaggccaggaagcactgcattccctaagcttgatgtgacaaccttcaaccaaaggctgagcttttgttattaaaaaaaaaaaaaaaaaaaaactgggcctaatgattgcagcaaacagcgttgggattttattgatgtactctatgtgactgtgacagtgttgacatgaaatcaaattcaattagcaggggcttgctaatgacttacactgcttcaaaaactcacaaggacaaagcacttggccagaaatctcccggctactgtctggtttccaactccttttggttgcttctcagagcaataaccaactgccagattgtctccatagattaatgttaaagaacttcactaatgaaactcttgacaacatctgtgtgtgatgagagggaaagggtagggaagggagacggaatttctgtcctcaggtgctcttgaagcaatttctaaaaccactgtggagcacatcgaaagaaacagcaactgtgtctctggaggataacttggctggacagggtatcaaagctgcaaggggaaat

SEQ ID NO: 133392 - DNA, 1015 bp, Homo sapiens
ttctgcctgccgggttcaagcaattctcctgcctcagcctcccaagtagctgggactacaggcacctgccaccatgcctggccaatttttttgtgtatttttagtagagatggggtttcaccgtgttagtaaggctggtctctatctcctgaccttgtgatccgcccaccttggcttcccaaagtgctgggattacaggcatgagccaccatgcctggccgcaagtagtactttttaaactagacaggaactcttttagcacataaagataggcctttggagcaggtgagcctggggaaggatctagagctctgaccctcccttgtccttgctgtctctcaggtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgtgagtatcacaggggctcagtcacccagtctggttgcaggcctgctgaggtctttcatggtcttccctgaccatcagagctcactctcctagtcccctcaagctagcctccttaatactcttcagccaccccccttcccacatgggcatctcccctcctctctccctccatgtatccaatccaaatgacacttcgaggatccactaaagtcttcatccttccatgatccccccaaagatttcttcctctctctcaactgtcatccacaagtctgcactgtctgatatcctgtgttcttccggctgtgggttcaccatggtcaaggtgctcacttatcacctgcacagagtagaggccgaagttggcccctgccttagagcagccagagggattaagttaacatagggaacccgaagccagaagaaagcaggatataagaccgtgcagacttgtgggtgacagttgagagagaggaagaaatgtttgggggatgatggagg

SEQ ID NO: 133393 - DNA, 1052 bp, Homo sapiens
gtacttataacattgcttgacaataaacagtctctctgaggtagatactatttattatttctcattttacaggtgagaaatttgaggcttggagatgaaaaataactggcttaaagatacataggtaggaagtggcagtacaagactttgaaccatgtctgaccacaatgcaatacagtttgtcttctgttctaaagcattcttattaatgtcaacccattcttaaatccttcattacacaaaaaaaatcaagtttttctctttccctctcaatggcatttaccatttgtcttgaattttggatctaatgtcatcaacaacaaaaaatgcaagcaagaaccagttactcaattgcaaaaccaacattctggatgcagtacaaaagttagttaacttaatcactgatactcacatcacaaattgcttactttatttctttaacaatgaaatagtaataacacaataattcagttgtaacaaagccaccaacagagcaaaacaaaaacaaagctaattaagaagcattgcttcagctcaaattagttatctcctttaaacaggaaaaacgaccattagtctactggttctcaaccctgtctgcacatgagaggaatggagggaaacaggacaggtgtttaaaaaaatagttatatccaagacccacctcagaactattaaatgagaatctctcaagagtgaggcccaggcaaagatttttaaagtgctgtcagtgttgaaaactacaggtctaaagtaataaggaataaaaccatgcctcgaagcaattcaaaaccaagaagctgattatacaataaattttttcctctaatcctgggaaaacagggggaagcaggcaccgattcagttttcatttttctttatccatcttcagttgcccatagtagagcttaaccaacatcaaatattggaagctttgcaaacacgctacccaaattgaaattatcactactttacatttagaaagctcttttaaaacaatagcttttacaacaatcccgcccatcttaagtttgcatagatgttcaagtcag

SEQ ID NO: 133394 - DNA, 1115 bp, Homo sapiens
tcacaaattgtaaatattaaaatgcacagatttcatcgagtacatgaagtacttagatgagacaaaatttaaaatgtatatttgttaaaaatacaaaatagaagattacaaaatcttatatgagtttgcctttaaaacaaatttgttttctgaaaaaaacttaattttttctaagctattgatgctctttgatctctcttttttctctaaagcacaatgaagaattttggcagtataataccttccagtactggaggaatcctttgcctcctattgatctggcagacattgaagatttaagtgaagacaccctgacagaagcaacacttcagggcaggaatgaaggggctgaggttgacatggagtcctgatgtaaggagccgaagcagtgggattggctgatttgaggagatgtctctaagtgaattctcgtattcttaagggaaaagttattttccatacttgaagttatatttccaaacctgagaaatgaagaaagattgttctgacattaaatacctacagttactactgaacctcttaataaggatttgtcaaggatagagtacagttgtaggggaagtattttatgtatgcattcttagagcaaaaagttttgtttaaattctagaattgaaggtactgatcttataaaaagaaattctagcagttttagaaataggtgggaaaaactcaaatattcctcctatctgcaccaaaaagtttatttgtggtatataaaatgaatattgttttataataacttgttaataaagtactttctaatacattctattgactctgttagttgaacaaatagctgacttgaacatctatgcaaacttaagatgggcgggattgttgtaaaagctattgttttaaaagagctttctaaatgtaaagtagtgataatttcaatttgggtagcgtgtttgcaaagcttccaatatttgatgttggttaagctctactatgggcaactgaagatggataaagaaaaatgaaaactgaatcggtgcctgcttccccctgttttcccaggattagaggaaaaaatttattgtataatcagcttcttggttttgaattgcttcgaggcatggttttattcctta

SEQ ID NO: 133395 - DNA, 1061 bp, Homo sapiens
actccagccagagtgactctgtctccaaaaagaaactaacaaagactacaatcagtgacctaggttctattagaagaagctagagaaagaagagcaaagtaaatccaaatttagtagaagccaatgaaatgggaaaaagagaaactaagaaaatattccaacaaatgtgatgaatgaaatggacaaattccttgaacaagtggatctggtactacttacaacttagggtaaactaatttcaaattctacttctggggccttaaaaaaaaaagaacccagagcagcaacaaaaactcagaaaatgttatttaaaaagaaaaagaatattgtctacaaaaattataaagtgcctagggataaacttaacaaagatataagctctttatgttgagaaatataaaactttattgaaagatttttaaaaacttaaatagttatattcttgaacaggaaatgagcttggtattgtaaagataataattcttcccaaattgatctataatctcaatgcaattataaccaaaattccaaaagggtaactaaatgttacagaggatgctattatggaagaacaaagggccaagtatagttgacacactcctaaagaacaagatgtcaaagactgctctcaaaactttgatcatcttgatggtggttatggtttcacaggtgtatgaatgtcaaattgtacactttatatgcacattattgtgtgtcatttagacctaggtaaagctgttttaaaaacaaaaacaaaaaaaagcccggcaaaacaagcctgggcaacatagtgagaccttgttgctactaaaaataaaaaattagctgggtgtggtggcacaagccatgggcccagctacttgggaggctgaggcaggaggattgcttgaggccaggaagttgaagctgcagtgagcagtgatcacgccactacattccagcctgggcaacagagcaagacctggtctcagaaaatatattaagctgggtgtggtggctcatgcctgtaatcccaacactttgggaggccagggcaggcagattgtttgagttcaggactt

SEQ ID NO: 133396 - DNA, 1098 bp, Homo sapiens
tatatgactggggacaaaacccaaaaaacaaactggaaccctaccttcaacaagcttactttctagaaagggagacaataagagtaataagtaagtgaaatatataatagattagaaagtaatcatgctatgggaaaagaggggaatcaagagtcaggagaaatgtagagtgagttgcaattttaaataaggtggttaaggtagactcatgagaagtcacatggatctgatgctcagaggagaggtttatctgttaaactggcaataatctgccccaaagtttttgggatcaaatgagatatgtaaaagttctggcaattaaaaaattttaaactacttccccaccctacactgctgtgaggcttcagttagtctgaaacacacaagtttaaagataagcagaataagtttgtgtgtattcctttttcagtaagaagaaaaaaagtttcccttctttgttgttttgttgtaactaatgacttctgagttattatccacaaaattatgggatatgtagaataggtagaagatcctattacatcaataaaaaatgcatttagatagggcagggggaggggtgcaaggtatttatgttttacataaagtggtacaatgttagctcgaactagactgtgaaaaaataaagatgtatatgaacagtccttatggcaaccacattattaattcaaagaggtatagctaagtaaataccaataggttaacttaaaatgaaattcataacgataggaaggaggtagagtaacaagaaaggaaattttgaaagtatttcaaactgaaagataataaaaatacaacataccaaaatttgtaggatgtagcccaagcagtgctacagggaaagttacagctttaagtgtttattttagaaactaacaaagacggctgggcacggtggctcacgcctgtaatcccagcactttgggaggccgaggtgggtggatcacctgaagtcaggagtttgagaccaagctggctagcatggtgaaaccccacctctactaaaaatgcaaaaattagccaggtgcggtggcatgcacctgtagtcccagctactcgggaggctgaggcaggagaatc

SEQ ID NO: 133397 - DNA, 1010 bp, Homo sapiens
taatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatgaaacgatagttgcttggttttcatctaaattaatgtaactatagatgtggggattttaatgagttgagcatatatacttttgaactcttggattagcctatttttatatgcttctaagaagtcagtaacatgaatacttcgccttataatatgccaggccttatactaactattttcactttgtttcattcaagttcactgtaataaagttagaatccattgaggaaaatgaataatcttgattttcagttttgttaaataatggaaaaagaactataaaaggaactagtagaagacagttctaggaccagccatcagtgggatgagcacttagatcttctgggttcattttcctgaatgattgtgatc

SEQ ID NO: 133398 - DNA, 1050 bp, Homo sapiens
cagactctcactgatagaaagtagagtaggctctggggaaaacaaaagggggtcggagggcaggtgtaagagggatattcacaatatgtccttgtgtactgcttcatctttttttaatcatgtgcattactataaagttttgtgatattttggctattgtgtttcagttcatttatttagaagcattccattttagaaacaataggtttgtttttaagaatgacgagaagcaacatattatagtagttcagagctcaagactgcctgagtttgaatctcagttccaccacttactagtgtgactgttctttgtaaagtgagactactaatattaatagtacctctcttatgggggtagttgtatgtaataaatgaatatgcttaaaatagtgcctgccactgatacatatgtgctcagaatttgttagtggtgtggtcatgatgactgtcatagtattatgattattgtttgcattgcaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactt

SEQ ID NO: 133399 - DNA, 12571 bp, Homo sapiens
tcattcatttctcagttggcaactggtgcctgcagtctttctgaaacctgccagaattggtggttaacactagtttaaatttgaatgactattattttgttttaagtgattttaaatgaaggctagaagttgaatagaggataaacaaaactctaacaaataccatttggtaataatatgtagagattagattataatattagtgttattggggatgatttccaaattgattacttaatcagattattgatatcagtatttcccataaatgactgtttggttactgtaattataatgttgatcagaagtttagcttctgtatctctgtcaaatattaatactctgtaaaaggtaactggcagatttaaataattaattaaaagaaaaaagcaaaataacataacagatgcagtaatttgatttttcttcattagatacctgggactgtattgctacctgtttcttcatagacacagctcacaatgtaattgattatattgatacaatatggaaaatactcaagccaggtggaatttggataaatctaggtaagttttttagtatttactaaaattttgtatattaatctgagtacttacagctgtattacatttaacttcacagtctcaaatgtgcatgaacattagaattatgttgtaaatgttttaaaaccactacagtttcctttagactgcatcctggtggtgatccctccaaaggcagtggaagctcagaagttgtatattcacacttaggtcagtctcacagtcattgtaatttcagtgtatactaattgttgatctgatggtaggtaatcattccctcattatcaccatcccacatgctgagacagtggtccgttctgttaggaagagagtgttctctttttctttctataatgaagcatgcggggagattttacctcttccatggaatcttcctccctagtacatccatatactgggaagggtgtaggtgtgataacttctgtgattaccttgagtttaagaaagaatagaaacacaattttttttatgcaaaatttttttttactgcattctacttactactcgatgttagaaattaaatgttgactataacatggtccctccagtccagaatctaaaggaaattgccattttactcctttttaaaataaagggggtataatgataatattcaggtagatatacatgtattctttcgtgagatatataatctgtgttcagaaagacatcatgactagaacataaaggttttcaagataaggattattatactacataaaaggacataacgtacatggtcttgagcccttggccttccgggtgggtctagttttgtgactgatttctgacacctactctctttttaattttaatttaccagaaattttgccatttgggactaagccctggaggtagtagtaagtcttttgcaaacttctcttaagaattccttaggaccagatgaaagcagctgtacaatgcaatcataataaaataaatatcccaaactgtaagtcttctttaaaagtagttaccttgggaaatttttcccaaggaaaaatggaaagatattacctactgggtatttgcttactgtgggttaggtactgtgttggtcccttataaataccttgtggaatctcaaagcagccctatattgaaatggcactatgttatagttgaagagacttagagtcttgggttaaataactagcagaacagtcctgtagcttacatgtggcaaagacaggcttgaagcccagagccaatttcttgattaccctcagttaatttgtaagttagcattaacatgaccctgtgtttatataattaaattttttgacccccattactgagttatggtaaggttttatgtatttccagagcatgtgactttcatagaaacagctttttttttaacatttgttttattggtttatgaatattttattaagttatataatacaataattgtaactacctgaagcacataaagttggctcctgataagtatactgtttgataagagtagatgtactatagtgtgacttatgatctgtcatgggcatcagaagtaatggagcatgttggttaacaggaagtcaattaggagagctaattccattatggagtctcaaaacaattttgaaaattgtaataatggagaaacacagtccttaaaaatagttatttggaaggttagtactttataaagtattaacttacacatcttttgcatgtataagttaaagaatgtaaaaaaaaaagtctcagaatcagctttcttttaaatgttactgtgttctgggcatctaatctgtgtttttcattttttatgccatgtactcatttttgactccatattcctcctacctaatctcatggcttttcctactctttggattcccaatctgtatctctggtccaaacatctctcttgtgctccaagccagtatgtccaacttgggtgtaccacagatacttcaaaatccttgtgtctcaagaccagcctgggcaacatgccctgagaccccatctcaaaaaaaagccaaaacaaaacagaaaatgattccatgcctcccaatatcttttctattaatcatctactcaggttaccctgaagaaaaatactgggagcctttcgttaccccttttattaggtcactcaggctaccataacaataccacagattgggtggcttaaataacaagtttattttctcacagttctgatgactggaattccaggtgctcaccaggttggtgtctagtgagggctcttcctttgatttgcaggggttaccctcttgctgtgtattcacatagcctttctttggttgtgcatagagggagaaggagtgaatgagagcatgagtgagctctttggtgtgtctcttcttataaggacactaatcctattggatgaggaccccacccttacgacctcatttaccttaattacttccttagaagtcctactttcaaatacagccacactggggattagggcttcaacatgtgaatttggaggcagggggacacaaacagtcaataggacctctctttttcctcgctgtttgtctctagtcagtctaaaagttgtatctcctaaagctacttaatcgctcttgaatatccttctattccagggtttctcgattgtggttttgacatttgggctggatcattcttcagtgggagtggtgagggaagtgggggtctgacctgtatagtgtaggatggttaacagccttcctggcctctaagactccagtagtacctcccagttttgacaaccaaaatgtctttagatattgaaaaatgttgccctccgggggtggagggtgttggcagagtcatccccagttgagaaccattgctccaatttcatggtttcttgcctggattagcattaggattactgtagtaatttccttaaggacgcccctgccttcaagttgtcttcggcccttttcatttctccacataatcatcagtgaccttcctaacatgcaaatctgttcctgtaagactccctgcatgaaattctagctttctggaaaacctaaactcttcaggattatgttttttaccttcaggattattttttaccaccccttctctgacctcaagtgccagtcctttgacttagccctttctttctcttctgttttcccttggttagtccttatgtgttcttaaacacttagctcaggtgatcctttcgggttgggttaagtattctgtatttcttatgttctaagagactctgctgtaacatatacttcagtttggtattagcacccatatgcttttgtttccactgctagtctctaagctccataagggcaaagatctaatgcttcctagtcacctggtacaaagcctggcaaacaatgggtattaatgactgttacatgtatgtatgaatgtattgtttcaaaatttgaaaaagggaacatactaagatgtctcgaagagatgatgaagtgccatctatattggtaaattcataacattcttatggttttggctttaattatatagacctggaggcttaatttaccctgtaaactgagagatcaacctcttggggatgattttaccctaaccctgcttaggtagactagaacatcaatatattcatatataatgggaaatgtaatggccagccattctggaacaaatgacattggaggtaaaattatatatgaaaatgttgcccaaactgcatgaaatcagatttggtggggatcattaatttacaaatgctttaattaaggaggatttgatggactctttaacactacccagtttaaggaaagctagtaagccttttaagggaactattatgcatatgtcctttgggtaaggctatgattttggcaaagaacaaaagaatgcctgtgaattccctttttcagtttttcatcctgaccagcactccttaaacacatttatttataatttcttctaaaaagaaagtgtgtgtgtatgtatccactgataaatttgggagtcaggtagtggagggcaggcatttagctacatctggaagaattaataaaatgaatctaactacatctgaagaattaaaatgtaactacatctggtaaaagtaccaaaggagatctttgtaaagtgtactgaaagataggtcttatcagattttagagcattatgaagctacagaatttttttttcttttttttttttagatggagtctcactctgtcacccaggctggagtgcagtggtaccatctcggctcactgcaacctctgtctcctgggttcaagcgattcttatgcctcagcctctcaagtagctggggttacaggcgtgcgccaccacacctggctgttttttgtattttaagtggagatggggtttcaccatgttggccaggctggtcttgaactgccgacctcaggtgatccacctgcctcagcctcccaaagtgctgggattacaagcgtgagccactgtgcctggcctagaattttttaaaacgagattccctttaaaagatagatgactgaacacatacagccctttcctcattatagtagtagtaaaaatataaaaagatataaaacacatggacaaagaatggcaggcatgttactgggggacaaaataatgtgccagtttttagaagttggggtagataggtaagttttgcgaagaaaaacacatgtgagagccaccttacccgaataactctggaaaacgaggtgctgtatggaaaaacctaacttgaaaatctgtatatattgaacagttgactcctctataatcaagatgcctaccttatatgcccatttccactccatgctcaggtgagagaccataagtttaattctctagaaaaagtaaataggaaaggagcaggatttaggaaagcgtgtcctcatatagaatgggggcgaaatgtagggcagaaaagaaggggattaattaaaaactttggaaaatgctcaagcagtgaacgtcagcccaagccatctccaacccctaccctgcctataaaacgtaccaaggtttggccgggcatggtggctcacacctgtaatcccagcactttgggaggtgaggcaggcggatcacgaggtcaagaaattgagaccatcctggccaacatggtgaaaccccgtctctactaaaaatacaaaaattagctgagtgtggtggcgcacacctgtagtcacagctactcgggaggctgaggcaggagaattgcttgaacttgggaggcagaggttgcagtgatctgagattgtgccacttcactccagcctggcgacagagcgagactccctctggaaaaaaaaaaagaaaaaaaaacttaccaaggtttgaattccagatgttttgcacagatgcaagtcacatttcttggagtgggcatgtcaatatcactatatgagcttattttaaaattaataactgtttcttgtatctttttctgtctcttaaatctttatgcctaactttttagatttttcagcctttttgtggcaatctttatgttttaggtgtgtctcttacaaacagcctacagtacatttttactatccagtcaaacaatctttctctcttaaccagaacttttagagccttacaggtgtaaatggtttaaatccgcctgtcacagatttggcaagtggtttggcaaccccctttaagctagttcctgttctttcgacatatccctgtcactgtttggtacctcctttgtgaaacaaccagatattccaagcccatcttgtactttgtctgaccagccattatttccaaggattcctagttccttttaatggggaatggtttgtagaaatggaaaatctagttcctaccaccgaagtggtattttgtctaggcctttttggcaaacagggtaggaaatatatgtatatgtccgtctgtaaaaatcatgtatatgcgtgtatgtaaaaatcatcaaaggagggccttaagaaaaactaaacacacacacatacatacacacaaacatacagacaaaatcgtaagttcatactgataactttagttccaatgcaacactcagtataaaatactaaggtggcaggtagctttcaacacttagaatatatcacacccagtggcctctagtttccgtctttgctgttgagaattcagctttttaaaatgttgctcctctgaaggtattctgtttttttaagatttttaccttgtagttttatcaggtctaatattacatctaggtgtggagttctctttttaatactgtgcacagtttgttaggcttcttaagtctatgaattgaccttatcagttgtgaaaaattctcagctttgcggggggatcccctctcaccaatcataggtttagcattaaaatatgtaacaatagccattatttcttcacatacttcctctgcctcattctttttctctgtttcttctggaaatgcaatcaaatatattttagaacttctcatggtagctttcatatatctcaaccacttctcttgctatctttctcgccatgctgcactctggatagtttcttctgaccgatagtcttttatttgaaaatactgagcatattatttctgataattctgacatctcaagtctttgcaggtcattttctgctttctcttgcttttcttggttcttgttcatgattccttgtttctctgtgctgttgactttgagtgtttattggggattgttcatgagaaatcgcactttggatttcttaaggcctgggttgaagtgtttttccccaaaggaatttgcatttgccacttttaaagcatcagatcttgcaagaactcagtatcctgagaacagcatggggggagccacccctatgatccagtcacctcccaccaggtccctccctccatgtgggattataatttgagatgagatttgggtggaggcacaaaggcaaaccatatcagcagtaaactatatttttagattaaaaaaattctttaaagggggaacaaagagaaaactacccagcaatgaaataggctgtacaacataaatatgcaagttattttaataataaaaaaactggatgacgtagctcatgcctgtaatcctgacaactcctgaggtcaagccaggcagatcacttgaggccaggatttctagaccagcctgggcaacacagcaagacccttcatctctaaaaaaaaagtttaaaaattagccaggtgtagtggcctgtgcctgtagtcccagctacttgggacctgaggtgggaggatcactggagcccagaaattcaaggctgcagtgaactatgcctatgccattgtacttcaacctgggtgacagagcaaaactccaacactcagtaaaaaaatgaaaaaaagaataaatgtaaacaacctatatacagaaaaaaatgttcattctcactgttaagtaaataaacataaatgtgctaccatttttcacctatcatattcactaagtttttaaatttgcttacttaaagcttaggtaagtacagtgagatgggatatgctcttgttctgttagtggggatgtaaaatgatatgactttcttctagaaaaacagtaacatgttataaaatagtgtgtgggaaaaccttaaatattcatacatttagtcaggggttggcaaactacagcccaatttggcctgtagcctatttttgtatggccctaccactacaagtatttcttacattcttaaagggtaatggggaaaaacacaaataagaatatatgctagacactgtaagtgggacacaaagcctcaactatttgccatctgtcctgttacataattaatccactattacctatgtttattagattaattatacttctagaagtctgtcagaggcaaataatcagatatgggcggactaaagactgatgaaatggacagacatactcagcaagaacttagagtgaacttatatttctaacagtaatggagtggacagtcataagacattcatacagtaaaactattttctagaaataatgaaatagagaaatgttcctaatgaagtataagatgtaaaactgtatatggaatatactgtacatcaaggaaagactgcaaggagataaatattcaagtgcttactctgaatgttagacttataggtgattttttaattttttaatgctttttcatgttatctcagcttcctagttttgatcttataatcaaagaaaaaaacatatctttgctccttctgttatggccactaaaagaatatgaagaaagctgcgtgtggtgttgcatgcctgtagtcccagctatttgggagactgaggcaagaggattgcttgagcccaggaattctaatccagcttgggtaatataacaagacactgtctctaaaaaaaaagttaaataattaaaaattaaaaaagaaaaaaagaacgaagagacatgagagttgagaaaataaagaaccctttgaggaatgtgtctctgttattcatcttcatatatatccagtgccagacattagctaggtgcttggtaaacatttgtttaaagaatgggcaactaggtcgtgaatatgaaaaactgctcagcctcaaagagatgcaaattcaaattatatataattttccccatatcaaattagcaaatattttgtttaataaaaattcttgttgtgttttttttttaagttggatttttttggagatataattgacatataataaaattcaccctttttacaaatgtacagtttgatgcattttgaaaactggataattgtgtaaccatggccactatcaagacagggaatcttcccatttccatcaccccaaaatgtccccttgtactccattctctcctcttactcctaataccatgctgtcactactttggattctgttactatagttttcccttttctagaatgtcatataaatagaatcatacagtatgctgctttttgtctctggctttcttagcataacacttttgagattcatcattttgttgcatgtactgttgtggtggtctttttttattgttgactagttttccatttgatatattacattttgtttatccattcactggttggtggacgtttgggttattcccaaattattatgattaagaataaagttgcattaaatatgagtataaatctttgtgtggctgcaaatttccatttatcctgcgtaaatacgtacctaacagaattgctgggtcacatatggtgagtgtatctataacttagaaactggcaaggtgttttccaaagtgactgtactattgcattcccacaatttaatataagatgctgaaataagtacttattgcaattgtgagtgaaaacttataactctttgggaaagcatttttggcattctgaatcaggtcagtaaaaatgtttattctctggccttcaagaaacatctttgtaagggataatctaaaatatgcacaaggatatttgtcaaagtaccattgtattagaagactaaaaatatacactccagctgttgtctttggtaaaatttataaattcagcactaagttaggcattgtggtgggttcaaaagcaacttaagatgtgttccttgacttacataacttgtaatctagtgagaaaactgtgctaattgcctgaaaaattttcactgagcaatgcaacacagcattaaatgagtgttaaaatatgccacattaagaagaatgagcagtagggatgaagacttggatggatttcagcaaggttttgaagcacggctaaagcttgagttggagggttggagctttctaggtggaacacaccatgactagaggtaaaaatggtctaagtatgtaaaaatcattggaatatatgtatgtatgtagagataataaaactatgttattggaggctcttaatggaacaggaacagcataatctttaaaagctggaaagactctgctgtgaggctctgcattcttataaaagctttgggtagtctaggaaacagcagtgctcaggaaatggtagaaaacaatcatttttactggtactaatataacaaatttcagcttgatagagtagtttgataaggaaccattgttatcttttgtaagtagcactaacatatacattatattcatggtcattttttctagtcgtttatgtaggatacagaaaggagagagaaagaaaaacttttttaccctgtgatccacagaatgttaagcctcttggtagcagaacctttgtcttgttattaaatacttctgtcttccatgattagcacattgtatggggagtaggagtagagagctggttgcaggatttataattaacccaatgaaaggtaaagagaagattgtctagattagcctgaggtatatataactgtgttaagtgataatggttcctggatgaggttgatggattgggcaaaatgatagattgaaagatttgaaaatcatgctttaaatcatatgtgcatttcttgaatgtatagaatgagcaaatagtaaagggaggatgtcatataaacagtgtaatacctgccatttacttagtgccttgtttatgacaggtgtaatacatattatctcacattaaagtcatactacagggcacacacggtggctcacgcctgtaatcgcaacactttgggaggccaaggctggtggatcacttgaggtcaggagttcaagaccagcctggccaacatggtgaaacgctgtctctactaaaaatataaaaattagcctggcgtggcgacaggttcctgtaatctcagctattcaggaggctgaggcaggaaaatcacttgaacctgggaggtggaggttgcagtaagcccagatcatgccactgcaccccacccttcctgggcaacagagtgagattgtctcaaaaaaaaaaaaagtcatattgtagatgaagtggagttattgaattgcccacagacacacaattattagatgttagagctgggatatgaacagtgcacttaaaaaaataaaagccagctctaatgttacttcttcctttcaggaaaccttccatataactcctgtccaccttttactacctaggttaacttgaggctcctcctttgttttcatatgatatacagttggtaactgcagttttgcatttgcttatggaattataattgcagaatacatttggaatttgaggacttagcattctctgattcatctactccttcagtaacttgcaagttaaaggtgaaggcccatggtgtgaatcacagtgcaaggcaggtatgccagagggactcactcctcatgagtgtaggcccaactcttgagatactaggccaaattttcagaggtctgggcattttcagcaaatgcccagactttttatgtttgtctcatccagtacctaacttactcaacttggaattcagtgtaacacagctatgagtgtatgtttatattcaagtaattcatagtatctttaaaccataggtcctctgctgtaccactttgaaaatctggcaaatgaactttccatagaattgagctatgaggatataaaaaacgttgttctgcagtatggattcaaggtagaggtaagaatggaataaaatattgccaaagtttaactcccaaagcacctcaacagaagtgttgatatcatggctgttagtgactatttgaattctctgttttcttatctataaagggaagataatacaggttgagtatcccctattcaaaatgcttgggaccagaaatgtttgggattttggatttttttccaattttgcaatatatgcatatacgtgacatatcttgggaggggactgaagtctaaatgtgaaattcatttatgttttatatatgccttataagcatagcccgaaggtaatttgatacaatattttaaaattttgaccacctgccacatgaagtcagatgtggaatttgtcacttgtggcattatgtaggcgctcaaaacattttggattttgaagcgtttcagattttcagattagggatgcttgacctgtgttccttagttttcagaattataaggatttgggataatgtgt

SEQ ID NO: 133400 - DNA, 1143 bp, Homo sapiens
aaatcaagcgtttaaaaagtcttgtcctttattctaaatttaatgagctagttttatcctaagccaaggtttagatcattcattttgatggtagaacataaggcatatgtcagtgtcaatttagaatgttttcaaggtcgtgtacaaggcagtgataggaaataagaagtgtaagatatctacagtcaagaaatttagaatctgttgggcccattaatactaagagataccatgtaaacaaaggttaaatgagtaatgaataccaaaaaaatgaaaggttattagtgtaagaaggaagctgttcatagtgaggctatgacttgaaggttgagagaatagcatttgaggcagacagaagtacaaagatatgaacaaggtgattggggatggcagcacagctgtactggcagggaaagaaaagatttaatgggagatttaatgagatttaataggagctattgctagaaaagtgaatttgttccagatcatggaggacttgtatagtcaggctgcacagttgacttcagcctggcaaactgttgaagaaatctgagctaggcaggagagaaagggagatggtaatagggaaagtggagagggagattggcactaaaaggaaagcaaaatagaataccgagggttcagcaagatcattgagtcaataggtatttgttgagcacctactaagtactaggtatttttctaggtgtcaaaagagaacagtgaacaaaacaaaatccctgtccacagagaacttccaatagagaaagtgaggcaataacaaatacaatattgtaaggaagaaaaaataaggcagggaagacgggttacagagtgactggggagaggctgctgctttatatagagttgtcagggaaagcctttctaagagtagaaactaaaaaaaaaaaatgtctagtagagaaccttgaaagagtacacagacaaaccactgagatatttgaaggcaaaattttgcagatggggaatggcaagggaagaggatcagggagtagagtgagtgcttgctctgctcaaggaggagctaggctgtagtaagcaatgggtacagtggtgagaggtcagcctcgagagggtttgatgaggcaaacttgttggcaggccatagcaaggacttggaat

SEQ ID NO: 133401 - DNA, 1347 bp, Homo sapiens
ctaagatagttgttcagggtgacagctattaggaatatgagtgactttataagtcttgagatgtaaggggactccttttttctgaaaaataatttttgaggggtaaaaccctcatctgatatcggaacatacataataattccttataccttttatttttgatatttagaagtatttcttgattgtgagaagtcagagtcttagcttattcttattgagtaaatgagtaagtttttagttgttaatgtggattttgtcttttcctttttttctttgaggggttggacataattgccttatttcatttcagggatccttctaaagtaaatattctggtacctggtgctggactaggaagactggcctgggaaatagctatgctaggttatgcttgtcaaggaaatgaatggagtttttttatgctcttttcttccaactttgtactcaacaggtatttaatttattttttgctggaaatagtaatttctcagaatcagattgacttacctattttcttgaacaattttgaatttgaagataagtacatagcatttgattattatatatatcacaaatgtgtcttatgttaaaatcaaagtacttacacaaattatcacttgaaccaattgcctagttattagagtgttgaaacaagatgggtaagtgactttatagaaagtgactgggcattccatgaaatgatttctgtacaaaatcttcaggactaagtatgaaccaggaaggagtatttctaaatttattccttaagcttctttacttccttgtttctttagttaaataagagtttagtttagcaattataactttttctccttaatcaagttcttataaaatggccaagtatgctctcatgactgagttggaaagatctctcagaacttctgtggcctcttttggaaggcagtggaaaacaattgttatttttaaagccagaagatgtacattgagtagctgccttgtttaaataatatgttgtctcggatggcagtatgagttttaggggattggtgaaaaagggaaaaaagaagagggttatacaaaaaatagcaaactgttttagttgaaaccagtaccattttaaaaaacctcgttggactgttattacttggttttgaagtttagaaatacatttttaaaaatctgaatgaacagcacatttatatctctgaatttactttttttttctgtctttaatccattgattggttgctcatctacatgtatatgtacattttcagataattagggaagctgtaatagtgactctttaaatattaattatatatgcaaatcttcaattaaacagtatatttttagtatttaaag

SEQ ID NO: 133402 - DNA, 1064 bp, Homo sapiens
tgttgttaacattatgtcacagctttcccttcagggtagcataatttctaactcctgcatggtaatattttactggggtcatcagccatttggaaattgattgctggttatttttatataaagatttaaatactatatgaatttacttccaaatccttttgctttctgttgcatgagtttgatcagataattaaaaaaaaaattctaaactgagaacagccacttgctggggtaagggtagaaatgcatgttatgattggacagatgggaactgagaaaagaaaggtaattctccagagtaggggtttcggtgggtctggtagggagtgagaaatgagagagcgttaggtctgagtaggatgccatcatggcagttcccttatataaggaatagcacagagtcctagagctatgagttttcaaaagccccatagtgttctttcttattttgaagtgggacatgcaaaggttatatgggctactagtaaagtgccctgttgctgcttggagcatgccaaacttaaaggccacatagttaaagataaaaaaatcattagtaggagtagatttggaaattggatttgatttgtgaaccaaatttaggaaatacagtagtgaagtttctttttacttcctgacatgatattagctgattgtatacattttcctttggcttcttataagactacaattttagtttcctcgggattatattgatttgccaaaattcctgagaaaaagccttgttttggtaaaacttttagtggtttgaaagtggaatgatggatcttacgtgaaggaaatatgtaatggcagtgtggtgctagtaggtagagatcagtttggttgtgaacctctggtttggtgtaatatatttgttatcatgtatgtttaattagagggccgtttcccattttccccatgaaaatatcccctcccccaaattcttctgtcaactaaaatatatagggatttagagatatacctgacacattaaactctacatctgtttaatctaacataaacaattgagttacatataaaatttagaaataaagttatgt

SEQ ID NO: 133403 - DNA, 1038 bp, Homo sapiens
gaggttgcagtgagctgagatcatgccattctagcctgggcagcaagagcgaaactccgtctcagaaaaaaaaaaaaaaaaaaaaaaaagaatttcttcctttttttataagagagaaagagttttttttatctcttatactcattttttgattttttaaaaaatttctagcacttacatatacatgcacacccctacacatatactctgtctgtacccaaattccctatctctttgtatacatgatctaccttttgcactacgtgctttaacgtacttttcatggttattttaaaatccctacctaatgattcttacattctgtttgtgcgactgttttcttgaaggcttccttataacaataagttccacattttcttgcttctttgcatgtttcttaattttttttattgaatgccaggcattgtatgtaaaggaatagtagacaataaagtaatattaatgaccagaaaaaaatcatttctccttagtcttattaggccactagtgggctggggggtggggagaagggtggtgctgactgaatcatttaagtgattttaatttgtaatatatttgcatgtattagctgcttctactaatcacttatttgtccataagccttgcatctagaaatatggcaatataggaatattactgctttctgaagtttcatatgcttctcaccttttattttatgtttgatgattttaatatttttcctgcatcagagtagtaggaatatctttgcaacattaagaaatacttggtatgggttacttacttacaccgaaaagaaaaaaaaaatacttgggttgggcatggtggcaaacaccagtagtccctgagtcaggaggactgcttgagcccaggagttcaggggtgtagtgtgctgtgtgctgtgattgcacctctagtaatagccactgcaccccagcctgggcaacattgcaaagacttacctctaaagttaaaaagaaaaaactttttaaaataaggtttttatagttttaattcctaagtttaggtctttgatcc

SEQ ID NO: 133404 - DNA, 1061 bp, Homo sapiens
tcatttttataatctggcacaggctatttgctctactcagaaagttttaacttaaatgttcagtcatttgattaggcttaatagccagagactggatctgttcacttgttttccttttttaagtactaatataactgttgagattttgatgcattttgacataatgttctgttttggaatacagggttagtgacttaaatttttaaaagcaactttactagctagaaattaatttcccttgcttaactcatattttttcagtgtcttgtatctattgctgttcatcttttattgtaagaaattgttttcacttataaatctcaagggactggcagtacatagaaactgaagtcctctttttgtatccacaggatggatacagttgggccactccagtgtgagcctctccatgctgccccatcaatgacctggagggactttcttccctctcttagagaggatgttcggtctccatagcagctcagtttggtcctctcctgagtaaagactgcttaattatatggtggttttatgattaatggaccttaatcttttgagggtagcagtgagaccaccaaactcttttcatttaggatctcaagctgcacttgaaccccagttgaggtgagaggctagtgatttatccactaaaccacctatatagccccttagtagcatgtctatttaaccataatataagtggattactctctcagaagctaattgatgtctgttttttaaacaggggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatggtaaatagtacctcatttttaaccaagtttttaaagtgtatgaacacttgagtttcttgataaaatgtttcacagtctcgcttcattgttatagttgctgtgtgcctgtatgttttacatgtgtaagtgttaacatttgttattggatgctc

SEQ ID NO: 133405 - DNA, 1048 bp, Homo sapiens
cttgagttaaggggcttgtgaaggccaaggttcttgttaagttaattgaagcctcctaggtagcagccctcagagggaagagatactaaatgtcactttttagactttaatgttatcaggctctcagttaatctctcctggatccaggaaaggcctagaaaggaaggcctggttgcattaatggagattcttgacagatgcatatttcccctaggaaacatggctttgtggggccattgaaatccgttggccatgtggcagccatttcaaaatgtcaaatatattttggggtaaaatattctgatttccttctgagtctgctatttgtcataagatgccataccagagtcaggttggaaagtaagtcgtattatatagggttaataaaaacctgtccagtgagatttcgtaattagtaaggcatgactccccaggcctcttagtgaagaacttggagaagagagaaaatataaaaaagatcagcgtttagtcttcacatattattgtatgagctgtaatttactcatttcgctgcattccactgtataactatactgtaatttcttcattctatagtaactatatgataatttctgatagtagacctttgggttgtttccagatattttattccttttttttttttttttttttatgagatggagtctcactctgtcgcccaggctggaacgcagtggtgcaatctcggctcactgcagcctctgcctcccgcgttcaagcgattctcctgcctcagccttccaagtagctgggattactggtgggcgccaccatgcccagccaatttttatattttagtagagatggggtttcaccgtgttggccaggctggtcttgaacttctgacctcaagtgatccgcccacattggcctcccaaagtgccaagggattacagggatgagccactgcgcccacctgtttcttatctctaacagtgctatgacaaagattgttcatgtttcatggggcccatttgcaagagtttctaggatataattgctaggtcataaggcaagtaccatgcta

SEQ ID NO: 133406 - DNA, 2020 bp, Homo sapiens
caccccacctacgagctcctcctccgcctcccaccaaggggccttggccccgcccttggaagcgtggttgtgacgtcagcgcgctgtctccgaagcccggcagcaaatgagcgcagaccgcacgggccctccgcgtaccaaggcacacgcatgcgcattggttctgggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacgggtaaggagcccgtggcggaccccggcccagaccgtcggggcgcccactggtggcggcggacccgccggaacgggggcgctcgccgtcccgccgccacgcctccgaggcgtcgggacccggctgctgcagctgacctccgggccccgagtcacctcgcaccaccccagcccctcccggccctgcacacccgcgtgtccgccgcgccgtctgctgcacagcctcgtgtcttctgacctcaggatcagattagctctcctgcctccgtcctcgtaaaggtttggctttgaggccgatgggggtgaccagagaagcgctgtaacaatttcagatagaagacgatggtggtacaatcgtccactgctgggctgattggtgtgtgtggtcgatgtcctccaaactgaacacacggagagcccaagttcacctacgcgtgggatgctgtaggacgtattttcccaaactgttaccagtgcttgtaagagcagtttaagatttccacccacccctctttggcgctgtgaacgcacttgcacttttgtgtgagcgattgaatgatgctgctcagtgtctttaactggtgggtgattaagggcggaagtggtccggatattctaaaatttgctaattattaggagagatgagagaagtcacaataagagctgcctttacgttctttttttctgcaaatctgtatctaattctccctggtgtgctaggcactgtggtaggacctttatgctcctcattcataaaaacagctccctaacttccacgtttcttctagatagatgttaaagtagcttaatcacaaaattataattccaagagctgaaagggacttaaatcaactggattttcaggtgaagataacacttttattcacgtaagagatatgagtccaccggtgactatgttctgaggctgcagttggaatcagacagacatgacctcctacgcaggtaaacctgttcccataggtgggttcctgctgtgctttatgcaaagtttttttatattgttcatcttatgtattatagttgtttttataaatctcttgctttgctgtgacctcctcaagggcaggggctgagtcttttttatttttatgtcactagtgcttggcatatgttgtttaagctctatttttaacaaaacaaatagtagcaaagaaatacatttctcattcccaaatagtctgtcaagtttttgactgatagttaaattagtttactagtctgaatttagaagcttgcttagtgaaagcttaaagttatttggaatctgattgtatatgtgataggaacttttgaacttcgaagatcttgatgaaataatttactgattaaacccagaaatagggaccagggacagcattactttacggagcccaaaagagaagtttggatattttatttctccaggtttagtagtaacagagggag

SEQ ID NO: 133407 - DNA, 1037 bp, Homo sapiens
cccagaccactgcattgtttaagaagcttcccaggtgatcctgatgtataagtatgttgaagaattactccttaagtgacccttttgggtgaacaccttcagtgcacctaaagtgccgtatgcacaacaccactttctttcttctgtttctttcctcctttcttctttctttctcttctcttttaattaaataattttcacataagccagtgtggatttatctgtaacaatccaatatttttgacctattatagctggctagcatctatttctttctttaatcactattaatttccttttaagttatggtcctgggtgccttggttaaacctattggcatttacaagagatgttgggtgtcaaagtaaacattgtatattaataagcctgttagcatttgaactgctctcttttccccttcgtagtgtacctggatggaacaaaatctgaagaggacctctttttgcaagtatatgaagatctaatacaagaactagcaaagcaaaagtgtaagtattgtgctaacaaagtggatggtagaggagaaacagccaggaaaatcattcattacatatgaaagaatggaataccagaatgctagtgtaggagtgattgtgctcatccattctttgctttgaggataattcagaatcagaaattctgggggggggtttggagactcaattattttgtctgtttttaggggtaaaaccatgtaccctttgttacatctcttaatgctatttatgtgatttactttaaaacttttagtagatggctgtaccaaatgggactggaagtatcctttgggcacagtataattaaaatgctgatgattttttttagtatgtccagagctccccttttcttttattcccttaaagactttctgtaaaatttctactttccaaatacctcaaagataaacaaaagattttaaaaagtattatgaagtgtttgtttaaggttttcatattggacggcactgtttgcaagtgacagggatctgcctaaatatggctacagcagaaagacag

SEQ ID NO: 133408 - DNA, 1060 bp, Homo sapiens
aatcaagtcaaaagagcacagaattgataaacaaggctcctgagttttaatcctctttcttccatttcctaataacacttcctactgattctaggacagcagcgaacatgccttctttaagaggcaggtagctatgctgattgttctttctgaatacaggaagcaaaatactcccctcatccgatcctacataaatacacacaagagaaccaaaattattttcaggtatctttaaagcagagtgatctacaaaatgtaaaaatgaacatcaaatgcttccttttgcatttttgtgactttgtttattaaatacttgagtaatatcaagtgtgcatttaactcaggtatgcgggtttgtttgtttttgtttatacttccagttaattactatgttattgccttattgcttggcttggtttccctaaacacataattcagcttcatttaatgcaagaactatccatttgattttctgttactttttatccacattaagtaaaggaaactgtgttgaatgccctggtactcctgaagctgggggactgtggtgaatgagtggcttcagtaaatcatttgtgtggcaattccacattgggttaacactttttattttcaatctagtggctgagcaggcagaatccattgacaatccattgcatgaagcagcaaaaagaggtaggtgtgattctttttgactgaggtatgcagtacagtaaaaggcacggatttcaattagctttgacaagtgcatacacccacgtaaccaacacccagatcaagatctagaacatttctgccatcctagaaagttccctttgcaccttctcagttaaatccctgccttacagtctgtcccaacatctactaccctagagaagtgtgattttagttttaaaatgtcagtcaagaaacactgttgtggggagatgcaagtcgaaagacatggtctgtgacttccaaagcacaacatctggcaggggagagagagatgtaacagatcattaaaatatggtatgataagtacagcaattgaaatgtgtttgacaggccgtagaggccc

SEQ ID NO: 133409 - DNA, 1017 bp, Homo sapiens
tattgggtcatctggcagcaagagaaggggaagaggttctgagattctactttttatgagtactttaaaccaatatctctgttttcccacccatgcctcatgcctgccctagcacctccaggaatctccaattcctaatttttgccaggcttctgcatgttcaaatctgcttccttcctcctggatctccctccgcaggcatgtgcttttcagctcgtgctccaccaagtcagcttgtactcctccatcctattccatctcccaaaaatgactcctctcccatctcttgagtctcctttccttttctctttggaattttatgtggttctataactttgttcccattttaggtttaacttttaggtttaactgggttaaacctgaattaacatgtactttcaatccaccctctatcttaaaaatggtactttctctttttatcactatagaacaagttgggagatacagctttgcatgctgctgcctggaagggttatgcagatatcgtccagttgcttctggcaaaaggtaaagtttgtgctgagtttatctggtctttgcttgccctgaaaaatagtctatatcaacttacgccatttgaaatggtaggaagaataatagtcttatttcaaaatagggtttaacctttgctctgcctgtgtatcatggaatagttatgataaaataaaattattgggggttggtttgtgttagtttttaatataaactaaaaccatggcaagctttaacattacatatattacttttagtaagaactgtattgtatgtttctgcaggattatagagccttagaaacaaagaatgtatgtgtacacgtgtgttggggagatcctgtctgagaaagctgtataggtaaagttgctgaggcccctgttctcacagggaagtcttgacagataagcaagaatgatgcggctgcaatgtcctgctttgagctgagcaggtgctagatgtaaagtgaacgagagaggatatcttgatcccctgtttttataa

SEQ ID NO: 133410 - DNA, 1057 bp, Homo sapiens
gcaggaggttcacttgagcccaggagttggagaccagcctgagcaataaagtgagacctctgtctctacaaaaagtaccaaaaattagtcagacattgtggtgtgggcctgtagtcccagctactcaggaggctgagctgggggatcacttgagccctgggaggttgaggctgcagtgagctgtgatcgcaccactgcattccagcctgggtgagagcaagaccatatctcaaaaaaagaaaaccaaaaaaaaaaaaaaaaaaaaaaaaaaagataaactcttcagatgattctgaagtttgtttcaatatccttgatcttaatgagaacccccaaaataggacaccctcaattaaacagaaattagacaagaaacataatcttttacctttattgtgtgtttcttttattccttgcaattaagttctaatcaccctgctttccattacagtccttttcagagaacgatcatcttcattccctcatttaaatatgtatttatgagtgattaccactaaatatttttaaaaataacatttaatagctccatgattatattttatttctgttttaaatgaggatatcagtaaactgtaatcaaatttattctagactttgctaaatcttctggactttattcatagtattatgggtggttttttaaaatagagtttaaatgtacattattattatttttttagatggagtcttactctgttgctcagcctggagtgcaggtgtgcaatcatagctcactgcagcctcaaactcctaggctcacgtgatcctcccatctcagcttcctgagaaaatgggactacaggcatgtgtcatcatgcccagctaattttttttttaatgtagagataggggtcttgccatgttgtccaggttggtctcgaactcatggactcaagccatcctcctgcctcagcctcccaaagcactgggattacaggcgagagccgctgtgcccagcctccttttgttctttattctagatatgtctttgttccagatttcttttctttttttaacttcagtttgaatatagtgt

SEQ ID NO: 133411 - DNA, 1002 bp, Homo sapiens
ccctaaagaaatatttaatgaagcaggttttactcccaagtttccaaaatttcctactctgtacacattagagtatgagtaagtataagagaaggaaagcttagatcagcacctattcattttgctttgagtttacattgctaagttcagcagttctctcagagagtctgagagctcctcacttctgtgtaaccatgaaaataaatgcatcccttggaagggtcaggggatgtggtcttacctgagtctgggagctcgatgtgtacatggaggtaagtaacttcacaattcccaggcagtgctgctgtgtctgtcgccagtggccagcggcttgggtttcccagcaggctcagccctgtgggcaactgggagccacagggaggccaggttcctcgcggtgcccggaaaagaacactgaggaaatccaaaggtatacattagacagcctgacaggaagcaggaaggaaagtggaaggaatagacaaggagtgaagaggctgagcctcaaaggaaaaatggttaccttttctaaatgacccatagttctgacagaaattagtagaatgcttcgagaagtggtgaggggtatgggctttggaatcacactgtctggattcaagcctgattctgctgagtgacctgcgacaggttacctaaacacccagattccctagctgtgcagtggaggaagtggtagtatctactgcctagagttagaaggattaaataaaatcatatatgcaaatgacttagttcctgaaaaactctactactgagcagttgctcagttaatgttgggtataaccatgaacagggaagtctgcattaaaaccagatatgtgtgttatacaaaggagtgtgtcaacacgtttttcagtttcaccaccaatattgaagagcagaatttcctaaaatactttaaaaatgagtggaggacaatgatgttgccttccagtcatttaggtttcttcatatgtggtagtagagtttttctttttcttc

SEQ ID NO: 133412 - DNA, 1029 bp, Homo sapiens
catactctcaccttctcctaaattgaaaaactatcctttaaaaaacccattatttataaataatcatctagagtatcaatttatttttcttatattcttatctgtaatttctagggcctttaaacacacacacacacacacacacacacacccattctcagccattacttggattaaactcactgtcaaatctactacccatatatatatatatatatatatatatatatatatatatattttttttttttttttgttctctacctccttgtaaaaagaaaacaccaaaaaccactctccaatcccttccctccatgaaagaagtggtctttaaaaaagcaaataaagcaacaaggaatgagaagactcgtgttgattttggaatgagagtgtgacagtggatttggtgcatattattcaactctgaggatgcactgaagtcaaccatgtcaatcagactgtttgtgtagccggacctaatcaggaaacagatcctggtaaaaccatgtttagaaagctgctaaattctgctactctcttcagatattgtaactttttgtaaggtcttcataggaatgttgttctgtgggagtgctttcagcatatccatcgggtcttttttatgaggagacagtatgaattctaaattatatgtccgatacacacacacacacatatttttccagtagacagctgctcagatgttttcagatgcatctaacttcagatctaactttaggcaatgacatcaagcttgaacccagactcccattgcagtctgttgagtctgccattggattgtggtatcattctgatgcagaattggaatcgtggcttgtggaggcctgatgtttcaatttgggctgctgagagtctgtctctgtgctgccaaagccagcacaccaccgcagactgcatcacacctgaatcagggaggtttgagagtttcagttgatttagtaccaccatatacatgcacgtttagagtagaactccatggactaccatgggagaggtggtgcttggcat

SEQ ID NO: 133413 - DNA, 1047 bp, Homo sapiens
tccatgccatgatgaaggaggaaggaagtaaaatctccatttccttgaattctgatttaatggctcagtaggctggaagcaaatatctggtctcagttcacagatatttagttcaaacgcacctagctttcttgactttaacaagggcagaaacagctgttacctttctgaattaattgagcagaactggtatatgacagaatctggcatagcgagatgggagaaattgtcaccaaatccacttttgaacaagcaaacattgcaatgtcctgcaacctctgcttgactatttacaaaaggccttatagtgaagattcatggcttctcattaaaaataataatgctaagaaagtttacatacaaataacaccaaggatgatttattgtggttttacagcgccaatgaggaaatttagtgcttatagaggttacagaggaccccttgaaccagtgtaaaaagatcagctattctacagtggagagcatttcctctgtagatcaaaggagcttaagcctatgctaagtctttggggtggtaaatggagttcacacgtgcaatatcattgcactgtacaggccaaatgtatttcttattcatcctttactgctctgacctttcaacactttagacatccttttgttattctttccatcagtaaaccagctgtggatcagctgagggcagtaactaatttgcagatgcgtctggaatgttctgttttttacccatttgggcttggggtctcatcttacgtgttgcaaattggaactgaaacttgttattatttctgcagtcatttactatcctggtagtattttttatatcttcggtatgatattctaggtgagtaaggtagtaaattttcaccacagtaaaggtatagttttgaccatttgctcagaatatcaatgtaatgttttgtgtagcatcttagcatttgaaagtcacgagaggtaagatttctggccagggcatttctatggaaaataatagctgtgcctcttctgttaaaaaaaagatgggatgtgcagagtaacacaagaaga

SEQ ID NO: 133414 - DNA, 1034 bp, Homo sapiens
taccacttacagtcctacggttgagtaggatcagctgtgtggttttcacttggggcctcccatactttgcagtcagatgtccactggggataaagccatttgaaggcttgactgacatggaagttaatatggctttttcattcatgtgaacactaagagaattttcaatctgatgtgtacgatttagttattaatgtgtgtttgtcatagttgagttatctgaaagtccttctgaaggacatatatctattgcataatggtttaccccgtaatagctagaagcaatggcagttacattacagttatactacatctgtaaactgtcgaaacatgtattcatttgcttgtgtgtgtgtttattttttaaaatttccaaccgtgcttattcaatgccttttagatactaagtctacatctgggaatgagaaaacacatgatctagtcttcataaaggtgatattcaaatttgggcagatggatactaaacaagtaggcaaataagacaaactataattagagatcatggtaatagttatgaaggaaataaaaaaaagaccttgcatgacattaagggaaatgtgttattaaatttataccctgagttctttacagtttttctgttactgagctgacatttattcaataaacactgaaacttcattttggaaagaggcttttataggcatcaggcaataaactctggccatggaagggcaaatcagagcaaaattgaggttcccaacctattgtcatttaaaatttaaaaacaaaacaaaacacatttccacatttcaaataaaaatttggaaacaaaaaaattacttatgacaaaaacaatccacactgtagtatgtgtgatgtttaaagagcatgataatttgctattgctatgatatagccacagaaaaataaatctacttacaaggtaaaggaaaaaccatctcacttctgacaatcagcaaaatcaattctgatagctactaaaaagaccactttaatatcattccttttaggctgaataaaaataattgtcc

SEQ ID NO: 133415 - DNA, 1032 bp, Homo sapiens
actccagtccagcttgagctctgtgccccattagcccggcgtgcatgctcccctggcaagccccgtggatcattcagtgggtgtgtgccgtgggtcaatggagaagtcctagaatggactttcctttgctcttcccctgccctcccaccctcttggttctccccttggcctgtataccctgcctaacaaaaaggcaaattgaatattcacagcaagtgatttacttccataaagagcatggaggtcgagtgtgtagggagaagccaggtgggcttgggtcctttgaaaatgtttttagatgagagcaactttagatataagcctatatactatgacacattcaaagtctgcctgtgtcaaaatttttcaaacaaaagcttatcccagcagattctttcttcagctgcatctgttagaattataaaaagctgtcttttttttttttttttttttcctgaatctcccttattgagttttagatttagcttagatgtactggccctctgttccaaattttggcctcgattgaaaggtgaaactttgcctccctttctaaatttaattacagatgaatatctctgcttctaattatggccttaaatggagagaaggtatactttctaatctgcaaaacctatggagtcctataattaaatatattttaaatgtagtgtttatgcttcagtcatttctgtcacttccctacccaaatgttcaatgacagactattgacatttgtaaggcatcatggtatataaatgcatctgtgggttgcagtaaaaattacacttttgcagtgaatgttttacattccagtaacacccaaccacgtgaaccttcttccttcattcaaaagaaggtacagcctttggagttagacagagctgggtttttcttgacttcactgatatctgtgtttcaatttagaaagcctaatttcctcatttataaaatagatgtaatagtatatacctcacagggttggttggtacacgtattaagatcacgtacagttacatacttagcacagtg

SEQ ID NO: 133416 - DNA, 1219 bp, Homo sapiens
aattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtgatattttttctttccctgtgtcagcttgaatcttactttatgtatttcgaatttgttggctgattgctactcttaagtgtgtgaagttgcctgaagagcaagatataggtggcagctgtagttctacaacaaagggccttgccttcaggatcccctgtgttttatgcctgcaacacagtgactgaggtttatttggagagcaatcacagggcatcactactaaagtccacttcctgagagtaagggttcctgttacattttggagatagaagagccagaagagtatagataggtctgggttcccttgcataactcctgccccaaaacagagttctgtaaccttcttgtcttttgccaccaaccccataagcagcaacttagaactcgtttgcctttctctgttgcatgctgg

SEQ ID NO: 133417 - DNA, 1062 bp, Homo sapiens
agcccttgctcactgcttcttttctcctggcagcgctttctgcgcagcacaggcaccctcgcctgtcacgcctccctctcctcttcccgtctcccagcgtggatgagggcgcctgcagatcccggctagggcacggaccgcctaggccgaggtaggttctgtaggcacctggcatgctgtagatgcatataaacgttgccctgtacaccctttgccttgttatttctttctgcagaaaagagagtcggttttttacacataatggggcaagaggccaattgggaagatatatggtgttcaaagaaagccgtggtgccttgagatgagaatgcggccacagctttttgtgggctgaatttgatgggtgggaggtgagagacgtggtctggaagttgtctcttcgtctggcattctgccccccttccagagctgttctgaaaggccggtttgttttatagaggggaggaggagggcttagtagtttttaaagatcagtgtaaattacctgctaggagcttaggcaattccaggcaggcccccctgctggaggctttcgtaacagatttcagttctagcagggaggaaaactcagactgtgtagatacctgctttttcttaaaggaatttttttcgggcccttaaaatggtagttttgggaaactgatttcttagaaatggcaaactcctttattttaaaatacaatataccaaactatgaatttacttttaaaaagttttattggccgagaggttgatattttttccatttcatgatgagggtttgacggtcactgccacctcctctgcccgtccttcaacttggccctgtaaaggatctccttagccttggccccaagtttgtactagattctatccttcattaattatagttcattcttgattaatgatagcaatgcttccactcactttttaaggagttactccttttccgtttgtaattgaattgcttaacagtaagaaaaacgtttttccctaaaactgggatcacaaaatccactttatccacatggactaaacaggtaatgcacaagagtgcttggt

SEQ ID NO: 133418 - DNA, 1029 bp, Homo sapiens
aaaaaatagccaggtgtggtggcgttcgcctgtaatcccagctactcaggaggctgaggtgggagaatcacttgaacccgaacccgggaggcggaggatgcagtgagtcaagatcgcacctctgtacttcagcctgggcaacagagcgagactttgtctcaaagaaaaaaaggaaatgagaaaagagaatgtgtgactgacaccacaaagaaatgtcagatgtctcttttggggttctgtgggtggccctccctcccaaaaaagtagaattgagtgaagggaatgcagtagagcgtgaaagaacacatacccacaagggtgaagctgcaggctctggttaaaggcagctttccactagatcttgacccttatgccccagggcctcagctttttcttgagttacagaggagggtgcaacttggggctagatggacttttttgttatggacttgccatatgctcttcttgtaagttttctttgtcatgtaagtttgagaaatgctgaataccatgtctctgtctttaaatatttacagtagacctgactgtcttaagggctaagaaataaggagccaaaccagcaacagagaatcttgtctttcttttcttttcttttcttttcttttctttttttttttttttttgagatggagtctcgctctgtcacccaggctggagtgcaatggcgtgatctcagctcactgcaacttctgcctcccagattcaagtaattcccctgcctcatattccggagtagctgggattacaggcgcctgccaccatggctggctaatttttgtatttttagaagagacggggtttcaccacgttggccggggtggtctagaattcctgacctcagatgatttgcccacctcggcctcctaaagtgctgggattacaggtgtgagccactgtgccctgcgacacttgtctgtctttacgtctttgtttcttgtaatttatgggaccacagactccacccctagcctgaagacctagtaattgctcccagagctgctgtttcca

SEQ ID NO: 133419 - DNA, 1017 bp, Homo sapiens
tatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgtta

SEQ ID NO: 133420 - DNA, 1180 bp, Homo sapiens
agatttcatatgttggagaaaagcctgacaagaggaggattgggttttaccagatttttctattataagaaacttgcatgatttaaatattttcagtatgtcctttgaggaaaaaagcaaacacagtgctacccaaatcattactaaatgtctctcatttggtttctcatgtttctctctctttttcttttctttgcagtattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatag

SEQ ID NO: 133421 - DNA, 1868 bp, Homo sapiens
gagaatcgcttgaacctgagaggcagaggttgcagtgagccaagatagtgccactgcacttcagcctgggcgacagagcaagactctgtctcaaaaaaaaaaaaaaaaattatgggaggggtataaaagttgaggtgtaatgagtattcatcaagaattaataggaagcaaatttgaaatttgctcacagagaaatcacaccagtatatcaaaaacagctaatactacacaaaaaacataaatgccataaaaacacttttatttattattttataaggttacatttgttttctgggcatactcagttgaggtaaatggtaggattcatttgtatcacctggacacagctcagctgtatggagtggtaagtgtcctgttatttctgtaacaacaacaatgaggagagctgacgctgacattttttctttcagtgtattgggaaatcctcattctcgtgaaaactgaaaattaactgtgttcatgggtgaataaaattaggctgcttgagagggattttcctctgtgtgtattttattatttggggtaccaaaacaattttgtaatatgtcccctgaataagacaaattgaaaaggcagggaaaaatgaggacagaagagaccactggaggtgtttggagtttttaatctttgctttgtgtttttatatcatgggcaatcacttgtatttcaaaaccaatggtaagggttacagcttaatcttatcatctgttcaggtatggatttgttcagtattagcaatgggaccacattaaacagtttcaaatgcctcaaatctgttgtgctttcacagtggtgacagtggggaaatgttgactgcttcctattttttccttgcactcagaactagctgcctttacaatgatccagaaatgtcttctatggagaaggagtaagaattcaccatcaataacagctatgtggttacttgtagtgttgtatggctgggctctgaaagaaaacacactgaggactgggtaaaccctgtttagatgttcagctttcctgtgctccattcctgaaattagaaacctgaagctatatttgccagcttcacaccatttcattcacgatcaccccttaaatttctaaaggacaacctgtggacatggcattctatttttccaatccaaaaatgggaagaaaatgaatattaggaccagatgtaagaacatttgggcaagaggaatgcaattctgctttctgaatgacatcatctctattttaattagtggaagttggaacttccatttaatactttggtggatggagagaaaatgtgcttgttttgcaacatccaggaggaattcgagcctgtatgagactgtaggaatgatctatttagaggattgccatcctgtgagaagcagaaattggacatgtagtgagttcttaaccacgttccagactgtaaaaagcttcacacgcagtgtctgattttaatcctcagaataagtttatgaggtacatttcacagatgaggaaagagaggcatggagagacgatctgaccagcccactgttttacagctgtaaaaatggcccagagctggaatttggaccttggcagtatagctccagggccaatggtttttaaatcagaaagaggtggtcttaatgctagatgggtgtaccacttccaatttaatgaaagacaaaactattcacctaagagaacagagcgaattagtggccaagtcagtttcagggaataaactgtggtcaccagcaagctttcagagagaacttggtcatccgacaaggagcttccaatttggtttgagttgtggagaatttaacattgcccttgttcctagcaatcaggaagcagaggggaaagatcagttttaa

SEQ ID NO: 133422 - DNA, 1023 bp, Homo sapiens
atgattaattaattaaaatattctgagtctcagcttcagcatctgtaaagtaaggaagtaagttgcacttcctggaatggttctgagggttgaatgcaaacagggtacacaaagcacttgcaaagcctcccagcacagagttcgcaatccagaatcttatttattgttacacctgttgcttttagagactctccatcatatgggaaagttcaaatgagaagttaagtatacctaggacatttttcattcaactgcacacatcagttttcaagggctccatttgggaaaagttacttcaggaggaagggttctagttggaaaaatttttttctggagaaagaaatttaccaccattcatgtgctgcccacatgtccatgtgttctgttttctgtaattcatctccttgggatgtcctttctgccatttctgttactgaccttcatcacctcaatttcatgttttgcaaatttcaaatggatacgagccatggctcctttttatcactgaataacattcaaaggatctaatctcagccactcccacaaccagtcctcagctgagatggagcctgtcatcaaagggcttaaatgaaagaaaaacttgcccaacctagaaccaaatttataatcattggttacagttgattctcattatttgtggcagttatgttctataaagtcactgcaaacacttaattagtgaatactgaaatagtgttccaagggaaaatacaggatgttcagttcctgcaagcatctggtcacaatgttttcatcaatcaatcaatatataacctttttttatgtgtgtttctgtttaaatgaaccttacttagtatacattgttgatttatgaacattgaactcatggccaacagtattgtaacttgtgcataaacaaagcttatctaatacacatattttcttcataaggcacatcacagctttcctgcacttgggaatactagtattcccaatacagtatttcagccctatgcttggaagccaatttgaacagcaaaa

SEQ ID NO: 133423 - DNA, 1029 bp, Homo sapiens
catcatcaagtaagtcctgacagtttcagagatgtgttaagaaatagtactagtttgaggctgggtgtggtggctcacgcctgtaatcctagcactttgggaggctgagtggaagaatcagttgagcccaggagtttgcaatcagcctggacaacatagcaaaaccccattcctactaaatatataaaaattagccaggcgtgatggcatttgcctgtagtccagctattcagggggctgagatgggaggatcacctgatcctgggaagtcaaggctgcagtgagctgtgatcgtgccactgtactccagcctggtggcagtgagaccctgtatcaaaaaaaaaaaaaagtgtgtgtttggagaagtgggttggaaaagaggtcagttctggaacaggggaaatggcactatcttatttttaaaacaatattaaatatcctccaataaatacaattttttcctataacctatagataattgttgtgttcttttagatcctctttcacctaatcttttcctggggttatttgattattgttcatttttagcttgaactttactaccactttggaaaaagtaacagttacattggttaattggtatactgtctctactggttaacagtgtatcagtttcttgtgtcccccactctgcacagacacaagacggtcttagcatagcttggatttctttattgtcttatacaaagtaatttatctgcatgatgctaggaaaatagaaagaaataactctttctctgtttcttctaaaccttttttgtttgtcatgattaagtagagggcatttgcccagtggtgggtgaggtggtgaggaatggtttccttgctcaatagagggtaacgcagtatcagcgtcagcatcctgcatgggtactgaaggtctcaggatgatgctacaaaaactaggataaaatttaacaaaataaatacttggagctgggattttaaaacagggatatcggagaatgaacagttgtatctggtacattgttgcaaagaacgattgtt

SEQ ID NO: 133424 - DNA, 1013 bp, Homo sapiens
tgaacatgacgctgcaacattccaagggcagacagcatttacacagtgagctgaactgccatttaaaatgacatctgaagtactgtttataaacctcagtctttccctttcgaaaaaaatttcttagaagttcatggaaataaagaaagaaatcaaagtaactgagtggtcatgatcttgaaattactgtaacactctggagccagattgctacatttagaaaaacgcttttgaaaggatgctttcttgcttttaagttggattcattatgtctgttgtctcttttaatgaacgtctgtcttttcgtcatgctgaggatgaattgcttatctgtgcggtatgaggattagtatagctaagccaccatatcctttgtggatttccatttaattatgcatcttcagaaatgaaattattgtaacaagcaatttttgtattaagatatgtctcctcctgccattttccttcatattgcattctaaaaagtagttgataaataccctgcatattggaaaagatggaacgaaagcaaaaatatccagagaagctactacgttgctctctcacaaacatgtgttgcatcagttgaatacttacataggtagcatcttctaagatctgtagtataaatactgtatacaacaacaccgtatcaccacttgtagtataaatactgtatacaactacctcaaattagtaatacacacaaacccataattgggtatatttttagttagttttgctctcttcccccatatttttttgcagtagagtcacactctctttgtagaaaacatcttattaaactgcttttcaagagtgaattaactccatccaaatctatacacagccattactttactgccatgaaatcaccagtgggtatttagagttctgaaaaaactaacacgttgggttctgggaggactggaccaggcttaagcgtatgtcctgtcctcctactcaaagcttgaagaaaatctctttaatgattcaacagtccaaaactatat

SEQ ID NO: 133425 - DNA, 1050 bp, Homo sapiens
tctgagtctagtacacagcctttcaccccattagaaagacctgcaatctttctttaccctgatcaaggatgagttggtccttggaccactacccatgcaagacagcttaagttttgcacctagtctccccctcagcatggccttagcaatggatgtggttgttcagttaataaaagaagacttcattgagtgtactttatatggtcaggatagtgctaagctctgtaaaggctgtacaaaacaaggactttgatcaggttgtttctgcaggatgaaacaaaacaaaggctgcccgtaggagtactgtattgtaaagcttaccatttggctgtttagctgcactgtggaggtcttgctccttcagccttgctctgtgctttgtttccagaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggtagtcgagctcagcatgaatctgggaaatggggaaggggcagccattttatttaaaatcatgaagtgagtctagacttctccggaacatgacatctcaaagaccctattctagagccaatattcagggaactatagagctaagtatatttcctcatattcaattcaataaacatttgaaatcctactaggcaaagacaactttccaatataaaacgggcttttcatgctacatatctgatagcgatcatcttgtgcaaatttattgaaagtcatagttgtctaatttaaatgtctgtttggcattcttatcagtccattgtacggttgaactgaacagagtatgtgacaccatggcctgtgtcataacactacccccgaggtgcttctcattacaaaatggccttttgaatcctcttcagaagctttggggattttttttttagacttagcctggtaattgtttcccctaactgaagtttgcctttc

SEQ ID NO: 133426 - DNA, 1110 bp, Homo sapiens
cattatgtagtttctgtttcagttctagccagggtggaattctctgaagttataatatttgaaagtgaaagcgagagagtctgggacacagctattgcttttattcatttttaaaattcacgcaatcttaaaagcaatacagtgccacaattaagtggtggcctgacttttagagacatgctaattctagcagttccactcctagaagagcataattagaaaattcaccaaattagctaattatttcaaccaatggtcattgagccgacatgagcagtgcagttcagactctaccttgacagagcttaaggctttatttcctcaaaaaggaaatggctaaacgacttgttttatagtctattatgcttaagtagagttttttttttccataagttattggggtacaggtggtatttggttacatgagtaagttctttagtgtaagtagagattttatattgcatttttatcatgtgtgaatttctgtagttatctgggtagttgattctgtaggttgaaatacacaaataggaggtgaaagaaggtctggaatttgtactatttcctgtcatcccagagagtcttcagcagctcctctatccatcccagttgcccctaccagctcctgctcctttcctgctaatatattgacaaaatcccacagaagactgtggcatgacccaactggcccctctcttgcctccgtatttgcttcctttttgtcaggagagctttgtcacaccacatctgaaccttttatttttaaacatagtaaaactgtcgagcaaagcagtggtggctgggcaagctggtaattaacactgccacttgctgacatggctcttttaatgtagttaacatagctgtgttgaaagaaccagtttaatggccacaaccctgttttaggtcttaaatgcaaaggacagaattgtaaactaagttgaatttttaaatctaccttaattttcaaatgaaagatatatagtcagaggttgaaactttgaaaacacaaagtgcctctgaatagctatattttgtaaacatgaggacatggataagtgactgtataagagggttggattataaatatgtttgagttctgaagtatga

SEQ ID NO: 133427 - DNA, 1139 bp, Homo sapiens
tcttaggcagataactagaaaaataatgtacatgtgcctttagaatatttcaggctcaataattcaatccaacatagtaagtggtagaactaagatttaaacccagtggctcttaatagcagcattttgctacttgacaggtacgagaagtttgatgtcaaggagaacacacaaaatgacaaagatcattgtaaggaattccaaaaactgcaggatcatgggatacccagacatctgtccctctaggtcctaggactttcaaaactggggcctggtgcagatcttctctttgcatacctccccaatctttgttgctgaataacgtggtttgattccacctatcatagtgtatctctgtttggcacaggttgtcttgttcctgctgatacattattgtctgtcttacatgccaacctcttgcatgcccctttgctaccagggcacaggtctagttttagagaacacacagggtcaaagccacaggaagaatgtggacaaagaaactccctgatgctgagcttttgaaggggtctcaggagttggtaggtaagtacacaggcacttacctctatccaggggagcagcactgagtttttgaaggtaggggtcattgtattagctccatcatcccaactccaccacgagaatgagacgggtctgttttgttcctctatatcctcggcacatagtagacacttaatagatatttgttgaataaatgaagcaaatgcagtaatcgctaagggtgcagattattttctttcatcatagtgctttattgacagtaggggatttgacttgcatcctggagaagcagattaaactccaaaggtttggtagatccagcgttacatagtgcaaagtacagtaagagaggcagaaggggactaaattaagaactttaacataaaggtttatcatgtttaaaattaggttagtgcccacatcataaggactcaccctaggtgaatgaaattacgtgaaactcacagagaagaaatatatattatggtaaatggggtcttactgaacaaaggtccagggatgaaaataaatcaagagaaatttatcgtgaacagtggtcagcttcttagaagaacatatagattcgtcacaattgcctttggtatttcctgttt

SEQ ID NO: 133428 - DNA, 1099 bp, Homo sapiens
cttttcaagctttttgttcctatatgctttgatgctttagcaatccagacgtaaagatatttactgtcaatatgaatctgggctaagaatgtggaaaattggttacccaaatcaggaaataaatttttgagcatagcataagtcaaatattccctttgaaacaataaaggccagctatatagtaagaatgggctagatcgtaatgtggtaacaaataactacaatatctcagggcaaaacacaacaaaagttcatttcttgtttacatttccagcaagctttcatcgaggcctctgctcatcagaggcactcgggacacagcctggccgagcccctccacagccacctatgtgggaagaggatgtggctcctcacacgcttgctcctaagccttctgctcagaagcgacatctctcccttccactctttcttcattagccaaagcaagtcatgtggctaccctaacttcaaaggggacaggaaagtgcaatactaccatgcactcaaaaggcagagagccagaaatacttggtgaagatcaatatgtcataatacattgatcttctaacacacatggtgttaatgtcacagtaccatccagcaaagaaaccatgaagcagttttaatacatcctctagatggagacatgtagctgtttcagccatagtacagcctgacttgtgtttacaactccctcaacctcttggttagctccattctgtataaagaaactcaaaattaagtagaggctacagatagataaagtaaaatacagacctttacactggactggtttgttacctaacagatcttgagaggcttcagttactgatcacaaaactgctgtcctgcttagtcaacaactgctgtttggccacttcatttctgcaaatgtttatgggcttaatgtatgaatgtggttgaagtatttacaaagagcgtgacttgggtttctcttagatttgcttctaggctattctggctcagctttccctctgtcccaggggttttctaacatgtccctatagccttctttttgggggggagtgggacggagttttgctctttttgcccaggctggagtgcaatggcaccatct

SEQ ID NO: 133429 - DNA, 1046 bp, Homo sapiens
gaaagtagaaccttgatttctgattcataatttacttagttggtttcatgtactttggccaatggtattgtattccaatagttaaccattttaattcagattaagagaaagtagggccaccctgcagctaagataacaggttgtgtttaaaggacaaataaaattaaataattagtctttagattcttttctttttggacacaaaacatcacagccaccatagcctccctttgttggtcatcatgcatgctggggacttaggctcatgccttggaagccctgtcttcccagctctctgctctcttctattcggctagagacacagagcttgctctctgcaatgatgcatcctggattatcattttcctcccgagctttcaccatcctggactatacccgtgagttctgataataccatctggacaacatcatggattttccatgtcagtttgatcacttcccctctttccttttcttagtacactttgcacagctttttcctcttccgtatgtccacatgctccttttcagcaactacagcgccattcttcacggctacttcttctgcctaggtagtactgtactgccttctagtaacttcgtaatgcaggttaaaaagctatgaaaaagtctttccatatgtcaccaaaatgcctaaggctttccctttaaattgggtatttctggcacctctggctccttatttaagacttctcttttaagttcacagtcacctttgagggcatgggcgtattgtcagaaagcatttttgaataaatttatgcatcactgcaccttatataaataaaatttgtatgtttctagaccttcagaaagtctagaaattgaaatccttgagcaggaggagataagttggccttttactcatgaaggaaatgaggtctcaatgtctggctttctgagaaacaagctccacgacactggcagagttcagcacctctatcttcattcattgcctttgataccagataccaataactgttggtatctggaaaagtcattggtagacttttgttctagtcatt

SEQ ID NO: 133430 - DNA, 1030 bp, Homo sapiens
gggccgctggggacgctgatctgcaggagggggcggggtcggaaaaaatccggtagctccagaccggtgtcccgttgccaggcgatggggaggaggcggggccgacaggaaagaggagccgggctcggcgcgaaaagggcaccctccagagccgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccg

SEQ ID NO: 133431 - DNA, 1020 bp, Homo sapiens
tgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctg

SEQ ID NO: 133432 - DNA, 1026 bp, Homo sapiens
gaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaag

SEQ ID NO: 133433 - DNA, 1068 bp, Homo sapiens
aaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctga

SEQ ID NO: 133434 - DNA, 1112 bp, Homo sapiens
tcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctc

SEQ ID NO: 133435 - DNA, 1018 bp, Homo sapiens
ttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaaga

SEQ ID NO: 133436 - DNA, 1028 bp, Homo sapiens
gccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatg

SEQ ID NO: 133437 - DNA, 1050 bp, Homo sapiens
gttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggag

SEQ ID NO: 133438 - DNA, 1049 bp, Homo sapiens
ttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatc

SEQ ID NO: 133439 - DNA, 1058 bp, Homo sapiens
aatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttatt

SEQ ID NO: 133440 - DNA, 1034 bp, Homo sapiens
taagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagc

SEQ ID NO: 133441 - DNA, 1037 bp, Homo sapiens
catactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaa

SEQ ID NO: 133442 - DNA, 2052 bp, Homo sapiens
aattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcct

SEQ ID NO: 133443 - DNA, 1029 bp, Homo sapiens
tggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacct

SEQ ID NO: 133444 - DNA, 1004 bp, Homo sapiens
ctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttaca

SEQ ID NO: 133445 - DNA, 2016 bp, Homo sapiens
gaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataa

SEQ ID NO: 133446 - DNA, 1049 bp, Homo sapiens
gtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgta

SEQ ID NO: 133447 - DNA, 1032 bp, Homo sapiens
ttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaag

SEQ ID NO: 133448 - DNA, 1979 bp, Homo sapiens
ggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacac

SEQ ID NO: 133449 - DNA, 2059 bp, Homo sapiens
gatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataaccttt

SEQ ID NO: 133450 - DNA, 1022 bp, Homo sapiens
tgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaaggagtgtgaatttgttgttctatccccaaatcatatagattgaactgctattataaaaaacagtcatggcctctcatggaagagtagatagtaaaataatttatagtctgagaatgaaaaagaccgttcttttatgtctttgctttactttttaccgttttgtttcacatattttttgtgaaacaatgaacaaagttggttttaatagtcattatattcacttattaatttgtatatgcatctactatatttctattatgaattcagaatatttggaaacttctatcgtaaacataactatatatattttttctgtgtaatattagggaaaatgttacatatatctctgaaagatccattagtaaatctattttatgttttgtgtaataaaggtttttaaaaaaatttcaacatagatgaaactgtcctatttctctaacatatcagacgtactttaaaaaattctctaaaaagtatatgatctttggtagttagaatgtttaatccctatgactgctgtgcttttggatcaacaaaggaatatttatcttgactacagcagaagctcagtataagcaacaggtgatttaatttaactgattcagcacatgatttctgagtctcctctaattcttaggtttatcaagttttatttctataaatcattctctatgttttttgaaagtgactactttaaatttgaaaatattgagattactgcaaaaaaaactgaaaaaaatcagcttttttgaaatttcttcctatgcagaattcattcaaattaaatagaaatcaaggttatgtatgtaaaatttgtttgaaaacaaacttactaatatgtaaacatcataaagttg

SEQ ID NO: 133451 - DNA, 1045 bp, Homo sapiens
tgatattttctatcataattatctctctcatttcttccaatagtaatagcggtaatattgttccattgaatatctatgcacctagctcatctcttagaaacatcccacatagtagcatcgtattactctctggtaaaaagaaagattaaattaaaaggactctacacagtgctgaatttcctgcacctaaattattcagttatcacttgccagtattagttgatccttcaggctatgccaagtgccccctcatgtaggcctctgtattaaaaagattgggacaaaatacttgattagtttgcctgtagaagctcaaagtgtgtaccaaatacattgacagtggatgctttcatggctcagccaacacagttcagaggaatcttttcggcttccagggcattgcttgttaccttttgtcaggatcaacccaaatcctcagggatgctgtttttccacactgtaagtcctaactcattagtgggtcatgaaatcaacttaacagctcaagaccagtatattttaaacgtgaaataataaaaaatagaggaacaatagagcatataaaatggttaagtattggttcctgaaatactgtttcagctaaatattctatttactgtgtatactgggtcacaatataaagtgtttcctgttatgaaatgcaatttaaaaaaagaaagcttgaaagactgctgcaggaggcaccggccatccagtgattgttggaagagtctggattgtgtggagcctgaccttagataaggagcagcagatccacaactcaggaagtctagagatgcttagcacttcttcttttgagtgagaagatggaatcactcttggtttctaaaatatttttcttctctgctgtgtatcgggcaacctcacatgattcagtgggaccagaaaaagcatagaaaaattagatccacacacagcacccaaaaaaggccatagtcttttgtttacctagatgtattttaacctctttaccactaagcattttactataatagaactggggacatacattgtccttttgagt

SEQ ID NO: 133452 - DNA, 1067 bp, Homo sapiens
aaagcttggggtggtatagtacctagtaaattctctttttttttttttttttgagacagacagtattgctctgtcaccaggctgcagtgcagtggcacgatctcggctcactgcaacgttcacctcccaggttcaagtgatcttcctgcctcagcctcccgagtcgctgggactacaggtgtgtgccaccacgcccagctaatttttgtatttttttttttttagtagagatggggtttcaccatgttggccaggattgtctcgacctagtgaattcttaaccaccgacattctgtctcttaaccttagaaaactccgcatgactcatttccccagtaagtaatgagaatattgaatgaagggccaggagagaattttctaccagcagaatcagtattggcagaggtaattaattcacctctgacattgagagtctagcctttccatgccttaagaaaatattgttaccaccctttgaatgacttatttaacagccctcccacaaccaggatatggaaagccatcattttcttatatgctttaagtagtcagccaactataaattaacaaaaactcaatgcaagaaagtgcttaaaataagaaatggaattcttcatggtttaatttcccagatgactggattctgttgaaccctttttatgttaattggctagtgaaacccagtccatagcctttagcccatcgttggtggggaggggaattgtcttgtattttctttgtgcttctagatatcctaaagagctccattcccctctctctgttctcacgcaaaactgtctcggctatttctggactttactgttctagataaattttaacatcaatttgtgaacttccacaaaagctgttgctattgcatttatctcttgagtgaggattcatatttttaaagctagatgttgctattgtagaattgctgcatatcagaataatttcagtctttttcagcaattggaattgttcccacagaatggggacacatggttccataacatatgtagccaaccgaggtgcattttatagactgatttgagacagatatttca

SEQ ID NO: 133453 - DNA, 1224 bp, Homo sapiens
tagggcatttatgagttgggtggcagattaaatgtgtacagtacaggctacatactttgtggggccagtgcaaaatgaaaatgtagggtccttgggcaaaagttatagagaatttcaagacagtaacagcagagcattaaacaaagcacagggcctttcaaagcatgaagccctgtgcaattgcacagatcacatgcccatgaggccggccctgataaagtttcttaaattgggaaagttgtgggtgtagtttgagtgtgaaggaaaaaaaaaacaaaaccattaatacaaaggtaataaatgagaaaaaaggaaaggcgaatcccatgaggaacaaggttgctttgtaagtgaagtgtggaaaagccatggtctatgctggagaggaggagagaggagaatgctacaggctggagagaatgacccagagatctgatgttacaaaccaggtctctcccaggggtgggtcgggagggctagtgggtaatattctagttgacagaataacatccatataaggcacaaaattgattggttaaataattgtaggattctgttttacaccgttcattgaaacccattggtagttgcatttgctatgcggtcagaaaatggtgaacaagttattactatttgttttgttcgtcttgggaaaagaatttagtctatagtgtggaggagtttcagagaattcacctctgaattcatggatagtgattccaatgtctttttaaaagatggaaacttgaacctcagtgaaatataaaggctatgagcataattcaagctttacggcagtcagcaatcaaacacagtactcatttattcattctggcaatatcattcatggtgcaaaaggccagtttcaaatataaacaggaccaggcagggaagacgtatgtgtgaggacaatgaggaccaatggtgactaaggcaagccagagagaatggggcctgttgaaaaatgctcagaatcaaataattgtaaaacatgatgcaggactgagcacagtctgtctggagattaggtttaattggctatcagtttgcatcccctgatagatgagtcactgggaaaaagcagacccattggtggccctggaaagcattgaagtaaaacattgttaccaagagtggagggcttaagagacaaacagtatcatccaatgaatgaaacccttccaactaagagcccggcaccagtgggcttccgtcagatgggac

SEQ ID NO: 133454 - DNA, 1170 bp, Homo sapiens
catgccatttctctcttgaatctgccataaataagaccttcctttctgagtaacccatcccagaatatttgcttctgttgctcagctactgtgtaattgaaaaatatgttaattatattactaataaaaatcaaatgaaggtgattaatcttttgtagaattatcttctaatccatttagtggtaagccattagtagtcttcatcaacaccactcaaaatgcacctgtgtttagaaacctttatagcaatttaacattgctgtggcatcaaagagtatttttattgaagactgatacatttatgaaatacaactgatggaaaattttaaaaattggttccttcctacagtgtttgagaaacacaagtacaaactttgatcctatggatggggtggcaaaggtccagaggagtgaagggactcagcagatgtcacggggccaggtgattagtagctaattggcagaagggcccagagttagtctgagtcttcatgttgaatttcctagtttctaaggcaacattgattatgagatatgccattgatttgaaaacagcctttcagaaaagcaaatgccaccatagtaaatatacacatcaatgcaaaggcatttcaccctcaaaaatgttaatttatatggacataagccttggactcaaggatataggtaatttacttttctctcttttttccttaccagatagtacaaatttaaaacaaagcaaaactattcaaatactatgtcaaaactagttattgacatagtatttgattttatgaaatcaatttaagtgctaaaattagactagaaaagaaacctctgtgtattgccatcagcccactggtttctgtttcaagtggtcttatatgcgatcttgaaaatagttacttcttggaatagcatgctgtcatttatacagaaggcttaaaaacataatagtgaccatgcactcacttcagcagcacatatactaaaattggagtgatacacagaagattagcatggcccctatgcaaggatgacatgcagattcatgaagcattccatattttttgatttttgggactcagggaaaatggtgggggagggggtgaaggctagaagactacacgttgggtccagtgtacactgtttgggtgatgggtgcgccagaacctcagaaatcaccac

SEQ ID NO: 133455 - DNA, 1432 bp, Homo sapiens
agaaaaggaggcagatgtctttaaatattaaggtgtatttaatattgctctagttaatttcttgaatttgttttttaaaatcatgcctttattctacagggctatgaaaatttcacacatgtatcctattatcccaggaaattgccacagcccatctgccagcattgtctctggtgttaaacatttgccaaatctcaccacttcttcccctatccaaagctgcaattcacctgcgttattgcagtgtcctcttgatttcccatctcccacatttgcccttctttggtccatttaaaaacttagatttatattattaccttacttaaattcagtgtcttttacttacacttggaataaatgccaaatgctttcctacctctcggaatgtacacagggtcattctcccactggtttgctgggctgaagccaaactcacctttgtgtttttcaaacacaacatttgttacctctgggtctttaagcttgctttttttcctgcctggaacattcttttctgttccccactcttgttccacatacatggctgtttcttccttatcttcacgtctcagctcaaaagttcatctcttgacaaggcctttccagatcacactacctgaaattatccttgcaccatttactcttagttgcctggttctataacttggctttatttcttcatagctgttatcttggaattgacctgatattcttatttgcttacttgttgacttgtctgcccccaaatagattgcaagctctgtgagagtggggctgtgctatcttgttcctgtatcctggcacctgaaccagttttgtgcctggtgcaatgttttaataatgactggatggtacagtgtgagcactgaaagccagaatgatacttgaccaatctgaaatgagataggctagttgactatcaaatatgaaatattcttccatgaatacatgttgatatacccatgttacagatagaacaagcaagtgctcatgattattcagagagagagtcgttaattacttcactataagactacatttgatatttaatatattgatcttccagtattttttcagaataaacttttgcatataaaaccagagagtagcaataaaagctaaagttttctagaatatgaacacaaaagaaaagtattacctatgtgatatgcctgctcctggtactctctgtattaacaacaaaaacaatttttcttttcatggtttactaaagccttggcctcctgggctcaagcaatccttccacctcagcctgccgagtagctgggactacaggcatgctaccacacccggctaggttttaaatatttctttggagatggggtcttgctattgcccaggctggttttgaactcctggcctcaagcgatcctcctacctcagccttcagagtcattggaatcacaggcat

SEQ ID NO: 133456 - DNA, 1109 bp, Homo sapiens
tttgcaatgctttgatttgtgtcaatgtatgaagtacagtgtccagaatataccaggagcttgacaaatgctggctctttgtatgaaaaattgtgtagtcagctgagctgtactgtattggtaataagcctgtttgatgtaaaattctcgcatttacccacaaactaggggagaaatgtttgtaggtaaattgtttgctctgaaagtcacattaatcagggtgacccgagggtcttctttatcttcccaggccattgctccaaccctcctcctaccaccttgaggcactgtctgacctctggaaactcccattttcatcttgcggagttgtgactagcatatccccttagtgaaaactttcctgtgaaaaatagtttctaaaccacacagagccgttcagaactccaaggatggacttcaaaacctctgatttatttcaatctgtaaagtcctggggcatagctccatttcttctcaaggaagagccaatgactcagaagtgacaggaattaggggaggatgtgcaccattttgtctgaagtcatgcaattcgagtgaaaaattcacccatctctctagtgggtagattagagcatccactgctcaggtgcctcagttaaaaacctcactttgcaaatgggagtttggaatccttttgtggagtatgggatgacccccaaagacaccatctctttcacaatgaagcatgcttttgcaaaaaaatgatgtgaggatgtttctgaagtgcagtatcctgtttctgcttaataaaagcacaggtcagtgtctactagggaaagataaaagctgttgtttggttaaggctaataattgcaagatgttggtgtgacactttctcatcagaaagagatggagaaaataaaggagatggttgaatttagtagaaagaaatttcttatcagttccttgcataaaagtaggacaaaaaagttctgataagaacattggtgagtactgatcagcatagggagaaagtgtcaggacaatagctattaaataagggaaaatgatgttttattgattttcctgttaaatgcagattggtgaagtgtggcttgttaattgggttgagtgttttaattctggat

SEQ ID NO: 133457 - DNA, 1271 bp, Homo sapiens
agcccgaggcagctgtatctttgtgcacacttattatatagctgaaacaagcatacttaactcagttgaacagaagtaagctatcactcccctgatgaagagcctacagtggctcccaatcactcagggaatcagagtgaaggccaagctaagaaataaacttagccttggctttcaagtcatctgtctgctttcacctatccacattttgtgaatgggtgggtgcctgggtgggtggatggatggtcagacatagcagtgttagggaaaatgattataacagatcaaatctgcagtgcagatgtaggcttcatgagcaatgacacagtatttattgaaccaatgatgattgaatacattagcagattaggtaacaaagtgtccctcttgtctcttggccgaaaggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttctttt

SEQ ID NO: 133458 - DNA, 1067 bp, Homo sapiens
ggcagtggtggcagttgctttggccatcagacattacatcagagagcaacgagaaggtgatctctcttgagctgttagtggcactgccacgagatgatagcacagaataatgggtgtagagagagtactggaaggaggaaagttcagtgaattgaaaagtcagtgtcatgaatacacaaaccgttaaatacctgactctcagctcagtaagtaacccttatgagaaaaggaaaggaaagagttaaggatagactgcatgtaagttaaggatagacttcggatccctgacatctaagcataaagtaaaaaaataagcgtaaagtatggcacataggataattggtaaatagatcagtgtgctgtgcagtagactttgaaaggaggtggttggtcacttaactgaaatactaggaaatattaatccgttcatctctgttagtcctacctctgtaagttctaggactgtgggcttccacatcggaaagggttacacatttgtcctgttacctgtcactcacgttctggctctctactctcctttgtctctccttgatccccagtctctcattctgtcttccttttttcctcctacacttttctcctacaacacactctgatttgcagcagttcactttacaagggcctgacatgtgaccgcgacttattgcttagtaaccttagacctggaggtaataggcaaatatgttctatttcttttcttctctaaacatcctatgcaggtagaatacattgatgcatatgcagaaactataacattaaaaccttcgccaaatttgatctcaaataattgcttgcaaagatttgcctagactaagaaaattatcaaggaaataatatctattcagctgagtttgacgttcttatttctatcccggctgtgtgatttggatagcaaaagtgcaatggctaggaacctgtctttaattatttctcactccacctactccatttgtatattgtatctgttgttttcttggtttgctctggggttgagcgtattgagcatctttagagattttgaagatcctcccctttaacgggtggag

SEQ ID NO: 133459 - DNA, 1153 bp, Homo sapiens
atacactctttcatggctctgtgccgactgtggaccctctcctgctgatgttgtttgttttttttgtttgtttgtttgttttttgttttttgtttgagatggagtctcactctgtcatgaggctggagtgcagtggcatgatcttggctcactgcaacctccgcctcccgggttcaagctattctcctgcctcagcctcctgagtagctgggactacaggctcatgcccctacgcccggctaatttttgtatttttagtagagacggggtttcaccgtgttagccagggtggtctcaatctcttgaccttgtgatccacccaccttggcctcccaaagtgctgggattacaggcgtgagccacggcgcccagcctcctgctgatctttctagtagcacctgctatagtctatgattctgtactggtgactgtgggacaactctccctcatcttttacccagcattttttcccaacagaatcactggcatttgtccatgtattcatctctccaggttttccctcaggtctttcaacgttgtctgctttcttcatgatgcttgaatgatcttccatcccaccccacagtccttcactatagaaggagctgattgtgtctgatttgtatgtttctgttagttgtatttaaaggtgtgtttttgtgttggatctatcacccatcgcacttgtttaatagctactggaagagatcttttaacttcctaacacagtacaattttcttacctagtggaacattggtttttttttttcttttttgtcttctgactgcgtaacttagtaataggtcataatgcaaacttttttaaaacactttatttaaaatgttgaaaaattattctgcaaacttttcttaaaagagtaaagagaagaagaaaactcttatttggggcaaaatattgaaaccttcaaccttaacactttacagccatttctcagtttttcatgggtgtaattaatactttttgtcaaaaaatgcgtagttcttcctaaattctataccatttttgccttctatattagttagtcacatgtgcattatatggaatgctgcgtttaaaaaggaggtacagagaaaaagcccatttttttctcaaagcttgttagtgcaaagctgatcaagcactttacagttt

SEQ ID NO: 133460 - DNA, 1054 bp, Homo sapiens
ttttgatacactgattttccttcttttgggtatatacctaggagttgcattgctggatcatatggtagctctatttttagttttttgaggaacctccatactggttatatctccatagtggctgtgctaatttacattcctaccaataacgcatgagggttctccacatcctcgccagcatttgttattgtctgtctgggtctcttaagttgatgtacttggcaggtcttggaaccatctttcctattaatgactcctcttgatccccagctcctgtgcagaacacttacataacaaaatacatcacttacctggtcatgacaggatcacattatatctgccattgatattctgttaatacacctaaggaagagtgtgattatgacagaacaagggaatctgcagctcataaatgcctttttgctctgtttactggaataattaaaagaaacagctgttatgatgtgggaacttgttatgagtgttaaatgagataatacatataaaacacctacttattttgtcaagaagtacagatggagtgtcccaggaactatgttagatgcttgggatgctagtgaacagggtattgcccctgttcttaagaagcccctggcccactcagggagacactaaaatggcagtcagaatgcagtgtggcaggaaagcattttcatagcagttaagtacaggtgctgtggggacagaaacaaaaggcaccaaacctgtcttgggagagaaccagtcctgaggaaggcctgcctatgtgatgcctaacagaagcagcagagactccagggtgccatccacgctgaggctaactcagagaggccttgagtgctccttttaatttggtttctttacacttctccagcatcactttcaacagtcccatcatcaaagcttacagggaaaagactcagattttgctttcaagagaagttttttccctcaactttatcccaacacacaaacaagagaaagtgattttaaagatgacttcctgacaggcaagcaagtacacagggtaatttaatgttgttaaatatcccac

SEQ ID NO: 133461 - DNA, 1131 bp, Homo sapiens
taactattagcaagtcttttcggctgggcgcggtggctcacacctgtaatcccagcactttaggaggccaaggctggcggatcacgaggtcaggagatcaagaccatcctggctaacacggtgaaaccccgtctctactaaaaatacaaaaaattagccgggcatggtggcgggcacctgtagtcccagttactcgggaggctgaggcaggagaatagcgtgaacccgggaggcagagcttgcagtgagctgagatcgcgccactgcattccagcctgggtgacagagagagactccatctcaaaaaaaaaaaaaagtattttcagagaatcatagagtatgctagagtccagcttagtatagctttatccacaatacaggaaactgcagatgtaggcaaggtattatattgcccttgtgaaagatctttggattacagattaggaaaacaaaattccactaatctacccattgaccttagggaaataatttaatatctgtgatttggtgcctttatctttaaattaagagattgcattcagagatgatccctgagtttcatagtatcatatagaaattcagtccttcaactctgagactagaagcctgaaattcacctgactcaatctcactttcttgtttaggagtataggtttgtatttggtttttgatcataaaatgaatggaagttcctattaaccttttctcatggcaagggataaaatctatgtaccagctcactgctttgaaactttttgcaactcttatttcactattgttagtactaaacattccccaaaatccaagccttcgaagaaaacaaaacaactaacaaaacacaactattttgtagccatgtattgccgaaagaacaagaaaagctcttttgtgggatatttatataggcttcctagagcagcttgccatgctaatcatttacagactttcacaaactgtttctcacctgtcttctccctgagtaaactgcctctgcattaccagtgtgctttgcttcttactccatgtttgtttacagaatcatcccagcagacaggacatttttgactttgtgtttgtacagctcagtcgtattcacagtaacagtttttatttacccttgtaatgaatgta

SEQ ID NO: 133462 - DNA, 1042 bp, Homo sapiens
gaaaagtattatttgtgtaagtgctgaaaaataaagaagctttggtttaagaaaatttcttttacaataagagaatgaaaaggtttaacatgcccaaaaaaagggactgaaaacaatatttttaagatacagctactaatatttataacaagcttgtccaacccatagcctgtgggcctcacgtggcccaggacggctttgaatgcagcccaacacaaatttgtaaactttcttaaaacatgagattttttttggcgtgtttctgtggtttttttgtttttgtttagctcatcagctatctttagcattagcgtattttacatgtggcccaagacagttccttctcttccattgtggcccagggaagtcaagagattggacacccttgatctataacatatatttgttatctgtttacatgttctattacagtgtttgtattagtcatggctttgttgttgaaaaaagacaaaaattctcacagactagctgacgtaaccaggaagaaccagggtgaagatgctttattagtaccttgaaccaggagtttggttgggaatctctttctctcttctgatttttgttttgtttctcctcaaacagtcctgaattgtacctgctcagccttgcaacccaagagaaaagggagtttctattccactccaaaatggaaaatcccaccgaaaggggatgtagtactaggtttgtctcagtgtaaattaatattgaccccagtggtcagaggcagaatgtattccaggaagattgggggcagggagcagagcacacttggtggagaaaaacaatggccaggtaccaatcttttccaacctgggagtttccgcacagcagtgaattgggaccattattgggcagtgaattccatatgatggggtcatgagcagcatctttaaaaaagtgaaataaatacatttaaatgaaattgaatagaaaatgttaaaggatatcacagtcaggtgaattattgtttcatgaaactttcgtttccattatatttacatgtgtgtgggttgggggacta

SEQ ID NO: 133463 - DNA, 1181 bp, Homo sapiens
gattctgacagcttttctttctatcccaggaaactgtggaaaatgcattgcagaccacagacaaaagcagctaagggaagcattttagattattgcttttgctttttaatatttctaaaaccttataaatcttcataattttatgtaggtctgcttttgtctgcctagattctcagcctttctattgtttggggaatgaatttcttttttccttcaaagaaggaaatacattatcaaatagtggctagaatacccagggtggtagagctgtgttgatttgcgtattccctttactgtcttattgatgtgtgtattccctttgctgtcttattttccctgtgataacacaccagcatggaatccactattctgctgtaatcctttcatgggtatgttatttcagtgctcctgaaagcccaaagcacacaataagacatgcttataacatattttagtttatcagtgtgtatccaaacactgccttttaatctttatttttctgattttctgtttcatgaatatctgagcactactacaaagatgttttctcagacattgtctcaatgactgtcttccaggctaagctctttatagaatctcaaagactgagacctttttctcctccatgtcctctttgaatgtgagctttgaatttattaatcatcttgaaatggtcatgaggaattatgttatcattttattaaaacgtcaagatagttctccctaccctaggccctccttgatcaaggtggattccctgaccttggtttccataaacatgtattcatccttcaaacctgatttttgaagttgctcaattgataaaaggaaagcatagacgtttataataccttagcactttatacccaaaacttgctgaagctgctactcatcagaatctaccagctgacctcaccgtggcggggacagatcaggtttgctggtgtgcgtcataacgatgaggttacaggaatgaagagatgaaggcctgtggccaaggtcactgaaggccaggtcccctgcccttccagaccagctttctttcccttccctcatagtgtcttctagatgttagagacaaacttaaagaaaaagcaagaggagctataaggcagcaaagagggtggaagtagaatgaaaatcctgccctttcatgaaggagttgaaataactctcctcta

SEQ ID NO: 133464 - DNA, 1047 bp, Homo sapiens
tccccgtttgctgactaaaataggatctagcatattatgcttttaatacagtacattttttaggtacacaagaattcctgactggttcttttaaatatttttctgccagtattaatatctccattaaaatacatatccaagctcctatagtatttcttttatgtataggattgataaagtttccgtgaaccaatgtctatatagaaccgagagtcacctgttcatgcatttcggaatcattcctgagttacaagtatattggctttggagttaaccaaataacttctgtttaagaatgaggcttgtttatcaatcagttgcccccaataactctaaagcaaagtgcctaaaagcatgctacaatatatgacagtaagttaccaagatacaaggcagttactgtcagaattttagctatgatatctttatctgtatatctttatgtctgtgcttgtttgttacataatccctggatgtagtattttaaacatactgcatattttgggagcagatctattctaacacttctgatttttttgaatgttgtgtcaagacaaaaaaatattttgagggcttccctactatatgctgggtaccagagtatctaaaaagacacaaaaatggggaaaaaaatcaactctgccctagaagaccttataaacaagatatgcttttggtcagaataagccatagggggaaaggtaagcctttgttatgtaggttgtcatttctcttctttaatttgccatccagtaaaataaaatttgcatttatcaattacacaagagatgtaagaagcaaatgtgaatttatttctgatgtttacattatagctagaggaggacaagtgtttatcaatacacattttccacaagataaatgcattatatatatatgaagaagtatatgtcatgatgtaatacttatcaatttaccacttcaaaattatcaaaatagaaaagaaagtagaatcctttggcaactcatcagctaattcagttcaaccgaattgaatctggttcttcagttatctgaacattacagatc

SEQ ID NO: 133465 - DNA, 1079 bp, Homo sapiens
tacacactacagtataacagctattcacatagcatttacattgttaagtaacctagggttgatttaaactataggagaggactatgcatacattatatgcaaatactgttccattttatatggaggacttgagcatccagggattttggtatgtgcaggaggtcctggatccagtcgctcacagatactgagggatgactgtatacatacatacaatatatagcatatgagtatataacaacggataaaattcagtaaggtctgtagttttgttaatagtatttgtgtcagtgtcatttccctggttttgatcatgtactatgattatgtaagatgttattgtttggggaagctgggtaaagggtacagggaaatgttctgtaatatttttgcaacttcttgtgagtctaaagttatttcaaaagaaaaattcttttaagggaagggaaaagtatcaagtatcatataactagataaatataaagttaaggtgtggtgactccaaacattgggaatatctgaccttagacacattattactgcagtaactagaaatgtcatggcttcacattaatcatgaatgacttaggctctggacagaatttaggacactgtagcctgctgtcttctcttaggagaatagtgaaattcattccaggaagactctgatgttctgcaaaaaagagaaaaaagaaaaagaaaaaaaaggcattctgaccttatgtgcaactctctgttgtcttaaacactatttgttttaaactcctgctttgacaaccaaacctactaaacaagtagagaataggaaactaatttgaatttctttttctcccaccccttgcctctggggagtatgagttctaattgataataagagaagaaatgagaactatggtgtgtatgtaatccatagatggataaccttccagtaatggaaggttgactttatctttcttttccacagactcctctaccactttctgatatttttctttctcttctttacttctctgttaggactcatttttgtccttccctttccgtagacagctttggtgtgatggtgtcactgacattct

SEQ ID NO: 133466 - DNA, 1051 bp, Homo sapiens
gaatggcaagcaaaaactgcagcttccttttaagttaaccagaaatttatgaagcgtctttaatggccatttcattgctgtgaactgtgttgatacctgggcaatgaacagacagaacagagcctggcaggcatcaggtgctcagtgttatttgttgttatgctgttgttgtcattctctgtgatctatactgccattgaaaagatgaagaggaaaaagtattcttgcaagtatgagtgtcttggatattcatttcagtaccctgaacttaggagtgataccactgacaatttttttagggtatcctctaaccccttgtaagtggaaagttttctagtggcaggtatgtgcctgattccatcttatccaagcaatgtgacaggtaatttcccacttcatgtgctggttctttaaattctcctgtgctaacactcatctgtgctttactatggagtggcaatgagtaatctgttaggttcatctccagaaaacagaaaaccacactttccctttacctcaggaacaccacagcaccttccattacaagaattaacagccctctgttctgacctctgtgtacggcattaagcgagtagagatggtttatcaggcaatatatttctgagcagccttgccagtggaaatttaaagttatttgattcctctgaaataagtttttgtatacagtagttaaatggtgaacttgtggatttcgaaatgtacattcaggtttttcaaatcaagaagctgataaattagaaaaccccatccatacagagtagctatctgatttttgttgttgttgttttgaattacttgatttatttattttttcttttttaaatttatttattattatactttaagttttagggtacatgtgcacaatgtgcaggttagttacatatgtatacatgtgccatgctggtgcgctgcacccactaactcgtcatctagcattaggtgtatctcccaatgctatccctccccccacagcagtccccagagtgtgatgttccccttcctgtgtccatgtgttctcattgttgaa

SEQ ID NO: 133467 - DNA, 1258 bp, Homo sapiens
ctgaggcaggagaatcgcttgaacccaggaggcagaggttgcagtgagccaagatcatgccattgcactccagcctgggcgacagagcgagactccatctcaaaaaaaaaagaaaaaaagtaagcttcttatgaacaaaatgcctgttaataaatgctgcacatccttgaactctaacacgtatgtcaggtatcaaaaaggaaaaaggaaagttgatttgctctctgcaaaatgagctttttaggagatggaagtgtttgtggagtgagcaatcttgtgccactaaccatcctaaccagattaccagccaggctcctgtcagccacaggatttgccagatgaggaagggactagagtaggttatgctaccaaaacctctccttgactctcccctcaagataccagttttgcagaactgttacttcttcatttgtttttgcaggtcactttacaatttttttttcacttttttcctttggacttttgtggtcatatagcaactgcacgataactgtgtgtttctgatttctctttagcttccagtgcttttgatagtgtcagacaccgtctcatggcatgatctagctttcaactccccaaagactgttcctctcacaatgaggtcttcttaatttttttaaatgaagtcgacctcgtttttctaaccttcttttcaataattaaaaatgtgaagacctacccagaatcattttctgtgccataacttcatcttaatatttgacgtgaactgcaaatttgttataaatgcagcctctctataggaggcccttacataggggtcaaagagctccccaacctccaacacacaccccgtgtcatgctacattgaaagccccaagatgcgatttcatttatcctattgtgtctggttggatttgcatgaaatttcagagatttctgttcctacttaactatccacaggtactttttgccttttggtgtgattactgagggttgtatgcctctaactttaatatatgtatttagagtcagggtcttactgtgttgcccaagctggagtgcagtggttacaccctgaaactcctgggttcaagcaatctttctgcctcacagccttccaagtagctgggactgtaggcacatgccgccacacctggcttataaaatttattaaccctagctataatgtgatatgttttacctgccagctcatatctctaaattttaattttttgtttccttcatttaagagaaaacaaagcacttgaatttttaa

SEQ ID NO: 133468 - DNA, 2081 bp, Homo sapiens
aaagctcttaaagataaaaagataaggcttaggtatgcttaactctactctaaccttcattacagagaaggaacaggaaaaagggctgggtttagccccagtttatcattttttcactctgcctaaagggcagggtggatgtgggcaagtcagtttgctgtttgctcacattttatcaggacgtttatttggactttgagtagtttggcctcttctttgtaggcctttccacagtctttactcaggatgatgatgtgcctagctaaagcctattaccgtagaacagggattagcaaacctgcaggccaaatttggcctgctgcctatttttataaataaagtttggttggaacatagccatgttcgtttgtttatgtattgtgtatagctgctttggacccaacgggagagtcagatagttgtaacagagatcatatggtccaaaagtcctaaaatatttatatttactatctgattttcattctcacacacacacaaattcaaacccctcttagaggtgaagaataactattaaaacacagtagcattctgcttatgctatttagataaaacctagtttaagactctgatgctctgaattaacccagagatatcttttagagtactgagtgaagcaatggcctgcattccttcagcagtcctctagagatactgctttgcacaatgaaacgtttggtaggaagtgagcaacagaaagttctagatcatatttcctggacgtaccactaaatgccacacaaagaatgtctggcataaaaatggcatgaatgaccagaaatgttcattgagttgatttggcttctgagtgcaaggattatgtgtcatgtgagcttgactcatagtgtctggtatggtatggtagtatgttgcagctgatgagagggtttcataggatttagcaatcaattgaagcagagataggagtgacagtcttttgtaagagggctaatagaacatgcacatgattataagacaaccccatcccacttccagtcacaggagagccaaagaatcttgctgtctttatgtaacccataaggtcattcagcaccttttttgactccccacttcccaagaagccttgctgactctggtattcttgagttcattatcaggttaaagtcttttcagttgaaaataatgaattgaattttgatttataattagtttacgttaactcatgttagcatgaccagctctccagacctgatcatccttgtcaaaatgaaagttctaatctcacagaagcaatatccaaattaaggtgacataactgacatgaccatgggagacccacttaaatcagtatgacctatttattgctcattgctcttggctgcaatcactggaagctctcttttgacccatattacatctgcattgtattacggttatttataacacgtttttcttcattgccagactataatctccttgaggacatgatttgtgtccttttttctttgtagttcacgctcagcctaagcctagtgcctagcttactgtagactttccgtaaaagttgttgaatgaatgagtgatagaggaaaaaggaagttctgtacctttcctaatttcttctcatctgtcatctgtcctattctgcctgttcaaatcccattctgtctgcacagagtaacccatccccacctctactgcacactattctccagtgactacagttcataatcatctctcccttcctattgcattcatcattagcagctcacaatctggcacttaattgtttcttaattgattcatcggtgctctctttgcttcacaggtagcctgaaatccctaaaggcaaagaaggtattttaacatatattgtgccagttctctgtgccaatctccctccatctaacacactgcattagaaattaatgtataacagattcccaataaatatgtgtaaattaactgaattaagcatcgccatccagtttcaaggcaggcagaccagaattaaaaagtaatcttcagctatttcttgatatgttttagaattgtgtcaaaattaaccaatagcttggaaagttatcatatataaaagatga

SEQ ID NO: 133469 - DNA, 1894 bp, Homo sapiens
cacacacacctacttaaaggttgtagtgtagtagcagttctctccacaactctagtggttgtgagattcagtgcaagcgacttaaaaaaatactgggagcagaggccaagcatgcctgtcttcttttctctctgatgaactcctattcatcctttaagacccgactcaagagtcaccctttctgaaagccttgcccaacaccagtaacagtaagtcactatgtcttctatcttaacactgtgtacatatctcttttatttccgtcatcacatttactacagtgcctctcccctctaccctctgttcctgacagcagtgctcatgtttgactttcacaagtgattgtttcatgaaataatagaagtgattgtttcacgaaataatagatgggtaatttctactattttaatgaccatggtataagcaccagtctctctttggctgttaaatattatgaagctttagagccgaaggcattcaagtcttttttcctgctgttgttgaaggtctgggatatgaaaagccttatcaaagacaataatagctgctatttactgaatatttaatatatgttagattctgtgcttggtcatttacatgtgttatttcatttaatcctcaaagtcacctacaatggtacatagttattagcatccccgtctaacataagaggaaactaggattcagactgaataatttgttcaaggccacatacttagtaagtgaatggaggaggagttgaattcaaatttgcttattccagagcccaagcttttaaccactgaaatacagcctcacacaggatggatggatgcatgacagatagatagatagatagatagatagatagatagatagatagatagatagatagatagatgattgacagtttttagataagatagatggatagataggtagatagatgaatcagtagataaatacctatgattaggtgttttataaatcacttaccatgaagaacaaattattaatctttaccaacattgtctacagacagtttcatatttataaagtcaagaaggaaaattatataaaattgactggaaaacaaacccaataggtttttggttatcattatgaaaacttagccatgtttagctaagcagcaattatccatactaacatgaaagatgttctaagttacagataattcaggaatgttatttctttgttttaacctacagtctttatctctcaacccctctcccccaaaatccagacaatcactttttactggaaccagtaagaaggacaccataaaatgatttgagcttcccttctactttgattagccaacttgcctatcatagtaagtaatcagatgactcaaaggacaggcagcaatgatagaaccacagaggtaggaaattccagataatggataagcagttgtggatacatttgcaattggccttaatttggtgaattcttccaattctatttaatgaaagaataaaaagcattctaagatcctagggagttgtgtagattactttattaactttttcgttattgataaaaagcctgaaggctctgaaaatgattaaagagcacaaaaaacagatggttgtaggttcactttttttcccctagatttcaccacctgctttaatatactgagaaatcaggtcaaatgagttcactgcctacagtaccaaaagctccctgacattagccagaagacacaagtctcaatcacattggcgtatagtgagaaaaggcctcatctgcaggctttggctagtctactgtagctgtgtttgccttaagagaccaaataatttctaatcttacttcaccgaattcccctccagggagctgggtaaatcagacaccttcttgaaatttccacatgatccggagcccgtaa

SEQ ID NO: 133470 - DNA, 4152 bp, Homo sapiens
gcccttctcacacaagagaaaggaaggaaggtaaaggcctaacatggatcacatttattaaaattctatctgcttaatactcttgtgaaatgaatagtttggccatgatgtcatcatgatagccattccctaaccttgtttagaagtttgtatttctatacaaaatcaggattgtttcagtaattatcagccatctgcctccagtgtccaacacaattagttatttgtgcttagttgcatatttatgtatatatactttgtgtgtgtatatatatatgtgtgtgtatatatatatattgcattccataaaccttagtttgatttggattgttaggcagtcgtgtattccggctaatttgagggttgaccataaaatattttcattgcaatcttatttttaaaacattttaatctctttatctctttcctgctaaatgaatatagccaagttattttacattgttaaaaaattgaatagggcgtactcaatctggtaatatagataaggcagatacaaaacaaatattttgaaagtttgggtgcataagagtggaggggtaattgtcattgttgtccagattaaattattactattaattgttcttctaatggttttacgccctgtcctaaaagtgaactagagaagctaatcctgattagttgaggattctgattgagtttctgcttagacatacaacacccataagctggctatattatatgtttgattataataaactataaacatagaggggataattactcctgcctccttttcttttaataataacattttaggattatgataatatgtgaaaatagtggtatgtgtaagcataacattcttattgttttgatgggagagctgaatacgccaccttcctctagtttcctctaatcaattctaagtagcatcaaggtttactctagagggaaagatttgggactgagttctctctaagaaaaacaaaaaatatgaaacatgactttattgtaaaccagtgtaaagaccagtatatgaaggaaggtgttacctgaattgtatataatgtaatatgcaaagcaaagaaaatttggaaagtaatagggtattaaaactgcctttttttatttaaacaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatagtgagtatctttccaggtggccctatggatttttctctttacttccatgtggaggttttatgattatcataacttctttattctgtcctgtatatgtcatatatgattaaaactttaaaagttagggaatatagatattgaacttatgccaacctcataaatctaaattaggttataaaggactggtatcatgagtcagggagaatatttcttttactgttttctgtttgaaaaacaaactgaagactctaggaatctgatttcaccaacctgtctcctcccccaaattgcaaactagcaattctcacatatgccattgtgatttgaaatcttgtaataataatttttgatagaaaatccaatcttattcatgtgctagaaaacacctacacacattagaaactgcaaacaaaaaatatgtttgattatggcttcttaaaacatcagacttcctggtttccagttttcagacccagaacttgactgctttctgagagccactattatgttgatggataggttttcctttgcgtgaaaatttcatgtgagtctaattttgcatacattccagaattattttgtgagctgtcagtcagactcatgtcctgggaaagatttacatcctagaaatctattacttctctagaattaaatctcacctaacagaaaggaagtaaagatttggcaatcattggattaatgtgatcaatgtagtcagcaatgtagataaccaggcacctgaatagtgagttttcttttggtggtatttagccaggtttctgtgtacattagttatattaatacagcatctgcctcttgttttggatctgggcagacagaagaatgggtggaaaataatcagtaaccttatgccagttcatatgataaagtgatccactggatgagagtgggcccttggggaaaataagaggccctgataggctgcttgacatcactcaaaagtgcatggaatatctaagagctatatgactctgttttttcagtaaaattgtcatgcttttactctaattctaggcatttgtataagatatgattcacatcagccacagaaatgttgcctgatcaaactatttcttgtattcttatggtaaatttgaattatgccattctgaaatgtgacacagtgctcatgagcaccatttttgtagtatttaatattttaactagcattaacccccttgtgtgcctctgaaatgtgtgctttcttcattcttcctttcatcatccttcttccataccttcatatagttcttctcatttctggtctttctcttctgctgtcctgcatgcctgccttccattctgccattctccctccctctgtccttcgtccctttgttccttcctcctgggctcccactgtataagtttctgtgagtacagagatgaaaaagatgcattcagctcttgcatgttctaaattctgccccctcaacctttgaccagctgtcttttttactcctgccccctctgtccttctgtttcttttgccatttcagattccatctatctccccatgttgctgctgtctcatccatcattccctgttcccattcattatgtctctcctgtctgcttatttaccctccaccctcagttttgaatctctctggctctctcttaactcctctctgcttctcactttgctactgtgatgtcttgccctagcctttaaaactaactcatcctccattataaagttacatttactgataaattcttcaccttgcatcatttttcttctaacctctatcttttaacttttagtttcagtcttatctcctcccctccctacctggtctactctttacctgtcaactgtaactgttctccctacggagagtcctgctactgggtagtcagaggcccccattatctagtaattatgtgcttactagggttacgtctcccccttagggtttgcctcctcctcctgggatagaccctctgagagagtcctctttgcacctaggacacctgtattggactatggatatgttcttgagacaagacttcatcatatctctgatgacataccctcagtttagatttgcagatttctagacatggacccattagttagtatgaggattggatgctgccatatctaacttgcttagggcaagagctctcccagacagtttctctagacctgtcagtgctgtgatcctgggaaaagctgctatcttagagttctgtcagtgcaggcttagtctgccatagaaacgggcacactccttacgataaagcaagaccaaaacgtggggccctctagcacaggctgatctaaactccttcaaatgattattctttaaatagttctacatttccctagtgggaatgaggataaattgattttctaaattatatatatgtgggccaggtatggtggcttacgcctgtaatcccagcactttgggaggctgaggtgggtggatcacttgaggtcaggagttcgagaccagcctgaccaatagacaggtgaaaccctgtctctactaaaaataccaaaaaagtagccaggcgtggtggggtgcgcctgtagtcctagctactcaggaggctgaaacaggagaattggttgaacccgggaggcagaggttgcggtgagccaagatcgagatcaatcatgcccctgcactccagcctgggtgacagaggaagactccatctccaaaaaaaaataaaaaataaaaataaattattcttatatatatgtatatatatgtagacatacgtcacctaaatcttttttaatcacattttatgctgaagtaataaagtgaattctaacaacatgtacttacatccttagacatcaatatgtatcttttttaaaaaagtaggacattttcct

SEQ ID NO: 133471 - DNA, 1949 bp, Homo sapiens
gtgatgattgcccatgtcagtcactttccatctgttgcagattgtttatactgtgtaaagttttacagtaagtgtctttgctgctttcagtgtttctggatgaggtggtcgtctttctgattataaagagatggttgtgagatgctgaggaaggatagatacaagccttatagtgaacttggaattgtgttctttatgtgcttatggaattgtgttctttaaagtaactttgggggttcatatgagaatataaccctgctcagaagaaattacttttaaaataatatccacaaaggaactggttagattttctcatgtgttctgcagatatttaccaatgtaacctacattttttcttgatgccagatagattgtaaggaatttgcattattccatctcaagtgtataatgaaataatacactgaagcaattcaccaccaagagttttgtttaaaaaaggaagttccagctccaacttaggttcaacaattgcttctgacacttgccagtggctcattgtaagaaacaaacaataaacattaccagtggagagagaaatgtaataccattttagattttctgacaagaagtagtgccaaggacccctgcaaaaatggtttgtttttaaaatctccagttctttgagttatatttccaacgagttacagtattgaaatgctttaaaaaaaaactaatttcatgttagagtagtactttgcagtttagaaactttcatatatagtatttaacttcatccccatagttttgtaataagtaagatagtttttaaaaagatttctaattttgttttatacattaaaaataggcagattcccagtacttgggaggccgaggcaggcagatcacccaaggtcaggagttcgagaccagcctggccaacatggtgaaaaccctgtctgtactaaaaatacaaaaaattagctgggcatggtggcaggcacctgtaatcccagctactcgggaggctgaggtgggagaatcacttgaacccgggaggtagaggttgcagtaagccgagatcatgccattgcactccagcctcagtgacaagagcgaaactccatctcaaaaaaaaataacaaaataaataaaaaatgtaaaaaggcagattcagagatgttaaataattttctcaaggacacacagcaggtagtatattgaaattctgattcacatcttccatttttaatttcttcctacagtttgtgattttcagaatcttagggatccatcttatacttagcagctggttgaagcctggaatcttctgatcagaattttttctgatggtttattttattcctatgcatttgtctctggttatatagagaaataatataaagaaaaatcctttaagccaatataatggatttttcatttctagacatgattttaatggaggaatggcccagagtggatggggttgttgaggaagagaacagtgggccccttcatggcctctttcaatttgacgtggtcttgtcctcttgcccaggagtgggatcattattttagatgtgaagcccttggtagtttccattgttttctgctagatgaaggcttaaagggaccaattagtgcaccacaaccttcttggaagtccactgtcatgataacttgagattagtgttctgtttcaaatcccaggaactccaaacctggaattttgtaaattaccccaaaaagaaattgaggccagtcctgggagaagtgtcttttactgtctccgtggcagattgcattagagtaatttggcacttattggattctgccagaatggtggggtgtggtcagcataagaagtttctgagttataaggacctgatatgataatgaacccagacacaaccctctgagccacagacccatccaggccctcaattaaggtccttgagatggaactgcaaatgggctttaggtggcttagt

SEQ ID NO: 133472 - DNA, 1108 bp, Homo sapiens
tctagtgaaatagcttgaagatctgtgagagtggtttgaattccgacatgtgaaagtatgtgctttgcttgtgaagtggaaattgccctattcaagtgggcttatgagtcccctttgtcacttagcttgtcactgaacttaaaatctttgttctttactttcaactttactgagggggaagaatttggtgttaatagatgtgaaagctctgtagaagatgttactggacacatcagagaaagaactgtgatttttagactcttggcagtggcttcacagtggccccaaggagacaggggtaggtgggactgttctcattgatcgtgatagagacagtgaagcagaaaaccacttatgtgatttgtctgaggtcctacctagctggctgaaatccagagcatccaacacgactacatcacctaacatctaaaatgacattgccttgaagggagagaaactgaaatggacagatacttaagtgcaggtctgctgctaccatagagtgcctttgtgcaaatggaaaaggcatctctaggccccatgggcaggcagattacacaaaggtgcttcttagtgactaaccaaggcacacagcttggtgagcagaatgctgactggttccaggccccaggttgatctccaccacatgtccctttgcacaaggcccaaaatgcacaaccacatagggaggccctgcatagacgtttgccttgacagtggactagttcatagatatttgtagccagttgaccaaatccttattttacctccccacttttcattcccaaggtaaaaaataaagttcatctattaaaaaactaattgtatgtgccccaccttaacagtattcttaaggagctctatttttttaaccacttttctctccctgtaaattatactacccacccttcctttttgatatctgctgtagcaaattgtaaggcagcactctgcccacaggacgtggtctttaaaggagtcatttcctcttccatctcctccaggccattcccatcgtgtttttcgtggcactggcaacaggaaggcacactgaatagcagtgctgaaaaggcactttgttgtttatgttattactgtgggtttgtct

SEQ ID NO: 133473 - DNA, 1035 bp, Homo sapiens
aaaaaccaaaaagagtacttttctagaagcaaacttcatagtcctctatattatgtacttatggatcttcatgttagagttataaaaatatacaggatgtaagagaggcatgtgacccatatgaaataatggatctatatttgggttgtaggataaaaatcagaggttcttccaacttaggatcaaaaatagtttgagcccctaactcattttttcctatagcagtggcttgtcatcatatcaacagatttcaggaacctctgtcctctcgcctggaggcactccaaaattcatttaggtggtttatgtaatagtggaacgattcttagaaatgggacagggtggatataaggtaattgcttttttttcctgatgaaatagtgcctgtgggttttttttttttttttttttttttttggtagtaatttcacaaagatcctaaattgaaatccgctggaataataggacacacaggagtagccgctgttctctattacgtacagcatggctgtatctgtgacctgtggttgtgcatattgtaggtttatttttcacactgccagttaagatttcccagagtttgacacaaaatctacaatcactgagcctctactgatatatttgtattgtccggaaggctgtcgagttcttagtcaagagaatggcttccatggttttctttcatagtgaatggttttggaaataaaattttatgctcatacttactgaggtcagaatcctgaaatttcgtccagtggtataaataataataatatgtcacaaggtatattaaccatttgccttgtactaggccctgttactactatttatatacatcatttcatgtagccctgtaacatccctttgagataactactcttatatccttattttcagatgaggaactaagaagttaaaaatatgcccaaagagccacatagtagcattaactccagctcagagctgactcttgacagctgccaacaaattctctttgttcttctgggtggaagaccatgaaacaggaaaatatta

SEQ ID NO: 133474 - DNA, 1810 bp, Homo sapiens
tattattcattcagcaaatagttggtaagcaagatctatgagctgagcctaatgtcagcagtttagctatagtctgtgttatgttccttattctcttgactagaaggtttattgtgttatgtatatctatagatacatatacattaaccaaagtgtgtataaaatataagaactaaattaaaatattttcaatgaaattataaaataacaatagatgctcctgttagagtcacttttttggttatattatagccagtcatgacttttatagcaaatggcagagggcttttttttttgagagttcattttattgcatttttattggtaggtagtgaaactgactttcactaggaaattaaatctcagcatctttgccttgaaatactttaatagattaacatgagtgatggcatttgttttcttgctgtgggtaatcatatttatttctgcatgtttaattacggggtttttattccatcatagacatgggctgtgttttcatataaaacagaccttatttcaaagagctcaaagagggcgaaaaaaagatgacataattgggctagtaatatagatataccatgcaaaatcaaagtataaacctgcaaagtcattttttggggaactgcgatttaaaacacagcttatatctctagccaggaagccacaggttctttcgtttgcttttattgatttttattttttacaagggactttaaaaaaaataactgctcgttggcctttaactaggatctctgcctttcttttaatttatttatatcctctgtaattacttttcctttctttatcctaatttttcttgattctgctgcattacaccaattttcatgtctcctcttgtttcccttctaaattttcatttatgttttcagataaatttattcactatgatgtcatctgaccattcttgtgatgcaaggtagtgcaatttctttaaggcttgaaacaagggcacactagggcacactattgatactgtcatatgttgccactgacgtcatttctggggtaagagacagttgtaaccagtaaaatatctgcagagctttattaaatattctcttctcctacttttgaagtgcccatttcccagaaagactggttatttgttctttgaaaatgtaagcttttttcaattaaacttttccattccacacgaaaccctgaacttctaggtgagcaaatcttattgtaattatcctctcttcatagaaaagcaggatcgataccattgtcctgcatagcatgccaacctataaattatactgtctgtcctttggtccctgtagattgcattaggtacactgctccagcagagtttgaactttgtggttgtgctggttatagtatatggagagaggaaataagcttgccttggccttagcttcttaaacggcattcacacgtttgtttatgaatgagtagggcagaccagggcagagaaaataaggcatttgtacatcttgctgatttgtttctggcttcaggggccatttaaagagaaagagtaagcatgaacagaccaaacctgaagcaattaatgagcagataacttcccaagcatgagcatcactgccacttaacctgtgtttagtcttgccccatgacaaatctttcctgttttccttcctttttaacatttcctgacaatagcacatattttcagaattttgattttgaaattgatgtgacctataattcctaaacagtaagtaggggtatcagttgcattaggtcaaacctcaaagttgatcaattcttatttctcataagacattgttctttagcc

SEQ ID NO: 133475 - DNA, 1049 bp, Homo sapiens
tgtgttaggcaaagaagtaaaaacagtccaagaagctgacatttatagctagtgtgatggggcctaagtatggagatggaaagacacgaatggaaataggaaagtacagaggcaccaacggaaggagtgagttgaggtgaggtgccttcaggccattacaaaactcaagtgctttgaagagggcctgagttagggaaggaagagacttggctgttagttgtgtacaggtgatagctgcagctcagagaatggccaagatggtcagtgggctaatatggagaagtagtgggctgggcatggaattctggcagatgattgcacgtgggatcagtaaaaggaaagaaagagccaagcagagaaaggaagcatggctggagaggctggtggagaactaggcagcatttccaagaagaagggggtgactgatggcgtcagacactacagaggagggtgaagactgagaagaagccacacgtaggcttttggagacctctgaaagagttgtttccatgtccactgagagcagaagattgattgagagagggtgattaagggaatagggagaagtaaagacaacaacttacgatctggcagtgaaatgaaggtagtagtggtcactctaaatggttgaggggggctgattggggcaacagaaaaccctcccttctttgattcactcattcctatggatttagagcaatggtcttcaactaggtcagactacgtattgtattgaaaagatctcccaggttatgtggtcaaagtcctgtctctgcgttggaatcccagtgctggaggataaagcacagaacccacactgctgctgggtctggagactcaatctcatgattgtgccagtgctgaaaaccatctcctgccctgaaatcctagatactcctcatgccagggttggggtgagcagagagagctgctgtggaaagcaggaaggggagattgaaaagcatggtttgtaatggaaatgctgcagtaactttcctacttggtacttgctctcatccatggacgctttgtaaatcagggactggaac

SEQ ID NO: 133476 - DNA, 2169 bp, Homo sapiens
ttccataatactatgattgggaataatccatattggatgggccagctcttaatggtgtgcaacctcacttcttagaaaggactgcaattgagagtctggattgttctcctgcacatatgtacttgcatgtgatgcttccatacacagttactgttgctcttcctgagggctgcatacagaaggattggtgcctgggtttaagcccaagcatgctctccttctgcttgactttacttcattcacacactttggagtttgtttcagatgagtgtataatcttaataaattatgatttgactgcaaaattttaaatcaatcacttaataatgttttattaagactctaccatatatttagggcacagccctggtcctttttggaaatctttaattttgtttttctactttgccttgatccaagaggattttaagtggtttacaaggagcaaagtaatataagttggaagtattacagtttagaaaaggaaaacagtaatttggggatctggtccaggcttctatataatttttcatttagttgagggaatacaaatgaatttttcaaacaataaaaaaagtcctctgttgattggctccagtgagtagcacagtgagcactctttgagagtccaggagagttcccaaggcggggggaagtgggggccaggggcattgtagctgggatgctcaggcaaagagatggagtttgagctgcttcttaaagtgaagggtagggaagatgatgcaattgatctctgaacagtgataaatgtagaaaggatgttcagaacacactctgtcttactaaaggagctctcttttcaactggtacatttttcatgctcagtaactacctactttaaaattcagtagggaaacatctttttaattctcagtttaagatgcaaagcataaatatatttctttaaagacagtacattaactaactatagaaaataataaactccagatgacgactgtgttttaataaaaatcataactttatataccttcatttaaaaagtttgtattttaatttagacaaaatattggccaaattttataacagctaatttccaagcttacattcattttcaactcaagatagtgttgtttaatttgcatttcaagaactactcagttgttatttttatattctttttataactcattgctgtatgcatctaaagttactgtgtgaaatttctagagaagtactcctgattgggttattttgtccatcagtatgattagtacatgcaactgataatttggtaatttactcagctatagcttttggtaaagactgacaagatatcacaagtaaccgtcttagctgtgatgatttggtttagttttaatttttaatttttaattatttatttattttttgagacagtactcagcttactgcaacctccgcctcctgggttcaagccattctcttgcctcagcctcccaagtagctgggattacaggcacctgccaccacacccagctaatttttgtattttaatagagatggggcttcaccatgttggccaggctggtctggagctcctgacctcaaatgatctgcccgccttggcctaccaaagtgctgggattacaggtgtgagccaccacacccggcctaaatttttgttttttttaaatcactgcccaactttattctaccagctagtgataaatattatgaagcagaattcatcaagtatggttgcttctttctttctaggaatattagactgaaacacaattgtctgtgtcctcactgaacttcatgtaaacatctattatagcaactttctcagtttaatatctgttcctcttcttaacagtaagttcttcaaggatagggttactgtatcttaatcattatattcctagcactggaaactgtagccagcacagagtaaatctttagtaaccattgactcagtgaaagctttagtgagcattgctacaactaattataatcagcctcacccaactctgtattaccattttgcagcacttgccaactcagtacttcatagactcatacaacacgagagatggagtgatttttaaggagacctaatttccttttttacgggtgaaagaaagctgagatccagagaaaggattgacttgccacgggacagagagactgtgactggcagagctg

SEQ ID NO: 133477 - DNA, 1825 bp, Homo sapiens
ggctctctgccgttgtgcagctgacattgtaatgtgtgtctgtgtaggtgtgaatatattgcccgttttggggggggtgcggcataaaataaatggtaaacataatttgtgtagaaaaaggtctatattatgggaacaaaatagatagtagtgtcaggggcttgggacatatacagaatgaagtaagatgtcagcctcactgagatactagcatttgggccaagacctgtaggtagagagggagcatgctaactcctatggtgagcctggcagggacgtgctgtggtccagaacttcaaggtcttcaagctatttttgcacacccataagcataagcccagaatatattcagtcccagttcctacttcgctcgtggtcctctaaagcactgtcttcagcctcaaacctgtcatgcagggacagaccctgggaagcatgtcctttccatgcagtgaaaaatactccatgcagtgaaaaacacactccaggcataatgcgtatcagcaggggcaaactaacagaaaatgagttgttccagaaggaacaaaacatacttcatgatgaaggcaaattgtttttcacacttagctaaatagaatttgggatgtggggtgccatgtgcaattaatgaagtaggctttctcaaatgaaaatatgccaccctgggcaacataatgagaccctgtctcaaaaacaaaaaaaacaaaaaaaaaaaaacagaaaaaatcatccaggtgtggggcacatatctgtagtcccagccattcagaaggctgaggtgggagggtcgcttgatcccaggagttcaaggctaaagtgagctaggatcacaacactgcactccagccttccagtttaggtgacagagtgagactctgtttctaaaaaagaaaagaaaatacggtccaccaagatatcttgacttactggctgtcttacctgtgtgagaaagggtataaataattccactggagagtggaactataaacattattacaaattcctaaacactaaagaatcagacaggacatatttctgagctctttccttttttatggtggggaaactaaggcccagggagttcagtgaacagttcagctgcttctcacagcaggtccctcctggggccacggtattgccatcaagcttccttgttcattagaagagctgactgattaatacatttctaaataccatcaattatgagataatttcctatcacctttccttgatgtgatgattgattttctactcactaacgtgctgtgtggcatgcttggacactaaacaaattactgaactttgtaattttcttgaaggaaatgtaatgcacacataatgaaaaccagacaggggctgtaaaatacagctaactgggattttcaagcctcgccacatttcagaacccaaagggcagaatttacttttaaccttagtgaactggttaggtgagatttttcagatatggtctgttttctttctagtcacagtctaagtctttcggttgaatctcaccgtatcatatctgcctctcaagggactactttgcagtactttgcaaaggcattaggtataattttaaaaatattttaggccttattcacaaatatccattagatatcaagtgattgccaagaaagtaatcaacaaaactagaagatatgcctttgtagtaagtctggacagatattactcatacgtccagtaagaaaaatccagcatcggctgggcgtggtggctcatgcctgtaatcccagcactttgggaagccaaggtgggcggatcacttgaggtcaggagtttgaggccaacgtggtgaaaccca

SEQ ID NO: 133478 - DNA, 1054 bp, Homo sapiens
ctggctttgcagctaggattcctaactcagattcctaactccttattcaccattatgggaagtcgcacttttgttgcagcttgcttcgttcattgttttctttcatgctttaaaattttttcccgcttgaaataagccttcttttggtttcctaatagtcgtttgcattttctcttcctctgaaatatagcagaacagagaagtcaggcaaaatggccagcagactgattagagacaactggcacatagtggtcctcaaggcagctggctcagcaggcagattggattagaacaagccttcacacccccacaggggcttgccagaagcaagtgctggaggagtcacctacacagcttcagagagaatcttttttcccctcccagttccaaccctgagagtgtttctgaagctatagaaatgctagtagctctgagcatcttcttgggctggctgtctctttttgtcagttgttgcattatttgcttctcacccagagcagccacccatcctgagattttatctgcagttagagaattctccctccatttctgttttgagggcatacttgttggtcaaagacatcctcttgtcttcagttaaacctgtttttctgaaataccaaaatcttgagaagaatttgagagcctgtgacagtgttaaataaacttggcagtttctacttcatgaattatcaaaactactttggtgggcaatgaacagggaacagagactagacagtttggatttggagtaagtggaggaagcaaagatagggtgtgaccacatgggacagagcacattttcctagagaccaaaaactctgattgtaccctggtccacagactcagtgcagaagcaggtatattaaaacccaagccttataatagatactgggaatgccaaaagcgaggagagtgggggcgggggcaagggttgaaaaattacctataggttcaatgttcactagctggggaatggatacactagaagcccagtccccgccagtatgccatatacccatgtaaaaacatgcacatgtactgcctgagtcta

SEQ ID NO: 133479 - DNA, 1053 bp, Homo sapiens
tttttttttttttaagagcatagctctaaatttaagaaatcaatttaataaaatgtgaaatgtgtaaatatattttctgacagatttctccagatttgtttaattttacaaattaaaaaatggctgtgaccgggcgtggtggctcacacctgtaaccccagcaccagaactttgggaggctgaggctggtggatcaccagaggttaagagttcaagatcagcctggccagcatggtgaaaccccatctctactaaaaatacaaaaattagccaggcgtgcctgtaattccagctactcaggaggctgaggcaggagagtcacttgaacccaggaggtggaggttgcagtgaaccgagatcgtgccactgcactccagcctgggtgagagagcaagactcttgtctcaaaaaaaaggtcctgcctttctttttaaatgccagggagactgtattagagcatttaatagatcactgaattatattacaattttaaaccttaaggggaaggcttttatttttatatcagcatttattgaatttgaatgtagtttcaacaaaagacaaattttcatgttgataataacactttttttttttttggtccttgttcttgttctttctcttcctagttttctctttcaatctcattaaaaaaaaaagttttagggaaatgtaagttgtccaaaattatgagtgatttttagtgaatttggaaagaggcttttctttccatccgtactgagacagtaacctcagatttggggcctggtatttcaaactcttaaaagcaaaggattgtttttgtgggctgtaaatgtagaatgctgtagctactgggaaagttaaacagaaatctaatttatacttttctccctttctgaactcagttgctaaagcacagttaactctcagagagttgtgctggacagggccgaccctgttggtatgtgtttgcttttttctccccttaacaaatagaaagaaaatagttcattaaaacctactaccctcacttttcagcaaagctcacttagaattccagtttgttcttgg

SEQ ID NO: 133480 - DNA, 1252 bp, Homo sapiens
ttatgaagtctttcagtcaaactctcaagttttttaggggtctggaagaagtactgtggaggattctaggagtatggtatgccaacccaaataaccaatacaaagatatgtgcgaatcggcaattacattgggaacagaattaagatacattataactaagataaagtatttcaaaatttaaacatttaaaataatttttaataaagaataaagtagaaaacttacaaacccatgtctatttgaaggattagctattatgtgttttgtaagcgagtagataaaaggagtaactaacttgtagttttacttgtttttagtatgcatattatagaatgtttgcatgtaaaattaatacaatttgactttgacaaacatttcggataactggaaagatggaagcaaaagcttcatttgggatgaaatgtcagtttattaaaatttctaggccatgataatttaagagtttgggaaaaaaccaaaagaacaggtataaagatagttgtgcatttggttagaaataagcggtgacgtattttgacaaagagaagcatactaattgaatacagtgggcaggactcattagagactgtgataataaagggaagagaaaaaacaagaaacatttctgcctggtatcaagaaggacttaacacagcaaattggaaatgaacttgcagcatcactagggatctggaaggatcaacatgtgtccaataagcattggacagttgatccttctttgagaatattctgaaaaccctgcaatttacagacaaaagcaagatgctagaaacagatcagaaatgaataaacatcataatgagacattaaacaggattaaggattttttttttttttttttttttttttttttttttttttgagacagggtctggctttgtcgcccaggctggaatgcagtggcaggatcttggctcactgcaccctacgcctcccaggctcacgcagtcctcccacctcaacctcctgatgagtagctgggactacaggcacgcaccaccacacccggctaattttttttttaaaagatgggattttgccatgttgcttaggctggtctaattcctgagctcaagcaatcttcctgccttggcctcccaaagtgctgggattacaggtgtgagccaacatgcccagcctcaggattaaggaatttttttgaaatgtttaattcagtaggtatggcatgactaagtaaagtgaaggaatcaaaagttgttttgaggtgta

SEQ ID NO: 133481 - DNA, 1042 bp, Homo sapiens
ctagtacggctttcaaagctctgacctcacatatctaatagggcaagcaaaatggaaagacagcgtatacttgggggcagtgagtgggcctcaaagaagtggcaaaggcagggccctcaggctggggtgttgaggaagtcctagatgacaatcgtataatacattcatataaagacagagcaatagcaacatgtcctcagccttacaaaaggaacttaaacgtgaaattttcttccaaattatgtggtggcaaggtcagtaaattgctttatttttaagatgtaaaattaaaataaccatttcccgatctcctacttcctcccctccccaaaaaacaacctattttaggtaaaggaaataattcaacaaaaatatacagaaactatttaaacgtgcagagaaaagataagaactgctgctacgaaagagagcaagagatggagaggagaacgtgtgatagggctggctactgagaataggcaagaaaaagaataatttagatgagaatatgtatgaggatatataaatggcaaaatggatacagtaaaaaaatcaaaataaggaaaactaaaggttctcatttttgcttaagtgctgacttcagtgcattttatatttgaatattatgttaatgaattagaaagttaagccctgaaacaaggatacataaagtaagaaacagattatggaaatttaaaacactctcttgctataccatatcttttgcatttcttccttctcctactcctccagggagacagagtctcactagcttgcccatgttggtttagaactcctggcctcaagtgatcctcctactgggattgtaggcatgagcaactaaacgtgccccacctataccatgacttttgagtaagatactaccatctgacgagtctctgggcaaatgattgaaaactaagtatcctgatcatgtctcctcaatgcatttttgatggaatttttgttactagagctatgctgttgtttttttagacagagtttcactcttgttgcccagcctggagtgcaatggtgtgat

SEQ ID NO: 133482 - DNA, 1081 bp, Homo sapiens
gtgccttcattgagctaatggcatgataaaaggggaagttgaggaggagctgttctgtattaaaatctagaagagacaaaatgttgttagtgcatgtcctttgtttgtatcctgattggaacaaagaaatgagaaaaaagaaaagaaatataatttttaggtaactggtgaaatgtgaatatggaccaggcttgataccaagaaattattctttcttttgttaggcatgacagttggcattgtcgttgtataaaaaaagtttttattttattgctgcatattaaagcaggtagggatgagtgacagctttaggacagataggacttcctctgaaatacttcagtaaaacagttttaaaacgtagaataaatgaagcaaatagtatagtatggtaaaatcttggtgatttttgaaaggtttatgggagtttattttataattctccaaacttttatgtatgtttgaaattattcctggtgagtgttttaaagtaactgagttctagaaggaaatagctactgaagtttattaagtaattcacaagtgttccaatttagcttcttttgttgtaaatttctacttttaaaaatggggatcatgtattaactaggtaagtgctaataaactgccccctgcccccagatttgtaaataaaatctgtgatcaggcttctatccagcatgtcttctaccactttgtaactaaatgcaaaattttaggtattttctaatttaggaattgtatgagtccattttcatgctgctggtaaagacatacccgagactgggcaatttacaaaagaaagagcttttattggactcagttccacgtgactggggaggcctcacaatcgtggcggaaggcaaggagaagcaaatcatatcttacgtggatggcagcagacagagagagcttgtgcagggcaactcctgttttttaaaatggtcagatctcatgagacccattcaccattatgcgaacagcaccggaaagatccatcctcataattcagtcatctcccaccaggtccctcctgcaacacatgggaattatgggatctacaagatgagatttgagtggg

SEQ ID NO: 133483 - DNA, 1347 bp, Homo sapiens
cgggaggctgaggcaggagaatagcttgaacctgggaggtggaggctgcagtgagcccatattgcactacaacactccagcctgggcgacagaacaagaccttgtctcaaaacaaaacaaaacaaaaaaacgggtgagtgagatttggttggtacagcattgtttataatagtgaaaatttggaaacaagccaaatatctatcaataaggaagtaaattatagtacagctactctttggaattcttttcagctgaaataaacattgaagtagaactatatgtcctgatctagaaagtaatgcatgatatattatgtcttttataaagcaagttgcaaactatcaggtataatgtaatcctgttttaataacaatatatgcaagaaagaaacaacctcaaaatgtatatgttgtaaaaaatactagatggatataataaattcttaatagcagtttatttctgagttgtagaatcaaggatcaatttttattttgtttcccatttgtttgaaaaaactcactttttcctgctataaattgtattctctactcttttcacttgttcttccatctgtccatccatccatccatccatccatccatttattcattcattcatcaatccatccattaaatccagatatttaaggagcacccatatgccatgcattgtgctaagcagtgcatctataactaacagataggttgctcttgaattgctaacctgctagctgggttacaagcaagtccatgggcaatttataatacagtgcagtaagtgttacagtaggagaaactatagcatactctgaataggcaatagcctagatgggagggacagaatggctccctaagactttttattattttaactaaagatgatatttattgagcatctgttctgtcaaagctttgggttgatttaagcccagtcactgtcacccaagagcccaaaagctattggagagggatgatggcaagctggtaatatattgtgccttttattagcattaagtaacagtaatgcacagcatgtgggataatgacttcagattgtagagaaagagggagaagagcctggattatccagtgacagaacagttggcctcttggtaattaagagtggttctatcgtttctacagatattactcttccatagactaagggtatatgataattctgaataaattttgtcatcccgctttcttggcccttcttacaattcactttctttatcttaaatgaaggatttcttgcattgcttttttttttttttttttccagggaaagtgttttaaaagttagtgaacaaaagttcactaacttttgttgttgttgataatagta

SEQ ID NO: 133484 - DNA, 2063 bp, Homo sapiens
gtgttgtcgatattggcctccctgtgaggtggtgaaacgtccttaaaaacagtgcttctgtggtaagagttcagttaattaggtgattgtgtgtgcattctctaaggcactagcctagtctttcttctcttgaccgtcttctagccattttactatctactgggcagctggtggatggcaacaggatgagatcatgtagctgtttgattgtattaatggaacactgcagtcaaagtacctcactaaagttggggattaaaatacttttagattcacctttcagttgaccttgatccttggcataaaataatcaataccatatgctttgtgggtggcgtgtatcagtgttgtgcagtttttgccagccatggaggagaatggtggcccagaggaaggggtgcctttttctctctacagcactctctttttgccagactctataaacagaaagtggagaggtgggtacattattctcatatgcacagaagtgccacatattccagtgatgacagctttgggtcttcctaactgaatgtgaggttgagaacattgattttgtgttctagagtattgcttctcgaacttgaatatgtatacaaatcatgtgaggctctcattaaaatgcatatttgtatttcagtagatccagggtgggcctgagattctgctttcctcacaagctgatgctgaagcagcccaaagtaaaggcctcttggaagtaactgactctctgccaccagaggcaatatgaaatcaccagtaggctaccttttggagagaagatcccagaaaatacttcaataggattttggccatgagacattcagcaaattatttaaactctccatgctatgccttgtcggaaatgtgaggagataatagtattcactttgtatggttagtgtgagcattaatgacaatatatagatgcaaaacttttgggacaataacatcaacatagtcagtgtctactaaatggttgttgaattcttcccagaaagtgctaggtcaggagaaatgtatatctgtttggggaaagtgcacagtatttgagaagaaattgcttattgtttaaagacatacaagaggctatgatccaagaatgagacttgggttccatgatccggtgcaacagtggtttcttgggagcagtggctggcctctggtaggatttaaggcatcagaatgtcaatgaaagtgggggcccttctgaaggggttcatggatttctgtcactgctgagataaaggagtcttaacttttttcccttgactgcagggtgtttgtaaggtaaggaaggaggcagatagtcgaataacgaaagaggcaaagggacagaagaaaaagggagagaaataactttagccaaccacttctgggcctttttcatttaatatgctccaaaatgtgaggtaagtagtagtgttctaattctacagatgaaaaatgtttaaaatacctgccccaaataactcaatttttaagtttatggggctggattaagcccaacccagaattaggcttaattccctaaaggcagctcgtatacttgactccataaacacctttggcacctaggacacatgtatttaattttcttgtgcaaaagagtaaatgcagttacctgtggccactccagctgtctttccaccacttcagccagctaaagttactgccgtgtccccaggacctagcaaagggcctgacccacagttaggctcagtaaatactatggaatgaatgagtcagtatttaatcagagagccgattacatgataccactattattatggatcttttaaacttttaactctgataccacctatttgatttctccttcttgactgtacactccttttacttgttctttatgttttttgttaatccacacacttcacatcgacttaaataatttttaaaatgccaccaagtatttttcatttctcttcgagccagaggaagtgtaagacatgtactttgcttatggggacttgcagtctcattggagaggcaagatacttaacaaaattatttagttctttaatgtgcagtcaaggcagagt

SEQ ID NO: 133485 - DNA, 1649 bp, Homo sapiens
gttactagttatttcatatttgtttgccttattttctcagattgaaaattatcttacagtaagcaagcttcttcctttataattctttatctcctccgtaacatgccagacatgttgtagaagcttttgtttattgagtgaattactccagatagcggatcatagtatcctttgatagttggcttataatctctatgaactgtgaaataagggtggtattgtggcaatttcaaagtattgataggccattgctctctttgccagtcctgggaagagaaaagaatctgatacaatgcttcttcatgtagtgaattttaagacagttgtctaagagaactccgcctcaccttgggccaatgttgagtggacagttgcacctttttttttttgtaaaccagtttttccttttagacttgaaagtcctgataaccagggcttatttagcaccttggctgcagctgtctctgacaaactagccaggcgttttgaggcctgacacctgtgtttccctttcgcctagcatggaggggttatgagaggatgtattgctacagtgccttttgtcctctctaagcaattctgagaaagaacttgtcacaggaaagtacctcgttaaacacatttgacactttctgaattttctgtacttcctgaataatccaaggtcccagaagccatttttcattttcctgaaaaatgtagccaggattctggaaaacttgccaacttattgttgcccttgatcaaggaataaaacattactactttgtgcaacatgagtgaattttcttagtttacaaaatgccaaaaggctgatttcattttagtatttcccacctagataataaatacataatagaggcagaattaataaatacatattcttatctacccctctgaagagctctatcagtcaaggttctctgcttgcaagcaacagaaaccaacactggctaacttaagcagaaaatgaatttatctgaaaatggactcactgggagaagggagtagaagctgaaggatggcctcttagaaactagggcaggctcagagaactcatctgtgaaatggatgaactctggccatttccaatcttctgtcacccacctaagattcagatttctgggaaaaagtgccgatttggagcagcctggattctgtgctaagtctttagacaggggaaggctcaacaatatgattgacagcccctgagggaaatctgggtacagttggtggaagaaggggaatgatggtgttacaaattacacatcttcactgcaaaaatacacagcgtgaaaaataaagtgacacatggattctccatagaagcaagccctctgattttactgtttgctaagtctttgttaaaataaaatttcttattctggagtggaaagaagtaaaggggttagtgacttagttatatacgaagtagctagctgaatttgactctaaggattgaatataataagcttgggattatcccatttccacaccacccccacccccgccagcttcaattgttttaactctctaagccttgaatttctccatctgtgacaaatagtaatgggattatttcaagggttaaatagataatgtatgtgaaaatgtctcataaatggtttttgaaagttttgaagttataa

SEQ ID NO: 133486 - DNA, 1090 bp, Homo sapiens
aatcctggctaatcaacccagtgtcctggaagcgtttcagatattctccagggaacagagctttatcaagttttatcatgttcaaaagatgctgttgccattgtttcttgcaagatacatggttacaaatcactatcaaaattcagtgctgagtggtttccaaggaggtgacgggtttgggtttttcattgttgttgtttgaggtcatctgcctttgaaatagactctctccctctaattttgctaaatgttcaccataggtagtgtttccaattctagagtcgctcctctcagcaggctatctggggatgttaaatccaaggcatggtatttggtttagttatctgagagactgagatggcactgtggtctgatgagctgctattgttcatctttcagggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggtaggtgcgactcttcattggagcagtcagctgaatgttccaggtgttcacaataatgtgacaacacgagtagcctcttgacatgtctggagtgcataggggggtttggaaatatacattttccatcccatcataaatgagacttttaatagataataagttattgataaatgtctttttcttaaacctctaaagttatacctataaaaaaccagatttgtatttttagtgatatcaatgaaaggcatatttggatgttcagcaataaatattttcaggtttaaaatttggagaagcacattatgttaaggagagagtttgtaagtatcataaattggccaaaataggggatttcaaagaggtggtggccttgctttttaatacattgaaaaaagagtgaaaacaacctaaaactattctgtctggtttaattttgaattttgtgattttctttcagtagtaccacaggcttcatttgatttcaaaataggtccatctgtcacttc

SEQ ID NO: 133487 - DNA, 1355 bp, Homo sapiens
ttaattgtattcaactcttgccctcaacagacagtcatgaaaagacgggaagttatggcaactttggtcttagagctgctgtgtttcaaatgcaggattttaatctaagtagaggaaaatgtgcagaaaacagaatacacatattttaaagtagatatagcctggaatgtggacaacacatggattgagttttgactcagtgttattgaatacttttttctttgcaggtgtggattgatgatgtgcttattggtagaaaatttctccttaaaatttctagttctacttcatccaagtgtatgtgaaagtagcccaagttcagatgaggtggtgctgagatttcatgtttcaaactcctagcttaaaccagtggacctgaagtacagttactctataattcagctccatgagtcttgggttttgttcttggctgttgtttatctgggtgctgaccaattaagagagtggggtgggggcattcgtcctgagccttcccattcattaagatcttcagattagacttctgatagtttgacaatatctccagatacagtcatgaaaggccctggcagtgtgaaataaatatattcattgtgtaactttaaatgccacagttttggtaactgttttggcataacagagacccttgaaaaaaaaaagtagaagtggtatgggcttccctcagtctgtgagaggccctggtaaggtgtgttttctgcccccacccccttttttttcttcagagtaaagatgataaaccatgtagacccttgaagttcctggtagtattcagtgattgttttccagagcccttgtatggaaatgggcaccaccatccttcggagcagtggcagtaataactgacattttttaagcattgagcaatgcttctgtatatgtggtttggccttggcagctcttttgataacataatagcccaagaagccagtttaagtgagagaaggaaccaatgagtccacgattgctttcaacaataaatgctaatttattaccattaagaaggtacatatgattggatttaaaatggtcattttactatttgcagactatatcatgcaaataggcaaaataatcattgtaaacatatatatggcttatgtgaatcagacacatagagtaaatacagatttttggcagaacttgtatgtgggaatcctgttgtgttgaaaagatcttggggggaagaaaaggcctaaaatggaagcatcagattgtgtgagagtgtgtgtctaatgtgatgtattctaacagcttacaaattgatgcactgtatcatagtatattgagtttgtgtttgatgtttgttctgatggaaggagatgtgaatgaactgg

SEQ ID NO: 133488 - DNA, 1043 bp, Homo sapiens
tcactagatgccttaatgacttttttatcttttctatgatgaaacatttcagggggaaggttgcatataagacagttggtttctgatcgtttttttaaagactaaaaccatgtttattatgcttcctccaatgttatttttatgtattattgggtcggtgtattaaaaataaggtctgagtatatactgctataattcagacagcatttgttgggtcatgaggcctaaaccaagaactaatccaagagccatacattatatcttgggttatgatatctcttcccctttaactctagtttttgcttcttggatcacttcatgggttgtagaacaagaggagaggctcaatttaaattaagaggcaaattggtttcacttcctcgtttttcaggcaaatggtaggaagtcatcatatgtgcaggctttactaaacattaataaaatgcaccgatgtactttctttaactttactttctcaaggagtaattctggttgtaagagtgtcctttcttatttcctgcctgcttgttatacatttcaaggtgtgatacttccgagcaaagagatccttccctttgcaggaagaaggcatatttccatgtgcaatttacttagtagtaaggaaacccgcatttatttattttaggcttaggttgactattgctgtttctgaagaaactgaaggggaaagatgggaagagagactcctgctctgttaccattttgttgcacgtctgttcctgtcactggattgaatactggaggaacatagggcaatcaggtgaaataaattagaggacaaaatttaaattaatgaaacagcccatagggtaccttttttaactggctggtgaaatcgtcttgacatcaaaattggtggtaccagatgttgcgcctgtcttttggacagcacatgtggaacacacaagaagcatctttggactgctttggagtaattataacctaaaagaacagggacatttcatgtacctatcttcgaagttctctgagcattcgctaccaaggggcaacttcctatctcc

SEQ ID NO: 133489 - DNA, 1015 bp, Homo sapiens
ataaaagactgtaaatgtgtgtatttattcaacatttctagaaccttccttgcccctcattccatatccttaggaaggtcatggggacacacctgatataggagaacagtgggaaagaagtgacactggaaggtgggataaacttgatttgtactggtgtctctcccaggtcagcctgggcagaccctcacacccagagaaccctcaaggctgccctctcctccttcatgcagccatttgctacattgcagaggggcagggggccctgtcagtcccatctgcctagttccactggtcctcccaccacatctaaaaccttccatcaaccagtatccagatgattttgtctcctgctttgaatattcagttgtgcatacttagcagcgtttcccttccaaagccccaggaagaagctttccagaatcgcgcttctagcctgtatgccctgaaaatgcgtttgacaacgtaacacagctaaaagtggcctatcagcttcacacttcaccagttttccttctggaccttccagtagtgctaaaggtgctcccattttctcggattcccaggttcaagccgtgcttctttcttggtctcctctttctctcactgcagcacagactacagccacaacctgcctgttctatcttttcaatattaagtccttccttcttgcccattttcaccacacaatttcaggcacttacctcctgtgtgggccttgcggtagctttctttggtcccatttatttgttgtgtttcttccctgtaaaattgaactgtttgtgccatgccagtgtcttcttcatgagtcctatgatgaagttcttacctgctcagaacttttcaatagcatctcataggctgttggatctgatccaaactctgtcatgtgttacatagagaaagaacaaagcggttacatcagagcccacatataaatatatatagttgatcttctgaatccataggctgtgtggattcaaccaatctcagatgcaaaatacttaaaaataag

SEQ ID NO: 133490 - DNA, 1071 bp, Homo sapiens
caagctgatctcaaactcctgagcttaggcagtccactcgctttggcctcctaaaagtgctgggactacaggtgtgagccgctgtgcacaacctaggtcctatttttaaaggattgtttgttatgggagttcatacactttttataatctgtaatatgcactataagggatattaggactgtgtactactgctaatattcagattttttccatgccctatgttcttcacctttataacttctcttcagctttttagatgctcttttacaaccttcttctattccagaatacttttaataggatcatatgtatgtcccagtttgcctaggactattgtggtttacacatattgtctagtataatttttaatagtaccccttttactcttagaaattattgttttaggatgataaattatatgatcaccctaatcattaagtgtcaggacatcagcgagtacataactgtgaggtaacccaatcagaactactttcttggatttggtttaaaaggggagggtgcagaaatcaggcttgccacacagtcttatattcttaatatgcaaaagagttcaatggccatgtttcaaaacacccaacatattatgattataaaatattctctatatggcattatctgtttgattcttgctaattcttgttggacagaataattacctactctaaaattaggttgaaatcaaaattccagaatgagttttttcacccagttgattatctgttatggctattgacttgtggtttggattttttctgtttttttctttgctttctgtattattcatttctggagatgaattgggagagaaaaggggggaacttatttagtattttagaattattcatgctttatactatctcaaggtggtgaaatttatgagtttatagtcagcaataggttgggacatcaactgtactcttcagttttagtaaaaataaatgagttttcaataaggtgactaaaatattcctagtgaggtttgagtaaacatatttagttcttcatgctgcaggatcagaattttcttatcaaactgaaggcacatgactc

SEQ ID NO: 133491 - DNA, 1066 bp, Homo sapiens
tcacaaggctggtcttagaggaattccaagtacagccccaaactacctcaccttccacatcttctgacttaaagaacatgatcttttaactctgttaccagttctgttacatctttgaagtaaagtccttgtaaggggatagaccttttttttctcccagtttcttaacaactgttttatttttacaaaatataccattttaatttgttaaattgggaaaatacaagttagcaataggaaaaagagaagttactcatcctaccacccagagataatcactttcaacactttattatagatttttctaccctacctctttctatataatactctgtgtgtgtgtgtgtgtgtgtgtgtgtgtgtgtgtgtgtgtatgtatgttgtatgtaagtgcacattttcgagaactggtatgaggtttacatatgaatttgcagtccactctttccatttggcaatatattgtcaacagttttatttagttaaacgtaataaaacattgtttctcctagttgcgtagtctctcatcatatggatggactgttatttattttacccattccttatcgttgaatgtttaggttttgattttttgatgcttttaatcaactgtgaatacacatccaatagctaatatttgcaacatacatgagcatttccttggggaaagttgctaaaagtggaatcactagagcagaaacgtatacaatattttaagatatggtacctattggccaggcatggtggctcacgcctgtaatcccagcactttgggaggccgaggcaggcggatcatgaggtcaggagatcgagaccatcctggctaacatggtgaaaccccgtctctactaaaaatacaaaaaattagccaggtgtggtggtgggtgcctgtagtcccagctacttgggaggctgaggcaggagaatggcgtgaacccaggaggcggagcttgtactgagccaagattgcgccactgcactccagcctgggtgacagagcgagactctgtctcaaaaaaaaaaaagatatggtagctattgttgagtttttttagaaagctttgtg

SEQ ID NO: 133492 - DNA, 1116 bp, Homo sapiens
ctttgtgcttccccagccgccttgctgaattctctgcggtgggttgagacccctggtgttcttggatgggacagcccacatgagcagagtggctctcccttgtttcctttgctctctttggatttatatccttccagaactagctgtttcgtaaagtatttagactctgaatacctgaattattcagatcttcttgtcactccaatcacaaacaggtaattatggaatcacagctgctttaaagaggcagtgtgtcatcttgtgttcactgaatattttactgtactttacacagttaatttcacactgggcaagctaagttagtgtcaaagtggcagaccagatttctcttgcgttacaatgagtggcagaggttggagcaatgcctcagtggaagaaatggtggttcacagagttatgtgaggggtcccatgaacttccacctactcccaaacatattttctactgggcctgaccagaggggcctcagaggttgctgaatggtaagtttggtggaggagggaataggaatggtttggtttctggtctaaagaggatatatggggtgaggcggcttgatggtgcaaggatgattgagtgttttaaatgaatggtttaagtgacaacctgcatcttgtatacacagcttcataaaacagcctctattggttgtttgatggagccaggtgatctggtatggcggaagatttgtgagccccactggaataattctaaaatgcttttattatagtttttgattatgaaagtaatttattttcaaatgtaccagatttttgaaatactgaaaagattaagaaaaaaagtactagtattgccattagccagatatcctattgttaatattatgtatgtattctgaatgaatcagtagattttgaacaggtatcattcgttcatactgcctgcctgttttctcttctaatatatgaggaacatattttctcactattgaatgttcttctaaagcagtattctggtagttgcctaacaccacatgggacaattttaaaataagaagtcactggctaggcactgtgtctcacgcctgtaatcccagcaccttgggaggctgaggtgggtggatcacctgaggta

SEQ ID NO: 133493 - DNA, 1216 bp, Homo sapiens
actgctgggtcatacgcccaggttttgcacgttggtttgtggggtgcaggcactgactgactagtgctaagacgtaatgtgcttttgatggagtttcctttgcctgggtgtttttggggtttttggaaatgtggaatcttaagaggaagaaaacatagtatttatagagctggaaaatgttctgcttattctcaatcctttattgacatagtggttactctgctgttttggttggcagtgtgattctcttagtttaagcaaaaatttcttttgtcaacaggtagattactaataaggatattttactcaccaagaaattcctaggaaccctttttctggacacatcagacttcacaaaatgtttctgtttttctttagttcctgttgcttctctcttcttgcagtatccactagcagcatggtggttgttctgtagatagtgatgttaccacttcaccatttggtcctctctcctctgcgtcagttaacttcccatctaatattttgttctgtgaactattccaggaatgattatcaagctctcgtcctccacttaaagtagcaaggcatgctagcattttctgtttaggactgaagaaatgcctgcaattcaggaagtgtggcaaccttataagtagtgggaaagttagaggatgtaaacttgggtgattcgcataacttcagtagacctcagtttcctcatttataaacgaggaggcagtctagagcctttagatgcggcctctaagggtcccttggatgaggtgtaaagttcatgttcttagggaacttcaccactagtacttggctgcctttaataggtcttaatgctcctataaatttaactatattatcccttttgcccatttatgatttattaatagctttaatgaattgtgaatgacagtttaattagatcatccatgtataattagggcaaccgggtttttttccctaagaggatatatttttcatccgtgagtatgtagcttacctctaacctaggtaattaagcattttaaggcattttccaaaataagaaggctttttctgttttcctaataaacactttattgaaaagccacatgcataaaataatggagggccgttttgacctaggttttgcatgtaatcataacccagacagacacaacctgaggcagtacatttagtttagtggtaacaaagcagtgtggaatttaagaaatctctctct

SEQ ID NO: 133494 - DNA, 1038 bp, Homo sapiens
gaaaggtccaaggggaaaacacacctctcctccatgtaattttgtaatccagtttacaccaacttttggatactgtcttaaagacactgaatgattttcaaagcatacaaatcattttctttgtatcataaacatgaaaataacataaacacccagagatgattttgttgagagacatgaactaattaggggttcttgcacttaaatgcactttcagatcatctcaagaacttgtgtaaatagacctggtcctacatttcctgggatgggctatgctgagggcacctttcagataggctgggtgtaactcccagaccagcagcagcagcttaggagcacttggccttacctaacctcttgggacctctgtttctccacgtccaaattgttagcaacgatttccagctagtaggcttcacagagctgctgtacttggaactgaacacaacatgatactttattggagtgtattattttatcaataatgtagcttgaaaacaagttttctgtgtttattcaaacctctgtgtagtgaattaacaacaacaattgctgatgtttataggattctcaaaaacatacttaatatttccctgctttcttttttggaagtgtttttcatgttttcccagtttcattcttgtcttggtatgagtcactagcatgaaacctgatattttgttttattatttattaatgggcttcttagacatttaccaatgaataattaagcaatacaaggagtgaaacagatgttgggtttagtagtcaactgacactttctgatttagcatggtaaactgaatttggaagatgctagataaatgcctaatggctattttgcattgaaatttaataaataaggagtaacttgatgaaagctaaaacttaacttttttctgcaattcttaatttttcttcatttcttaactgttctaaggcaatcatttgaaaacaaaatgtaataaacttaagaataaagtttggaataacagcacagttggatactgctaacatacttatttacttttttattat

SEQ ID NO: 133495 - DNA, 1035 bp, Homo sapiens
tgtgttttaaccctcccaacagatttatcagttaatagctactctactattcctgtagatgaggaaactaatgctcagaaatgttaagtaatttgtccacattgcctttataaaggcaaaatttgtattttaagaaacctttgtaaaggtgaccatagatgaataatatagtatttgatcttgtaagaaaaatgcctgccgtttaaaatgtgtctcttctttaagttgccacactatgtaagttgccaggagatagacataccacataagccacgtggccagcagaaatgattagtagcgacaagcacgtgcctaaacatatcctgccctctccctttctgactagacttgcctctgcacttccacagttccctccctccagcaggtgcagaatggcctgtttctccttcatcctatgatgctagtggccttcatcctgtgatgttaaataagatggactcgcttttgcctgtagcctcctccttcagcttgcagatatatctgacctttctttcactcaaattactcatgaaatcccattgcctctgtgaatctgacctagttggaaaaaacaagcaaattccccttgcttttctcctgctgttggagcattcacttctcatcagttgctttccatgcaaaggtgattctgcgccttcctgtgtgtagtgcaaagttacgtaatgaatgcctccagggataggggcaagcaagagctgtaactgatgtggatattattattaagggtttttttgtttgttttgtttttgtttttgtttttttgtttttttttgagactgagtcttgcactgtcgcctgggctggagtgcaatggcggaatctcagctcactgcaacttccacctcccgtgttcgtgcaattctcctgtctcagcctcctgagtagctgggattacaggcacacaccaccacacctggctaatttttttatttttagtagagaaggggtttcactatgttggccagactggtctcgaatttctgacctcgtgaccgcctgcctcggcctccccaa

SEQ ID NO: 133496 - DNA, 1057 bp, Homo sapiens
acagtaaaagtgtagtttgggaaatgagatactagcaatgggaccttgggtaagttgccctatttttctaaacctgtttccttatctgtataatgaagataattatattaatacaaagcaaccactctcaaaggaccattgtgaggcttagctggtacagtttgaataaagcacttattgcagttcttggtacccagtaagcattctgtaaaagttggctgtggtgagttagagaattgctagcagtgagagcttagttgtcagaatgatttaaatgtgactgtccaagatttatttacggcacttaaatgttttcgtttgctgcaatacaattttttatcccacttaatcctgggtcaccaaaaaagtgttgagttacttatgtacagaggattttgcaaggctctaggggatgggccctgtagggaacttgtattttggctaactaggtaaagacacaatacaagacagggagcaccaagggccatctgagcaaggctgagtcgatccattgaggggttgtcacagtgggctgataccaaactaagacttcacagtgatccactttattatttggcaggtagaattttatagtttgaatcattccaaacactgtacaagaatatttcaagctatgcaacaaagtaaaatgaggatttacctgagtattttgtatgaatcattataggagcaaggtgaacagcagcaatccgtcatgctttgcagtttgtattaattaaaccttagaacgtggggtagttaggttgagccatcctttgcatattttttcattacagagagtcttctcagctggccttggggcatgcagagaggtggagatctgtgtgagcagctatagcactaggcagccttgcatcctgggtgttgaaagtgcaggccattatcctcccctctgacctccaagatgttaggtggcctttctgtgcctcagttttatcatctgtaaattgggtatgattgtactagtgcctagtacataaggagtgctgcaaagattacatgagtgtctttaaagtccttacaacagtatctcaca

SEQ ID NO: 133497 - DNA, 1049 bp, Homo sapiens
gtattacttttcatataatttaagaaaaaggaagaatttcagcaaattgtagatgtacagtgtcaggaataattttccacgcatactatgacattactgttattactagggtaccagggactgctgttgccactggtggagggttctggtttccaaagaatcaggacaagggggttaagttggggcaaggtgacagataactacacccatgatcccattcaggtattcaactggtttcatggttggatcctgatcaaaatatggcagaagtatttagatagaagaaacataaaggaaagaaccccactagccttcttcagacttgcaaagtgaaaatgttcctcctataaggggctgctggggaagcccagcaccctggctaatgctccagggttgcagaaccccgcttcttgttctgggatgccatggccattctggagagtgcatgtctgcgttgcctttgttttctctagtctgaggagtggctgagcttcagggcactgacttcctcccaggaacttcctgaaaggggaaatttcgactttgctgtatgaacactctgaatgcctgtgggttgaacaatggtagctgctgttgtttttttttcaagagggagctcaattttgttttgaccttgggaagtgtggatagttgtgttcatggcgcctccatgtgggcggtcaaggaagaaagtcttggggtaggagcccttggagaatgaggacttgattttgccatttttgcttttggccttaatctgtgttgttgtggagacagtagtactgagatggggttagggtggggaatggagtgtggagaagggccagggaaggagctaactagagggttagtgccaatagctgaaggaagcgctctgccttaggaggctttataaatagttgcctttatccagtgtgtctcattttgcctctctcaggcctaatttctaaataatcccatttttcaagataaaggagataaaaaggggtactctgagattctcccagcaggtgtgaaatcctgcctaataattgtagctgcagatttct

SEQ ID NO: 133498 - DNA, 2284 bp, Homo sapiens
cctcaggaacctaaacacagaacagagcaccctcctcaaatctatcaagtcagttaattgttaaattcataattccacagtttgtaatcactcttatggatggttaggcagttaactagccatatggaagtgatagggaattccaatcaaggtaaaattgagcagcagagtgaaaatgcaaaagctttctagtttttattctatatgggaagatgagttctggagctgcgaagaacacctggttaatgagttcttgagacatgtctaatagcttttccctaaggctagggacatgagaaataatcatgaaatttgagagaaaggagatttaagataaggttgtcaaaagggataagtattttaaagacacctcagcctactggacttttggttgcatgcaaaatagagtatacagcctgggagtgcacagccagctatgaacttcctgattcacagtgaatgttattttttgcctctgcatgcacctcccttgctctgacttgccctgctgtgccgtggccttccacaccttctgcatgactggactttgccttcagcgtcttcacatggcctgtagggcacagcctcttgcaaaggaagtgctcagaaggtatatttagaaatgaatttcctaaacagttgaaagtatccttcataaacaaaaggactgattatattttttcctctctttttttgatgattaaaagcattttaaatactattttttttgtcttgattgattaaaggaaatactatgtatggcagaatattggcagtgagtagaaattcaaagcaggcttaatattgactttatggagagatagggaaaggccaattaaataatgaaagtaaaggcttacataatattgtatactaatgtaattaaataaatgtggaaaaatccgtgtatttaaatggggggtctgaatctaacacctcaccactcactttctaatagaagctatttttgtaagtgtgtgggagtctggcaatatcctttcagatagaaatcattgtaggtttaaatcactgatatagcatggattaagcagatgaaagcaatgaaggaagagcctgtttagattccagagaataaaattcatagaactgtgagaggtggagcttgaaatactgccacagttttgaagttgttttagtgacatcatgtttctatgcatgattcttacatatgtatcaaagtgtgggagtattcatcttccagaattctagaattcatgattttgtaatctagcctatcaagtgattcacatacaaagcctttcttttttcctgaactgttgaatttggataaattgtgaattgtgttttttttttaaactagtaaagtggtatcttttggaattgcttcttaattgtctatggtaaggcataaggcacgttgcatgttgcttttcaaaatatcttgatatgataaagtgcagttcagaactgtaataaaaggggctattttttaatatcccagagagtttaattataaaataattttgtagtaacatgatctttgaccaaatttccgtctagcattgtagatcttcattttgtatattttctttagttttatgacaagaataataatactcattctcctcctcatattttcttaggacctgagtaagtactacagcttgatgctcagtcctcacttactgtggctaattcgagagacacttgatactgaaatgcaagatctggtgttactcagcactggtttatgagcaccaggggctatgctttttgctatatacacatcacagtctgccttcatagtacccctgcagaggaggtggtattgtgcctgttgtacagggtaagaaacaaaggttcagaaaacttcagtaactctttcaaggcttgaggtcacaccacaaagaacgtagtttatccaggatttgaactcagcattctgttaccccacagccgttgctctttctgttgtgcagcattgattctcttgtaactttgtctattttcataaattaatttgtctctaggaacaggcagctttctctcttctagatgttatgacctattttctgtctcataacatggccaagtacataatttgagactgtgttttttattgtttgtcttacgttgtttttcagcaaataaacattaaccaaaatcaggtagccaagatgccaaatcatgtagcaaacctacacatagggggaacaaagaaaaactgaacatgctaagtaagccatcttttcacctagcgtcttaattgtgaggcatatatgttgcatgttgcttgtgaaag

SEQ ID NO: 133499 - DNA, 1452 bp, Homo sapiens
ctgaagcgggtggatcacctgaggtcaggagtttgagaccagcctgaccaacacagtgaaaccccatctctactaaaaatccaaaaaattagccgggtgtggtggtgcatgcctgtaatcccagctactcaggaggctgaggcaggagaatcgcttgaacccgggaggcagagagattgcagtaagccgagatcatgccactgcactccagcctgagccacagagcgagactctgtctcaaaaaaaataaaaatagaaaaattaaaaattatactaatctaaaaacacataatcagttactgtgttttaagctgtgaagcttaacaccttgtacttttatagggtatgtaatatttgaatgacatacaactatcctctacttggggagtaggaatttctgcaacagtgactgctcacaattaatgtcttcagtctcctccattatatgatgtgatgtggatctctgtaaaaggaaaaccaaaacaaaacaaaactctacaaactcttttgtttgttggttggtttttctgagatggagtctctctctgtcacccagattggagtgcagtggcgagatctcagctcactgcaagctccgcctcctgggttcatgccattcttctgcctcagcctcccagcctatagctgggactacaggcacctaccaccatgcctggctaattttttgtatttttagtagagacggagtttcaccatgttagccaggatggtctcgatctcctcaccttgtgatctgcctgccttggcctcccaaagtgctgggattacaggtgtgagtcaccgcgcctggcccacaaactcttttgaaaaccatgtagggggaactagtgtatgtccatgccataaaattgccatttccttgccatagtatcaggatcctcaaatggtagtccattttgattttgtaattctctgctttctcctctcacctcttaaatacctgaatagatgttggaggattgctccattcttcactcgggagcctggtccctttgtcagttataataagtgaatcagggagtttctctctctggctctgctctgtgcattgtaaagcagagtttctcaaaatgtggaatgaacccctgcgttagagcacctgcactgaatccctgggtatacttctcttaaaactgcaggtttttggttatataatgttataccaagggaattttttaaaagagaatgttttaaaaaggtatttcaagacaataaggagctacttgtttgtaagagttctacagaaaccaaaaattatgcgaattcatacttttgggaatcttatcttttccaaggactttgttaactatttcatcaactctaaggcagttaagaataaacacagttaaacaggtacttcaggctggatgtggtggctcacgcctgtaatcccagcactttgggaggccgaattgcttgagtccaggagtt

SEQ ID NO: 133500 - DNA, 1033 bp, Homo sapiens
gctggagtgcagtggcccaatcttggtttactgaaacctctgcctcccaggtttaagcaattctcctgcctcagcctccggagtagctgggattacaggcacgtgtcaccatgcctggctcctttttttttgtatttttggtagagacagtgtttcacaattgttggccaggctggtcttgaacttctgacctcgtgatctgcccgcctcagcctcccaaagtgttgggattacaggcgtgagccaccgcgcctggcctatctgcacttttatattcttttttctccttagattagtacacataaatcaacaatgtgtttatattccatttgtttgctttgctttacttatactgaagacaaatgctgaaatatctgatatagtctatatatattatatatcaactgttaatattttctgacagctaattaaaaaattgaataccaaagcatatttctccattagagagaaggcataccataaatgttgtggtttagacctttagagcctatttagagctgaattaagttgacttgcactgaatttaattagtttctaatccaaaacaaaggcgctgtgttttatatataaggttaccattaagatagatattttagctaacaatattggaatgtgttttgtagaggatagggaatgttctgatattacaatagaaaaataataaaaattaattcctcctaatatctgcatctttccttttttatttttgagatagagtcttgcccctgttgcacaggctggagaatagtggcttgatctcggctcgctgcaacctccacctcccgggttcgagcaattcttcttcctcagcctcccaagtagctgggattacaggcgtgtaccaccacacttggctaatttttgtatttttagtagagaaggggttttgccatgttggctaggctggtctcaaactcttgacctcaggtgatccacccgccttcagcctcccaaagtgctaggattacaggcatgagccaccatgcctggacgtcgttcctcttttgtttca

SEQ ID NO: 133501 - DNA, 1072 bp, Homo sapiens
tgtgattggttggtgcatttgttctgtttggttattaaatattttgaatctcactggggattacatacttttaaacatttttttctgtgagggtttttggatgtgccatttaagagaaaaggttattttagtaagttctaccaaattaaaagatgaatagtaagaacttgctagtatcctgtttatggctgaatctgagcaggcgtttacagttattttctaaaataatcttgagttaacgttaatggaactatgtattatcagtcccacactggaaagctaattattggtatgtaatcttagcagaattactatgcttgttggtgtaatccatgtcagcaaggtgacacattataattttatattcattttccacttacttttctcatcttctgcatgtatcatcagacaagctttctttattacagatgtggttattttaggggcaaccacttttacttgaattgacataaaaaccatccctcatctctgggccacatggtctttcctgagacgtaaatgtgatgtagcatctgccacataatctttcttaatgatatgtgtgtagacacctgaaagttccttttgtttctgtgtctgaactgttaggtcatcagcttacttaccagaggactgatgtgtttcttcaggttctgctggcataacatttggggcctatttttcaccgctctacatttgatttccctatagttttaaattcaggaaaaaaaattgaatttttgatgctaattaccctctttttaattctatcatttgtaatttaagatgatagattagattttggacatttatagtttatgttctctaatattttaacctttattagatggctttctaaaataagtgtctcgtacaagtaaatttctcttttaatgtgtggttttagtactttctaagcatattaacttcatattttcttaagttatgatctaaaactgatgagaaattaacctgttttggctcaaggaagcctagatactccctaaatgttaccctaacttagagctttaataacattttttcctactagggaactaatactgttatagga

SEQ ID NO: 133502 - DNA, 1094 bp, Homo sapiens
agacactaattccccacccttcctacatttttcacattgctctctggttacttttcttaacccatgttaattacagttgggtgggtacagtggctcatgcctataatcccagcactttgggaggccaaggcgggcagattgcttgagcccaggagttcaagaccagcctgggcaacatgaagaacaccatctctacaaataatacaaaaattagctgggtgtggtggtgcccacctgtggtcccagctacatggggtgtgggaggatcgcttgagcccgtgaggtgagggctgcagtgagtcatgattgccccactgcactccagcctgggtgatagagcaagagcctgtctcagaaaaagagaaaaattgtagttttgtcatctctccaaaccattaattacattgcattcattgtgaaataaaggccagatatgtttatctgtcagtcaagtttatctgatcccaccccctcttctagccttattccttactgcttgccttgaggtatttgacagtttagccaaatgaggacactaacccttttccttcccctcctcagatatttgttgctttcctctcttctctcccacccctaggatgctttttcctccatcgctctctgtgcaaatcctaccgtgtttcaaaacccatgttaaatggtgcctctttctcattgccttttctgatccctctagtggtcaaagtttctgttgactcctatgacgttttatgtttgtttatgtctgagtttttttgatatgtgcaggaggtattggtatgcaagtggagaagtgagatagctaagggaaggcagccaataaaggtgcattattaaaccactaatggcaatgggcagttggaggtcaagcttggggagaagctctgggagatgatgtcacgcaggacttctcaaactttcatgttcatgagaatctcctggggaccttgttaaaatgcaggttcagactcaggtctggggtgagacctgagagtctgaatttctcatgagcacctggtgataatgatgctgttggcatgggtccagagaccccacttcggagaatggtgatgctgtaaatttgtcccacctga

SEQ ID NO: 133503 - DNA, 1012 bp, Homo sapiens
gaatatcttcttttctagcctcgatgattatagctcgttgaaatgcctgaagtcatttttgatttcttctctcttgctcatgagaattattccaaaaaaaattttggccttcacaccagtgtttaaaaattgttctgtacctaggtttacagtggggatacaccatcttaaatctagttaaggttaacaagatttatattcttttctggagagttcagtcttggaagccaacctgagtttttaaaatgtgctgactgcatgtggataaattacagccctgttcccagatgtgtgggatctcacaagatagggattggatggagaagtatccctgatttgtcaaagtgctagtctaagagagctgcctttgttgtaagtatactgcttgtgtaatttcaatgatcaagattccctttgagaaaaaatgtggttgtactgacatttactttgagcaaatgaagcataattcatatctgttgaaattgaaattaataatgcatggccatggctatgtgagtacttttttcagccttctttgtatgttcttgcatataaatttttagaacccgtggtaaatcagatggtgcagaggctgttcgattttttttttttcttccttgttttctagtgggtggcttgcttgagcaagggaatgcagtgaataagtttatcagcgttagaatctgtggttatgaaattatatcacttattaaaaactaaatattttagtcaaggtttttaagtgtcctttgcaaaaaaaaaaaaagcttttagattgctctttacttgtactttcccagctgaaaatgaaagataagggacaaatattagtatcaattcttttatttgcatgccttttctctaatggttgttccttgccttttagtccttgtgtaatgaatacgttagaggcaaatgtcacctatcttgaaaccataaagacttagtttctgtactactactttttaggtacaagtgcagtctgacttctgaatgtagaaccagtcatcag

SEQ ID NO: 133504 - DNA, 1030 bp, Homo sapiens
ttcccctctaaattcagtgatgagaacattatcccccaattaattccatcttcagtcatctgtttattagaaatctttcattgagctgaaatctgtcctgtaactagcttcagattctattcctggggaacacggagagactggaacccactggaacacatttgtttctcccagtaattgaagttggcctcatgacacccttggggatggctttcttccttttatgaaccatcgtgagttcttgccatcatttctcataaagcaggaatgaaatcttgttccttaatatcctgattgttctcatcttttaaaaattacctgtaatgaaacccagcacttgatgtgtgccttgatgaagtcagagtagataattctgtctttcctccctgacattcgtgtgactctagaaatctttgtctttttgtctaaataaattatcccaacaattacagcaattttagtgcaaagggcactcaataactttctctaccagtaccagttcatgtttgtttcatttttcttgatacagcattgcactgctagtcctgtttttgatctgtggtcatctgtgatgtgtacatagtcttctgcatttttccttttccctttatcatgtatttgcttggattttttttcaattctgagagtttttactgctattgaatttcatcctaattctgggaacatccttccaagatcagattcatttaaactttattcccaatttctagcatttgtaattctaccctgttcattctctaaaggaaagtagaggaacctgttacaataagatttgtagttagatcagggaaaaacaactatttttgttaatactgtcagtaaagatagggaagtttttagatttcaagacagattgccatagtctgtcattctgtatctccagttgattccaagtctttattactttgttgtttacttacttaatgggcatgaagccaataataggctacccacatttgacttcaccacttgtgttggtataaaagggaatagagaaatcaagagagag

SEQ ID NO: 133505 - DNA, 1105 bp, Homo sapiens
gaggtggaggttgcagtgagctgagattgtgccattgcactccagcctgggtgacaaggtgagactccgtctcaaaaaaaaaaaaaaaaagaaaatgcctttctgtggcatgcacatattaataacaacttgcatgggtatagaattcttggattagacctcttttttacctaccttgcttgccacgtagtagatttttctccattgtttcccagcagatagatttgataagtctgtggccagcctgaatattttttctttgtgatttgcttttttaaaaatttggttatttgtttctataacatgaaagcttaacaacgtatccaggttatgcttcagtgttttataatttttgttatttatcttgaagcactgaacccactccatctctataatattctttcatttcaaggatcttgcctattttatcattgaattttttttaatattccacaggaattgtttttcttctttaggtacaccaatcattcataattgaatttttgttgtttctctgccaaagctgttagcttccctctaattgctgtatctctccattatttgtgtggtttgcccaaatctcttgtctgcaatgctgatttggcactgttttgaatatcaatgtcaagtgccagtaagtaggtgttaaatgaatgaagtacctgctatctctttgatgcttcagattcatttttaagttctgcagtattattgttttttctccttatttcctttcttagttctgacaatttttgtttcaccttattttttagaatgtcctatttcaacaatgcacattttgttacattttcttgatatagtgcaaagcaattatagtccatttttttcttctgttttctagagtaaacctttcaaagcattctcttcatttttcttttgcatgtcctttgccttgtcttcatttgtgcttaggaatgttccaaattttgtctggcccttgtatttgtccaaaaatagggtgggtggaatctcattgacttccttccctatttgtcttgggtctgtttgtatctttcccttagcacttgagctggaggactggaagatgatggtatatattctatttttagctgttcagttgtct

SEQ ID NO: 133506 - DNA, 1002 bp, Homo sapiens
gttttaaatggtgatgaagtccagtttatctataagaattgcttctgctttttggtctcatatggaagaaaccattggaaaaatccaaggtcacaaaaatttacgtctcttttctactaagagttttgtagttttaggtcttacactttgagttgatttttgtatgtggtgtgatgtggggtttcaacataatcctttgcgtgtgaatatccagttgtcccagcaccatttgttgaaaaaaacgtattcttttctcattgagttgtcttgacattcttgttaatttttcttatctttattacttttttcttggaatttttctaagtttattttttactttttcttgaatcagaattcttagattattttaaaaaatattttctcaatttgaattagtagtgtttaaggctttgcattttattacatgtccctatgtagcattcttatccttttacagatattctaaaattacaatttttatttttgtttttgaaccaagattgtttaatatagtttaaatttttcaagtggttgtagttttttttcaaccttagttatttattctgaggtcattttgatagaatgtggtctgtactgtttctactttttggaatttattgtagtctaatatatatagtcaatttttgttttatgggtacataaaatgcatatgtgtgtttgtcttaaaaccataaatatatgtgtattatttaattttatgactgatatttgctgctaatctgcttccttatattgtgtgtgaatctgccaagtactgagaattttgcagaagtcttccatgactctggtgtttgtggcaatttctcctattccagaaattttgctctatgtaagtacagttatgtgttgcttaacaatggggataccttctgagaaatttgtggccagatgatgttgttattgtgtgagccttgtagagtgtacttacacaaatctagattgtatagcctacaacacacatataggctatgtggtaaagcc

SEQ ID NO: 133507 - DNA, 1109 bp, Homo sapiens
attttttgtgttttcagtagagacggggtttcaccatgttggtcaggctcctctcaaactcctgacctcaggtgatccacccatcttggcctcccaaagtgttgggattataggcttgagccaccgcacctggcctaaaggttcctaaagtctctaattatgaccgacattcaaaatgaagctgcatatgttttggttaatttgaataatttttaataatttgagagaaaaactcagtagtgcagaaacaaaaggtacttgaaatgaacctttatatttttatttatcaattacattctaatggtccaagaattaatgaattggcaagcactatctcctattggagtcaagtttggctctgacatggagtctggaggtggaaggttcttgctgtctttcagagctaacgaatgggtgtcctctgaacattctaccttctcctgttttgccatgggttaccatctaagatgttatccagatcacgttagaaacgattacaaattttgggcacataccacttcttgtagtaatgagtcccatgcattttctcatcttatatgggagaaaatacctgtatattgctttatcattttcagagaaacagtttgtgtttccttatccaatacatcttggtaaagagtggcattttaatggaggaaattacaggacttcatcaatatttctttagggaaatcctgattcaaagtatattttcatgaaaatcactagctctgtcctttgagaaacgtattttttgtagggctttctactctaggccatgcttgttatgagaacagattcttctgcagcgggtgggaggatgtttctaaacccctggagtctacctatgaattgctactcaaattacagtgtatccatctcagaattaatgtgttgtgcatgcctagtccttacttgtgggttgacacaatgatttctattaaaaatattctttatgttttatactataatgtatccttaagcagtatgctgtggcctgaatttaccttgtcttttattctctttttggaatgaaataagagcacttgagatactgtcatttggtggtttggttgtttgtaaaatagtaaaaaaaaaagtttggtaag

SEQ ID NO: 133508 - DNA, 1497 bp, Homo sapiens
cagaaacctcctgtcatatcagcatgggtctcttgcttcctgcaggaagggcgatatcctgggaggcacagaggtggagcccgagagacgcagtgttccagcgctgctcggctcaggactgggtcttttcttccgtatcctcaagcagcttcctttgacttactacttctttttgtttgttttttcttcattgggctttaagcgttgcttctctttagtgtatgtgtgactgaagccaaacacaacattgctttccctttgcctgcaaataatcttgttgcccaagcccatctctgccattttcagtgacagctggctggccaatgagcctgagcactgggaatgcccagcagggcacatctagggggctgctttatatttggagctagcaggtctcttttctagggctttccaggaaagatttagaattaaacattggatggattttgtgtgttcatttctttttccatcactgtgcctttattttcttggggctttcattaaaagcagaaaaacagataatggtagaaacatctatagcatgcatacaaagaagtaaaagatttttataattttttgccttaaaatatatctaatgctgtggcctctgagccattctcagttggtatgaccatgatcagagaaaccttaagaaatcagctttgccaggtgtggtggttcacgcgtgtaatcccagcactttgggaagccaaggcaggcagattgcttgagcccaagagttcgagaccagcctgggcaacatggtgagacctggtctctaccaaaaatacaaaaattagctgggcgtgggtgcccatgcctgtggtcccagttacttaggagcctgggtggtcagggctgcagtgagttgtgatcgtgccactgcactccagcttaggtaacagagtgagaccttgtctcaaaaaaaaaaaaaaaaaaaaaagcagcttcctgtgttcctcgtttgcattctggacaaagactctgtggccaaagaaagagcagctggactctcatgctagttctggagaaatgtaagaaaagcttaattccactggaggtgccaggcaggcagttggcattcctaggcccactttactcctggcccagggccttctcctcatcaacttatcagcgttgggcttccttaccttgacctcacatttgcagttgaatgagtgccagggaaaagaacagacatagggtaaagtagagtaatagggagtcccgtggggcttggaagggcagagggtgttgttgccaataggggtagcgccattgtgtctttgctgggctctggagagaaggagagaagagcaaaggagaggtgcctgatgccttggattgatgttctcaatcaggaagagccagaccaatgctgcctcttctggccgcctccaccatcctaccacgtgttttcatcctcattgtcacatccactgtgcccttcctcacccagatggtgggttgggagatgagcaagtaagtgtagacgcc

SEQ ID NO: 133509 - DNA, 1749 bp, Homo sapiens
tgttaccggaagcgaacagtgatgtttagacacatagttacatatatttctaggagatagcctcattttttttccctttggaaaactaaaatcatgaattaattgtgctttccaagaattttttttttaatcagcatcacttgctaaaaaatagaaatagaatttttttgtttcttttttatgttgaaaaatttttttcatttttattgtttctttcctacattttcttttactgtaggggcaacagggtgattggtgagatcttctaccaccatgtatttactggtaactgcaggcatctagttgcttctaaagaggaatgcttctgtgatttacccagtcccttttcagtctaccagtgatttctgtagcccccctacccatccctttcatgtgaataccacccacccatttaattcctcatcacatctttcttaaacagatgctaaagaggttcctcagattctctgacttgcacatttgcatacgatttagagaacttccaagttggtgcttctgtgagacatcatgtggctgtgagctggtgagaggggaagttgggtgctttaatacattcaaaggaaggaatttgtgagtgtgtgtttaggcaatgattaactttcttttgcaatacttactctggtccgtaaagcaaaaataaattgttactgaacacaatgtaaaatcctccttccttttccagagggcagggacttgagattggttcatgattaccagcagagagttagtgagccagtgctggataatctatcacggaccagtgggtttcagaatcggatgcagtgcgtatgctggaaggggagaaggtgctgtaggcatgtgtaggcatcttcctcacttaatgatttgaaaaccctcttctcagtgacttgcaagccttaacatctttttctgattgtatttccatacagatagttaagggtgatggcaatagcagtggcctttacttttgttatacccaatcagcctgagtacatttttgtggtgggtttgttttggtattttcttgccatgtgaattgatatttaggacctgcgctttgcagagctccttcattatagtatgcgttctttctgcagatggcaaatgcaattttcctcttgtcctagagagatgacccatttcctgtgacttgttctaataatacaagatgactttaatttttgttcagtttgcctttaaaagattgccaggtttaactctcttgtctctgtaactcttgtgatatatttttgagcattggtaagacatgtaataatttaaaaacaatggcagactaattttgtgaaagttttttattttttatttttggctaaataagcaccttttatggctgtgcattttggattcgttacatatatcttttctaaaatctgtgactgaaagtggggtgaagtattcctgccctgcttactgaatctttttttcccacataactaacctcagggtattttgatcatttgctttttctataaaaacctgtagaatgaggagattgcagcagatgatctctaaggaccatttgaactttgaatttttttctccttcccctttgcagctttggcgtctcggccactttctgcccaaactcacccctggatgaagggtctaagcttgctgctgtctccagcagtgatgggctctactaggaggcattgccaggtctggtgggctccttcgggttggcctggctcttctctttgacctctgtaataactctgagtgccc

SEQ ID NO: 133510 - DNA, 1714 bp, Homo sapiens
acagaatttcaggaattgcagttagaacatttttaatatgaaggatatgcatttgtactgaaagctatacagttttagaccaagaaggggcttggaaggctggaagtgctgtagccaatttaagctgtatgggaagttaatttctacacatctggaaaagagcacgcttcccactgctcctcagtagggttcactggagtgggtatgttgattgcctgaattaacctagaggtcagtgccatctaggatggtgactcagaaccattgagtgaaagccttggtctaagtaacctcaataacagcagctccctaaaaatagcaaaatatggtgtttatgagactgctttaaggaccaacaggttttattttttgctactcttttagcttccaagtgttgaatatgtttctgaatgtcaggatttatttggatacagttcccttttttgttgttgttgaaacaaagtacttatagtttatatcagaagaacaaagtgggaacatccctcataaaaatcaaaactgtggctctgactgtataacaaagccttcggaataagttttttgcattgaactacgtagattcatcgtctggatctccatataatgtcccatccttacccctatatgctatttcttcatatggcaaatctgacacaaattaaaaccctgctgaacagtgaaaatattgcaggtttatctattcacatattctaaagtaagtttagaaaggagaaccagaagactaatttagtagccattttaatataaataaatttgatagaatctttttcattaaaaaagaaaaccatctcagctctactttaggagaaatggcttatgttcagttttcagaagtgcctattaaaaacagttacgatttttattacccatgaattttttaggacctgaaacagcctttgcagttgtgaggctgcgtgctatgctaaacttagcagaaaaaaggaacagatttttctttatgatccaggcacacttacacttgaaaagaaattaacaagattctctaaggaaggttttgattccagcattcatattaatttttctttaaggggagttattctactaatattctgttaatattagtagaaatgttgattggatgttgtagagggaaaatagggagctcaaagggtacatcttggaagagacagaagccattttataaggaggttaggattgctttctccctcagaaggtggagggaatctgtttcctctgtattgggttgaggaaaatacaagtttgtgaagcaacaaattttaaagtcaaatttcctggttggaacgggaggcagtcacatttttcaaaggaaaacttttgtaatgccttttaagttatgttaagatctctgcagacttaatcctagtgaagtgtgaaatagcaatagaaggtaaaatgtgcgattgttggtaattaaatctgtggcaataactgactacagtaaaccgtgaacgtttactcttgttctgccgaatggagtaacattaaagaaagagctgctctcagacccaaacactattttgtgtgaatagctgttactgataaaattataggaagttgttcaacaatcacctttgatttgttacattaccgatatgtaaaaaataaaattataggaagttgttcaacaatcacctttgatttgttacattaccgatatgtaaaaatctgtctgatttctcatctaacatgt

SEQ ID NO: 133511 - DNA, 1045 bp, Homo sapiens
tttgaatccaggacggttgatttcaacaaggaagatattagggagggatttcatttgaggaattcctgattcgctgctttgatgagtacactgaatgttctggttccttctatcatttaaacaaacctatctagaggagattataagatgtatccattcacagtttaaagatctactaatatttttaactagtttatggaggaataagtattttgaaatgaaaatcaatgtaaaattgttttcaaagtaaattttagttcaaggcttgataccattttaatggaagaggatttgtttgacagggataaaagtgggtacccttgcatttgctcatgtaattatttacttttgtgtattaataatatggagacatttaaaaagacaattagtgggtacctgactagatgaaagtatggcagtaaaatttgggctatgttgatttatattcggcaactatgccagtcttccaaatttattccgtatgcttatatattatatatttttattttaactttagaaacgtgaaccctgaaatctaccactataagaatattacattaaattttgaattattttcttgttgtcttttaacttattcattctttgaattcatttatgttagtgtttgacactcaaaacttactctttgtattctatgtagatatacaagagcatacttcattttaacttggttaatgtttttatatattttgtaggtataaagcacatattttctttaattgattaattttcatgaatattcactaaatatttctgttggtggtacatagataacctcatttaatataatttgtaagtctgtgtaatacaagtggccttgagtgcctgcttcatgttacatatagttatcctgaaatttttttcagttcctagaagaaacatttttttcctgttaacctgttcttattttacacgtttttgaagtcttttactctttagatcttaattatcaaataggaagacttagtaaacccctttaattgattgaattatcgctattgaaacaggcaaagtttaggccagt

SEQ ID NO: 133512 - DNA, 1878 bp, Homo sapiens
ggagcgggcgcgccgggcgcggggagccgtcggcggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggcggttcccggagctcgtcccggacgcgcgcccgggcggcgggggctcggcggccaccgctgcctcgggggagcgagggcgggagggtgtgtgtgcgcgctgtgagcagggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcggtgagtaccgtccggggccccgccgggcctctgcgcccccagcccaccatccttggccctgcggggcagctgccttcggcgcccccgccccccggcgcccgcggttcgcccctaccctcccgggcgcgcccccggccactgccttcacccgcgcgggcgcgcgggcgcgttacacacagacacacacacacacacacacacacacacacacagcgacacacacacgcagcacaggggtcggggctgccctgcccggtgccttggcttgttccttttcgtgtccctgagggctgtaccttatctgctgtgcatctgctaaatggcagatcactccgaccagaggcgcgggggtggaaaggtgggcagaggggttgaacttccagtgtcgtggccgcggcaccccatggggtggtggcgtggggagccgtgtgtgtggcccagcgggtggcgagcggagccggggcacgttgggggatggcctgcggtggagtggccggtgtgcatccattatcagtgccctatggggtcaggagggaatgggggaacggtgggcagactcgcagctggattcccggagcactcatggtgaggaagccaagtggttggccctccaaggaaagggtctgtgtactgggggcgaggcgggagggcaagcccaaatgtgtcacacaagtgctgttctctagccaccagaccatcgaaaggagggagcctagaagagttggccagtggatggtgacaggcgttattctcgtctgcaccattccttctagataaagatgagggtaggggagcgttgtgctgtgtggttgttgacagcgaccggtatcttttgtttaatgaggcaacctagatgtaggcctcagttcacaatagttactaccgaaaaccagtgcagtctctcagttactctcttggcaacaaatagaaaccttttgtttaaaacagatagcattttaatgtctttggaatctgggcgagaaggaaaaacgggaagcatacaggaaaaatttccctctagtcttgaaaaaaaaattctgcttcaacactaagttagcaagaaaatgccatttctcaaatagaaatttattgatgattatctctgggaggatgttcagaatcaagcgatcagggttcatatacaagccacagtgacagaaccctgagctactgtggcaggaagagcaaacagctttgcagtaacgggcctgaaaaatgtctgcacttgtgttctgggtatttgcatgtataataaatgtgtt

SEQ ID NO: 133513 - DNA, 1078 bp, Homo sapiens
ccagggagtcccattcctatgttcaatgtcagtgacacccgctgaggtgcaacttttgcgctttctgtacaaccctggcaaactgaatgatagcgcctgggttaatacctctgtgagccctgcgtttgtgcacaaagcactaacaagtttccctagtaaaaagatcgtccctcaccattattcagctggttagcttttctgcctttacattctcccatgtggacaggcattggggaaggggagggagcacagtgctgaaacacctctcctggacccgtgcccatctccactggggacaggtctcatactagctccctgagcataaaaatcctgtctgattgcttcatctgctatgcgtctgtggggatccgcaaagatatgggatccagttagtctctggtgagtcgttaccttggccggatggggacatgttgcctgctgcacccccctcttcgcgctctctcatttcatttcctgcagtgtgccagcaggatggcccacaagccatctactactcggacaagtacttcgacgagcactacaagtaccggcatgttatgttacccagagaactttccaaacaagcacctgaaactcatctgatgtctgaagaggagtggaggagacttatgtccaatggcgtctaggccgggttcattacatgattcatgagccagaaccacatattcttctcttcagaggacctcttccaaaagatcaacaaaaatgaagtttatctggggatcgtcaaatctttttcaaatttaatgtatatgtgtatataaggtagtattcagtgaatacttgagaaacgtacaaatccttcatccatacctgtgcatgagctgtattcttcacagcaacagagctcagttaaatgcaactgcaagtaggttagtgtaagatgtttaagataaaagctcttccagtcagtttttctcttaagtgcctgtttgactttacctgttacttttgttcaataaagtttgtatgttgcagtaaagaaaaaaaaaagatatgggatacagaaatgactgtctatgtcaccaaagggcattccctgagctctttcaagcca

SEQ ID NO: 133514 - DNA, 1182 bp, Homo sapiens
aaactgaatacccatcattgaatttgatttttccaaattgaaatttaaagtactcagtcacccattagaagaaaagccaggactagagacctcaagggatgagactcccaggctgtggtttttttcatgtacctgaggctcaaggacttctcaccaaaggagagtttgtggcttgaaagagctcagggaatgccctttggtgacatagacagtcatttctgtatcccatatcttttttttttctttactgcaacatacaaactttattgaacaaaagtaacaggtaaagtcaaacaggcacttaagagaaaaactgactggaagagcttttatcttaaacatcttacactaacctacttgcagttgcatttaactgagctctgttgctgtgaagaatacagctcatgcacaggtatggatgaaggatttgtacgtttctcaagtattcactgaatactaccttatatacacatatacattaaatttgaaaaagatttgacgatccccagataaacttcatttttgttgatcttttggaagaggtcctctgaagagaagaatatgtggttctggctcatgaatcatgtaatgaacccggcctagacgccattggacataagtctcctccactcctcttcagacatcagatgagtttcaggtgcttgtttggaaagttctctgggtaacataacatgccggtacttgtagtgctcgtcgaagtacttgtccgagtagtagatggcttgtgggccatcctgctggcacactgcaggaaatgaaatgagagagcgcgaagaggggggtgcagcaggcaacatgtccccatccggccaaggtaacgactcaccagagactaactggatcccatatctttgcggatccccacagacgcatagcagatgaagcaatcagacaggatttttatgctcagggagctagtatgagacctgtccccagtggagatgggcacgggtccaggagaggtgtttcagcactgtgctccctccccttccccaatgcctgtccacatgggagaatgtaaaggcagaaaagctaaccagctgaataatggtgagggacgatctttttactagggaaacttgttagtgctttgtgcacaaacgcagggctcacagaggtattaacccaggcgctatcattcagtttgccagggttgtacag

SEQ ID NO: 133515 - DNA, 1070 bp, Homo sapiens
taccaccgttagggctaggcatggtagctcacacctgtaatcccagagatgtgaaaggccgagatgggagggttgcttgaggtcaggatttggagaccaacctgggcaatatagtgtcatctcatctcttaaaaaaaaaaaaaaagccaggtgtggtggtgtgtacctgtagtcctagctagtaggaaggctgaggcaggaagattacttgagcccaggagttcaaggctgccactacacaccagccggagtgacagaatgtgaccctgtctctaaataaataaataaaataaaaattaaaaatacaccgctgtaaatagatgatagatcaagtaggcagaagattaacaaggttataaaagacttgaacaacacaataaattaactagacctagcaaacatttatagaacgctcaacccaacaatagcaaaatattcttctcaagtgcatataaaactttctccaggatagatcatatgctaggtctttaaaaaagatattgaaaccctcatacattgctggtggaaatgtaaaatggtgcagccattttgcaggacagtttgagggttcctcaaaatgttaaacatagacttaccctgacccatcatttcaacagctggatgtatactcaagaaaaataaaaacctgtgtccacacaaaaacatatacaaagatgttcatggaagtgtatttataataccaaaaagtggaaataacccaagtgtcaatctactgatgaataaacaaaatctatcaatgaaatattattcagccataaaaagaaaataaagtgttgatataagtgacagcatggatgactcatgaaagcattatgcaaagtaaaagaagtcactcactgaagaacatgctatatgattccatgtatatgaaatgcccagaataagcaaatttctagagacaaaaagtagatgagtggttgtctagggctgagaaggttcctgagaatggggaatgagtgtaatgtttttctttaggaggaggataaaaatcttctaaaattggattatggtagtggttgcacagctttgtggatatagtaaaaaccatt

SEQ ID NO: 133516 - DNA, 1007 bp, Homo sapiens
ggactttagttaaccaaaataatatcaggaaccaggccaggtgcggtggctcacactggtaatcctaacactttgggaggccaggagtttgtgactggcctgggcaacatagtgagactcctgtctctacaaaaagtaaaaaatattagctgggcttggtggatctcttgagcccgggaggttgaggctgcagtgagccatgattttgccactgtactccagcctgggtgacagagcaagaccctgtccatgaccctccccctacaaaaaataaaaaaaccaggaaccaaaataaattaaagatgggagggacctcagagtcaaggctagcctactagatcttgcctaatattttgcactgaatgtaagaaaaatgtattacagaccattctcgtcagatattcttcactgaaccttctttatctcttgcatctagtgggtctaggttgtagattttaacctcctacatattgcttgtccatccttaattacattttgcctggactattgcagacgctcctagctagttttgctgccgttgagcttggtttttctcagttcatctgcctactttggttcaagtgatctttcaaaaaggaaaagacatgcttaaagtggcatgcccacgcaggaccagtgtgtattggttgcttgtgttctgcacagaggcactgaaatctcagctgtgttctgttaagcctcctggggttagttggtcttgaggaaggggagctttttctcatttcctttatctctttgatactccaacagtgaggcacatttttctaacctgctaggggtatccttaatgtgtcagtggtagccctgatcctcatcacctgtgaggtaaaagtgaactctcctaggcttgcttctccctgcctctttgtaaatttctgactcttccggctacggctctgggctttagtcggatccacctgcagttttccagtgcccggcaggtgtcaggcttagatgcctttgctctcgctgctccctctggttaa

SEQ ID NO: 133517 - DNA, 1035 bp, Homo sapiens
agggttgggatcatggaaatagtcacagaaggtgactgttcgttgggatcctgaagtcttgtgttcgttgtgtgaaatagtggtctggaggggtaaggaaacctgcatttcaatttgagggagcagagagttaaaaggcctctgtcttctattgttctagtacattaggtgctctagtataacacctaataaaattctgggtttatagttgacactgaattgttggttaataacagattgaggtctgctcttggaaatgaaaataggaagagttttattttttttatgtttttctttcagatgtctcaaaaagtatatagaactttactgtggtctggagtaaggttgcaatattcagtctattcaattttggcatctaaatagaattgaactattgcaataaactggagtaactctttgttactgacttattttagaatgtaccaatcagttgcttaggtagattgtaaatagtgattttaagaatacaactataaaatagaaaagatataagaagagcaaataaatcaagactgactaggttgtatatgctcttcatcttattgtatgtggtttttttttccattttagttatttgtcaaggtataaagagctctatcactcttaagacagtcaacttcacaggatgtaatctgacatggcagggagcagatcacatggccaagatcttaaaggtaactttatgttccaactttcatgaaaatgtgttatatgattgccacacgttaatattttgatacaagacagcagttatttttgtcttttgatacatatgggcattgcagttttagttttgtttaaagaatgtgaccaattttcagcctggggttctaccatttattaaaggtagtatgcttaatcttagaaatagaagacctaaaatataataattagatttttctgtaaatacagtttgtaaaacagtaattttaaaggtgccttaacaactttatagtggttattactactgtatttaggataaaattacataataatgtgacatgaagccttttt

SEQ ID NO: 133518 - DNA, 1071 bp, Homo sapiens
gtttctgtttgatttgtaatatacataaaatatgtatatagaaattcctgtatatagtttattaataaataacttacatgttaaatgtttacttgtgggatgtccagtcaagtgtttagagaccactggaggacagaatgatatgatttagaggctcagcaatgatagaatttagaaccagtaccttcacttggcatataaagaaaataaaattcttagaagttaactaagttgtcagtttacataaagcaatcagtaacaggtcattagtggttagggtcacatagctagtcagtgacagactagtatctgggtcactggactccttactcaaaatctactatttaatcagtctgtcagattaacccacctggcatatgtacctggtgtgtgtgtaaagctctgatgtaatcagctgtacttagttccttttagtgttcctatctctttatccaagtgtattaatttcatcttattaaatctttgaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagaggtaagttaaatgaacttgtaaggtggaaaatattgaattttttgatattaaatatgcttaactcttggcacagtaatgttgtccgaaggttttttaaaaagcctcttttttctaataggttttattttgtttttaagcctttataaaagttatatatattctttatagaaaataccaagtaacaaaaaaaaaaaaagtacatataatctcaatgcctagagataaactgttcattttggtgtatacactttcagtattgttttttcctgcagatacatttgtgtgcttagagttacaagaacagaactatagtgcacttaccattttgtaaccctgctttttttatttaatgatgtatcatgtagtactctattatattgaggcataatagtttaattccctactat

SEQ ID NO: 133519 - DNA, 1500 bp, Homo sapiens
ctttgggaggccgaggtgggcagatcacaaggtcaggagatccagaccatcctggctaacacggtgaaaccctgtctctactaaaaatacaaaaaaattagccatgcgtggtggcgggcgcctgtagtcccagctactcaggtggctgaggcaggagaatggcgtgaacctgggaggcagagcttgcagtgagcggagatagtgccactgcactccagcctgggtgacagagtgagactccgtctcaaaaaaacaaacaaacaaacaaaaaatctgtatagaattagcaagtgaccctttgtctttcatcgaaagctcttgacctgcaacagtgcggcctcaccaatgaaggagcaaaggctttgctagaggcccttgaaaccaatacaactctggtcgttctggatataagaaaaaatccactcattggtatgtcgctacaatattttttattgactaacaaatagcaaaagaaaaagaatttctcatgtattgacagttttgaaaacttaatgtgtttccttccctaatcttacacttttgtaatcttgcactttcttatgtttttagtagataatttactgatgaaaagagttgtacttaaattgctcttggctgctactctgaataggagtgaacctagataataaatctgcttccaccaagtgcattattttcttcttgtggaacttctgaattcttggaaatagtatttcattcatttgttgatttgacaagtaatttttgaatacttctatctgctagatactggtttaagcactaaacatacagcagtaaaccagctagacaaattcttggtctcatagagcttacattctagttggggagttatacgtaatgtaatttagatagtaggaagtgcaaaaataccgtaaggtaagaagacagatgggggcaggtgggactatattagataggttttttaggggacagcttcactgaaaaagggacatttgaacagagacctgattaggaggggaacaagccgtggaagatgcagataaagtaccttccaggatgaggaagcaatgaatatgtagttacataggtggcagggtggatggagtatttaaggaaaagcaagaaggccaatatggttggggcactgagtgatgaagagactggtatgctacaaagtcagacaactagccaggggcctgatcttgtaaggtttgaaggtcacggtaaggacttagataattctaaatgagctgaaaaccatgggaggattttgagctggtaagggttatattccaagtagtaattcaatcagatgacttggtgtggagaatacacttgtagggggctataaaagggaaagagggaggccagttaggagactcacactggttcaagttagagatggctatggcttcacttagggtggaaggttggaggtggtaaaaagtggttgaaacaaggtgtagctaacaagacttgtggggtataaaggaaatagtaatttttttaaaaagtcct

SEQ ID NO: 133520 - DNA, 1101 bp, Homo sapiens
gaagttagaatactcaaagggggaaaaggtatttaattacattatgtggaattcatattcaatttcatgggaaaaagcaataattggttggcttttgtttttaaatgggaatagccactcattgggaaataattactataatttcaatttttattttactttagatcattctatgatgaaagcagttatcaaaaaagtcctccagaatggaaggagtgccaaatcagaggtatatcatgttttatttctccagaaagaattcttatttaattgcttttcttctgggatctcactgtactgcccagcctggcctcaaacttctgagctccagtgatcttcccccttcccagcttcctaggtagctaggactgtaggtatatatcgttgtgcccagcttttcgtctgtttttaataaaatgaaactattaaggcacttttctgccatcttaaatttacagtcaaatcaaatgtcttttctgtttttgtaaataccgtatgattctttaattttgggtcccagaactgctgattgcaaaccttttattaacatagagtatcttaacaatttccatttaagatgtagccctcataaatgatctgtaactgaaatatagtgtttattctgtctcttttagtaccagtggataacttctccatcagtgaaggaaccatccaaaactgctaaacagaaaaggagaactataattctaggaagtggtcacaaaggaaaagctactattagaattggtaaccttttctgtcttggctttttaatgctactagtgttctagtgtgttaaaattaaaatctcttctcattgtatgatattgacagtaacaaccaatattgactccgtgcatattatgaggtctgtaattgttctgataagattatgagaatttatggaatgtagaaatagtaaatgaatcattaggaaagggatgctagtgcttccatttaaaaaattacccttatttgtttttcatacaatattcatcattttggatatgttttctgattcatgattacttttgatactttgcaattgaaatttgggatgcactttgatgacagttttagcagtgcttttgtatgattttg

SEQ ID NO: 133521 - DNA, 2194 bp, Homo sapiens
tttgtgaggcctccacggatgaattttttctcctaaaaatcgtcctgtctttaagactctgtgtgtgatggtagagaataaatttctcatctgcagttgatctgagaaaaaatgtttatcctgcctccttgcttggtttatgtgaaaaaagtgtaataaaataatatgggttattttcggaaagattttatgtaaaaaagaaaaaaaaaatatgggcgattccagtattaattataaaccttatatgagagaattatttcagtgacatagcaagaataagttagtgtctttttactttgttattgattgtgttagactaaggagtagtgatagacatttatagagaatgacttaacacttcagaaagatcactttgattagatgtcctttagtatttggtattcggtttatattattatacaatcttgtcctctttttttaagcaaccaggttttcctgtgactgtgacagtagagagtccttcatcctctgaagttgaagaggttgatgattcttcagagagtgttcatgaagtgcctgagaaaactagtatagaacaagaagcattacaggtacaaagctatcactttaaagatatggagaagatcatttcaaactctagttagtttttggtgaaagcttgattatgaactggacagcttgcatgggaattctgttttcgccttccttctatctcatatcccttgaatggttctttatcttagaacaaggtaaaagggaggacgtctgcactctaagaaataaaaattgaaacatgtcatcagtaatatattttcctttccttagaatcatagaatattaattagatttagggaaggccttaataatcataagataaactcaaagaaattaagcactgaatgaatgtaaccagctgattcagggctctttgggaggccttatctttttgtgtgtgctaggaagtccacaattaatttttaaaaattaatacaattttcttttatatgaaacttacaaatatagaagtaattatcctttttttatatacttacatgtagcttataaacaacaggaatgtatgtctcacagttctggaggcaggagagtccaagatcaaggctcaggcagatttggtgtctggcgagggcctgctttctggttcatagatggcttttcaccatgtcctcacatggtggaagggcagttatcttatttttatgtgactatggaaatcactttttgattttcaaaaaatgaagcctgattttcattttttaaattaaaattagtgatatttatatagagaaattttaagataattacaaaaatgatagaatattagagggaaaaatctatagataatgtagaattgtccctattataaatgagcaccttttgtttgtagcacctaagtggtttattactaagttccagaggaaaaacaaaatcctagaatgtctgattcatgttcattattgttttaaatgtgttgtatttattttcttcaccaggggattaggaaattttattctaaaagtgattatagccattggggagaccaagaaggttaggaaatacaacttgggaatttctgattcaagatgcactgagaattctcttagctcttttctattttaagaactccataaaacgatattatcaaaatttctaacatacgtaagcctacaataatcaagataattgaagagatttcaacatatttttgaaatagagatgacagatggaaatgagtatgaaaccgatgcagtagaacagaggaaaaccatcgcctagaatatacacaggggaagcctacagctcagagggtatctaatctaactccagaaacagctccatacacagatatgcatataggaaaaaggaagggagctagaaatgtgactaacatggagggagctccttgacagtttgtatatggaagagttgactcctagccttaccttcactctcctgaaatgagatcatttggctttgaaaaacagtaaagtaactggggagaactagggtagatagtgtggattttgcaccctagaaaagggtagctgagaatatcctgccatactggctacccacttcttcatgcataacagaagctagtcatcagctcccagtgatcctctgctcccttattttttttttttttttttttttttttgagatggagtctcgctctgtcgcccaggctggaatg

SEQ ID NO: 133522 - DNA, 1052 bp, Homo sapiens
gtagatagagtaattggtagctgtgattcttgttaaagaccaaattgaaggtagttttaattgaaagtattcaggaatgtataggaatttttcttttattcactttgcttgttaaataagtttgaattaaaattaagtttgagatattaaaattgttattaatctgcagggtagatatagatatagatatggatcagtggtcctcaaccaagaatgattttgctgaacgaatatactgaaagaaagagttggagatagataattgatagagttatgttttgtaggtgaacggtttggtgaggaaaggaacaaacatattcttgaggactggaggaaaggtggtatagatgtgtggggatgaaggtgagaggcagtaggtgtgtggtagaaattgcagcttctactgagacagtatataaaatacggaataagtaaggaaatgaagtcaagaggtatctaatacattgttgggggaagagacagtgcttaaaggattggatgatatgatatggtttgtctcagagaataaatgtgggaaggtctgagaaattgggagggatgggggtgtagtctggagtaggataatgggttttaagattttagaagtatttaatgattgtaggtttggggaaatgtaagctgttcttatgtgcttctagtaatccttgccttttcctccttttcttctctcgaccaggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtaaatgaatagaacagaacttagtgattctacaagtgattagcaaaaaagggaattactaagtcagagagaaaagaataatgatctgtgcacatgctcagggaccagaagcatctttggggtcctttccaagactgagattagtaagtttgtgcccatttccttatattgtattgttgtaaa

SEQ ID NO: 133523 - DNA, 1153 bp, Homo sapiens
aatgacctggaaatcttctaagatcacagaataacattgacgttttgaactcgatttttaaatggatggctttgtttgtcactaaatttttgttttgtttttccttctagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatatggtgtcttaaaatataggattggaagccactaaaggaagatttctctatactttttattatagtgaaatttttggtctgtttttccctttgatagtttacaacattgattcagcaattgtttactgaggggctagtatgtataatatcattctgggtgctatggctttcagcagtgaacaaaacaaagcctttaatctcaaggaactaacattctgtggagggagaaaacagaacaacaaagcagagtacgatgaatagaaagggatgggagtgaataaatggaataattttaccatttggttaaatttggaaataaatatatatcacatggccagaagccattgacatattctaatatataaccagagcagcaaacatgtctagatgcttaagcatgttcatgga

SEQ ID NO: 133524 - DNA, 1359 bp, Homo sapiens
attacagggcctatagggtcttcctataggcctttatagatacatttttaaactttaatagcttgggttgcatgtctgatagaaaccattttgaaaatagcataaatgctggtgagaggttctgacatctcagcttaccctgtcataattggtttttgctaatcataggatttaggatcagaagatactgtatatttgcataacagtgcctccaaacatttataatattgctttacattcaatttacagtttttattatacttaaatacaacctcattaaagtttaaaagtacataagccttttatgaagacctcgcacattgataatcttattaagtttcccctatattttttgggaagaggacctctgcattctaaaacttattttcttttatttttggcggttctgaagactgcatggtattaagagaccatagggttaactatattgcttatttctgttaaattttgctcctgttggtttgggacatatacttagatttctgtgaagtgagatcacagcatggaattttgtgctccagacctaaagggcaactgttgcacatggattcctgtttgtgagaaagagatggtaagaagaatcacagagagcatcacggagtgatgaattaataaataacttgctcagtgaatgtaccacttgaaaaatccttctgccatgactataaagctaaaatgtttgcaatttgaaaatcagtttgtatggtcccctaaactaagtgagccttggcccacaatttgaatgcagaataactgaaatttccctgtattgttgtttacttgcaaatttcgtaggtatttctgttcatttggttttgagctggaatatttgttattgttgtttatctttcctttcacagaaatgagtcacaggtcatcagattttgccaagattattaacaatacagagaatcttgtgcgggaattgctgtaagttttaaaaagaccaaatcatgttacttttgttagatacttcctaaatctggatgtcttccagtattttctacactctattgtttgttcagaatatttcataatttaaaataatccttgtaagattctctccaattcactattagtacctaacgctttttatttgttccccatcccgtgtttatatgtttttgtttttattttatgtgatatttccaaagatttgaaatcattgtatctaggaatgatttttcagcactgtggcagttaaactggtgtgaaagagatgtaaatgacacagaaatggtcatctttgtcagcataattgactataaactagttcaggtgttctcgaagtttgagtctcatacgatctgtcagagtcacctggttagggggaatatt

SEQ ID NO: 133525 - DNA, 1052 bp, Homo sapiens
tactgcctgtagccattctcatcattatcttactttttcatcctggagtcaaagaattttgctttttattttgatgtataatagatacatgatttcatgggtaggcctaaaacattatcgaaaccccctgcccaacatccacctggttcatagcatgttgcataacacaggattattggttgcaagttataggacccccaactcactggcttaagtaaaaaagaaatgtattatctcacctaacagataaatgcaggagaatttaggtgcttctaaatgactgcaggaaggtgattttcccccatcttctggctctgctttcttatgtgttctcttcattgggtggccaccattggttgcaggattagctcctacaagtttcttctttccctcaatagaaacagctttccttacctagaagtttgagtaaaggtctcagtaccaaattccattggccagcctggggcaggtactcatccccttgagccagggttgaccacagttgaaccatgtcgactgagagtggcagaggggtaatttcctaaaggaacatcaggctgttgtcactaagaagaggaggaagagcttcaggtcaaacagtaaccctaggctttcaacacagtctccagtaaatagttgtccaaggattgcataaataaatgagtgaattagggaagacaaagtagtattgtaacattaccatatttcttgtagtaaatccacccaagttaaagcacttggtagagcatcacttgttctcaatctttgaccacatgagtttatgtattgactgttacctatgcttctgcccagagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaagtaagttctgggagctgagctgggtggtgacgt

SEQ ID NO: 133526 - DNA, 1593 bp, Homo sapiens
tgcttttgaactcctgacctcaggtgatccgcctgcctcggcctcccagagtgctgggattacaggcgtgagccactgtgcctggcctatgcatactcttcttgcagaagctagtcagtagttagtagtagtttttcagctaattagctgaaaaagtccaggggctggtttggctttagatatggcttgatcaggggccccaacaatgtctccaggacctggtggctccacaggcagaaaaagctgtccctttcttgaaaggtggctgcagctgctcctgaccttatattctcccaagtttcaatgcctttatggagcattcccagtaacggtctcatgtcctgtgccccattctgaatcagtccctgtggccatgcctgagttgcattctacctctgggctgtaggtttcattggctcccctggaactacgtgggctgagagtaggtgagggctggggttccaagaagaaactactagtccatcaatggatgtaggatagatggatactgggcgacaagtaaaaactcagatatctcccatgccttttgaaaaaatttactttattttattttgttgagacagagtctttctgtgttgcccgggttggagtacagtggctcttcacaggcaggatcatagcacactgtagcctccagctcctgggctcaagtgatcctcccaccttagcctcctaaatatctgggactatgggcacataccaccatgcccaccttcccatgccatttttgaagatgatttgttcccagtaaaagtcgaaaggttggatcgctcatcctctcaggatgttgataacgatggtaacaaaggatgaggctgggaggttgctttcactcgtgcaatgctttggagtcagttagtctttccctgctaggggaggcctgtcagtctcctggttgactcccatctatgtaaggaaagaggagagtgaaaagtgcaaagtctcaaacttgtcttctgtgatagaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaaggtagagtataaaaggcagggtgaggggaacccactgactcggtgtctgcagggacattttaatatatacaagagcgggaagaaccatgggtgtttgaggcctgcagaacccctgagccagtgcagctgccagtgagcaggctgccaggtgcgaattcccagctgttgcagtgcctgagtcctgctgttcccagcctcgtggtgatgtttgcctcacagggtcccactcgagtccttggggaactacctgcttttgagagtggttcttagaaacgtgtttggtcaacagacggggagagacttgtcttcaagagcagatgcagattatcccgagcccaggggacctatgtgagggagcttccccttgcctggtacccacctccaaaagcatcaacaggataccgttttatgagtggcttgccaaggcagggcagt

SEQ ID NO: 133527 - DNA, 1794 bp, Homo sapiens
ttgaacccgggaggcagaggttgcagtgagccgagattgcgccactgcactccagcctgggtgccagagcaagactccgtctcaaaagaaaaaaaaaatgtttcttctcttggtaaccagggagagttagaggccccacgttaaagactcctttctactttgggggtagaaaggaggtgtgcagagcgaatgtgaatatgtgccaggactttgcagtgatgggcttgggttagccccatccaggtgaggaccaggctgacggatcatcctcaggctttggaactctgagtatgggtttgctgtccacatggagattgctttagagcatgaactgctccctacacaggatagagtcatttccttaaaaaaattgtgcttcgggaagagttgggaagtttgcatacatgtatgaaaaatggccaaatccttcttaagcagcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactatttttcatcaaagcggaggttacattttaaaataaaacatgtaagcctgggcgcggtggctcacacctgtaatcttagcaatttgggaggctgaggtggatggaccacttgaggtcaggagctagagactagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagccgagatggcaccattgcactccagcctgggtgacagagggagactccatctcaaaataaataaataaataagcaaacaaacaaacaaataataagtaaaataaagtaaagcatgtttccaggagccggtgatcaaatgccccagatatcctatcagattctctgcccagctcacctctccctctgcaccatctctttaccatttgatcagcttttcctcttgttcttttctggggatgttgttttttgtttggtcttggtaatccaggatccggtggttcaccattaacccaaaagctctctatacatgaggtgctgtggcctgcatctcaaacagccagtgcagctttggagaagaactttcaaaagctgggcctcccctgccttcatttctttctctgtcgggcctgcgggaagctggctgcctgacagaacatactggcttaaatacctttctgggttttgttgttgttgttttttgagacggagtctcgctctgttgccagcctggagtgcagtggcatgatctcggctcactgcaacctccacctcccaggttcaagcgattctcctgcctcagcctcccgagtagctgggattacaggtgcgtgccactacgcccagctaatttttgtatttttagtagagatggagtttcaccatgttggtcaggctgctcttgaactcctgacctcaggttatccgccggctttggccttctaaagcgttgggattacaggcatgagccaccacaaccggccaacatctttctgtattttagcctaatctgaaggggtccttttagcctggctctcattcgctgactgggggctgcgttgcagcacttc

SEQ ID NO: 133528 - DNA, 1948 bp, Homo sapiens
gggaggccgaggcgagtggatcacaaggtcaggaaatcgagaccagccagaccaacatggtgaaaccccgtctctactaaaaatacaagaattagccaggcatggtggcgggtgcctgtagtcccagctactcaggaggctgaggcaggagaatcccttgaacctgggaggcagaggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcccttcagaactttgtatcacatagtagagttcttgaaaaggcctcacttttgaaaagacgcctttttttttttttccccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaagtaactaataaaaatacaaaacaaatagaccattaatcttaggccacctgttaaaagaatgagaacaggccaggcgcagtggctcatgtctgtaatcccagcactttgggaggtcgaggcaggtggatcacctgaggtcgggagttcgagaccaccctgaccaacatggacaaaccccgtctctactaaaaatacaaaaattagccaggcatggtggcacatgcctgtaatccaagctactcgggaggctgaagcaggagaatcacttgaatccagggggcagaagttgcagtgagccaagattgtgccattgcactccagcctgggcaataagagcaaaactccatctcaaaaataataataataataaataaataaaagaatgggagcatgcaaattaagtttgtgggcctgtttggaaggcttcactggtcccagactaccttctcccagtgggatggggatgcctggaatcctggaattcacagaggggtgtgtagtggagccagttttgggagctttcctctgggaaaagtgctcaactcagtggctacattcaccgattcctgagaaaactgtgccataacatcaacttcagaacctcatctgcagagctggagtcttagaacagccagggagagttttccaggggactttctggtgtccttttctaagccctggtgcacagggactattttgtattgctttaaaaaatttataacagtgatatactcttaggctgggtgtggtggctcacgcctgtaatcccagcacttcaggaggccaaggcgggcagatcacctgaggtcaggagttcgagaccagcctggccaacatggtgaaaccctgtctctactaaaaatacaaaaattacccgggcgtagtggcgtgcacctgtaatcccagctactctggaagctgaggcgggagatcacttgaacctgggaggcggaagttgcagtgagctgagatcgtgccactgcactccagccggggtgacagcaaaactctgcctcaaaaaacaaacaaagaaacaaagaaacaaacagtaacatactcttagcaaagacttgcaggtgggcagagtcaccagggtagccactgttcactgcttgctttgtatcctaacagactcttaactgggcatatgcaaatatacagagtcatatatttaatcatgcaaatggaacttg

SEQ ID NO: 133529 - DNA, 1146 bp, Homo sapiens
ggaggcaggacctcttatcctgtgttaagtagagccacaggggctagacatcagtgctctgcagagggctgggtgggaggggaggcaggacctcctatcttgtgttaagtagagtcacaggggctagacatcagtgctctgcagagggctgggtgggaggggaggcaggacctcctatcccagggatgtcttcagtcttcaggacagcttgcttgcttctgagttgtctgcctcttgtttaggcttcatagagccaagttatgggtgctggctccaggcagcccctaaaagtgggtgagctttctgctggccttgcctcctcagatcccattaagaaagccagagatcatgggcggcgagtgtgagcacagcagtcagctaggggttcaggcgtcggtactgaggtctggctaggacggtggacctgacatgggccttgctgcactttggatttagacaaaccaaatccacagtgcagcaagggcccatgtcagctttgaaaccctgggctaacacagagcttcaggcaaaagggaagcttggtcacctggaagtattgttggtgacctgggctctgcttggattcaatcacatggcagggtgtgtttctgtggttctgtgtggaggtggggggtgaacaggctgcaggtgtgggagaggagcagttggaagtgaagtgggaattgcagagcatctgatgaacagagggctgggcagcctcgtgtctggaatgcacacccacgtgcatgtgtgctgtgtgctggacttggccactgtcactggtgtgtggtgatagctctgcagtcccactcgcaggggagctagtggctggagccctgcagcccctggcaaagcagagggcctgcatacttgtgggaagagcttgcattcttggagtcagacaggctagagttggagtcctggctttaagctgcttgccagatgacttgaggcaaagttaacctctctgagcctcagtttcctcatctggaaaatgggatgacggtggctctaacccgaggattattgtgatcaataaagataggctgaggccacagtagacttcaggaagtactcattcccttctcttactttctctcttctgtctcttttgtccctctgacttcttggacgttagccagagag

SEQ ID NO: 133530 - DNA, 2550 bp, Homo sapiens
tagcaccttcttaaggagaggggttttcagactggggaaaaccatgcaccgctcctcagtgtttcatattttcagcttaagtttgaagggactactgactgccatttgtgtggcccacctgccacgtgccaggccctgtgctaagcgttggtctggcaggaagaagttgaaatacttggttcagaaagggatggtcctgagctgcgggaagggcccaggtgcagctggacttcctggaaccagggacacaaatcctcctccatctgctctccacttctgatcctggcttctctcagcgggaatgttggcttcattttcagatgggccttcttcagatgtttcctagaaacatgatcccctagggctctcatctcctgtctcacagttgcactaatattctgccgctttttctgctctccccactctttctccccacacccaattcagaaaatctcagggaaggccctgattggcccagttaggtcctatgccgaactctgagaccagggagccaaggggccttgctggacctgcatactggctggagggtggagttgggaagagcagggtggataaaatgccaggtgtccaccacaggtaggtggatctcccggttccagatgggaaaaccgaggtgactaattctgggtagtctgttagtgagtggctgccctacaatgggagtcaggactgggagggggagcccgtccttttaacccctcggccacagtgctctctgctggctggaaggcactgtgctaaggatgtgggtagaaaagatgaacagcgtgggcttctagccttccaagaccacagaggccaaacaacaggcacacagaaacttaaaagagcaagtggaaaaaaactatgcaggtaatatgggcaaggcgctctgggagttcaggaagtgaagagctcgctctgggtaggggtgggattggggtctgctgatgccttctggtggagataaggaagtgtgttctggctctcaagaagagtttacattagggcttaagctggacaaggagggactgatatgatgtttagtgaaaaatctgattaaacctttttctgaatggccctcagggatctagaattgggttgaccctagtccttgcttgatgacatgctcttgttcacatgggccctgcttttgtcttgtgtattttctttctttattttttttggagacaggatctcgctctgtcacccaggctagagtgcattggtgtgatcatagctcactgcagcctcgaacccctgggctcaagcattcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaagtctgttttaatgcaccttcaacagcagtttgcttgaatatagttctacttttgcaaagatgagctaaacggattttttaaaaatcttcattttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtacctttgaaaagtggacatattcacctttctctgagacattaaaatactggtgagtgtgtgtggtcctgggccccatgagcaggggagtgggtggtgagttcttccctcctgtacctcaccctggggctctcaggctttgggacctgtgtcccagtgggtggtgatgtttctcacaccaaagacatcgccctggggaagaatctcagttcactccctggggtaggtcccgtctactccctcctttgtatatcttctgggaaaaaaacaaatgtactttctgaaatgtgtcaatttaaggactcctgttagcgatctttgggacaaatactcctgtcctcctcttctgcgttatttccctttttaagaaaattcactcctttccttattataagacagatgctgttatcccagagtctgtgaatggaattggctttggcatgggctgactccagtttaaatattcccatgaacaaatgattaatgagtatgtcttaaccactgcccctgcacctgggaattctgcagaaaatgtctgggtcttgtattagtttcctggggctggtgtaacaaagtactacagacttagtggctcaaaacatcagaaaactgattctcactcttctggggccagaagttcaaaatcaaaatgtcagcagggttttggtccctccagagagccatgccttgcctcctttagattctagtggctcagggtggtccttgatttgtggctgcatcactccagcctccacatctgtcttca

SEQ ID NO: 133531 - DNA, 2473 bp, Homo sapiens
tttgccttacagccactataggaccaacttattatttctctgcagccttgcagagaaagaggtcactcacatttgccgtgcagctgccatgtgttggaagcttcatatatgtagtaccactaaaccgtcacaactagtctgaaatggagatattattattcccagtattcaggtgaggaaactgaggctgatggaaattaagtacaagtcatacaaggggatgataacccactgttccatatgcaagagtttgttttccctaagtaaacaataaatgtgctggggcagattttttgttttttgttttttaaaaaatcttctgcttgcatctaggaagtgttaagaaaaaaaaatctgttgatttgtttatgacaacccatacatttcagaaaagtagctggaataataaacatgtttttcagttgtccagtggagccccaaaatagaagcaagatgaatattccattccgcattggcaatgccaaaggagatgatgctttagaaaaaagatttcttgataaagctcttgaactcaatatgttgtccttgaaagggcataggtgagtacatctgcaatgcacgagcttggcaaagaattagcttagtttttcaaatgcagaataaaacaaatctataggagcctgcttagcttggagtagcagttatgtaatttgttgggccaacccagctgttataaggatgtgccttcttcctgttgtttatggaaccctttgcataattccccagctgagagtataatggagctccatcttccatgagggttttggcaaaattacctttgaaaatctcttacactgctcgtatagcacagaggttgccattccatctctgatgaggccagcaccactctgttctggaggtagagaatcattattattccaactgaacatcaaattagtagctagtcttgcatgctctatgaaaaataaatgtcctcacatgagaatagcagcagggaatgtcctcacatgagaatagcccagccccgatcttgctggcactgtcacgacaggctcatgaatgttgaacagaatcgctatcttcttccaacttaccttttcttccccacatcttgcttgctttctttgccaagagtgaatagttcgaatgactctaaatgtgagcatggtgaaccttcacagcttaagggagaattttctgatgactgagacgtgtgaagctctgtgccaggtgtcgggagtttttaggtaggagaccggaaatgatggtctcaggtgctgcaactctcaggagccagtggctagaaaaaggtgttttgatgcgaaattagacgtttttgttctcaatgcctggatctttggtcattctaggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaagcccttgt

SEQ ID NO: 133532 - DNA, 1917 bp, Homo sapiens
agtcatgctcagagtcagcctcccctccttcctcaccctttcatatgtggttgcacatccctgtcatctgtatcagacctgtgcttctcaaatatctgctaattttcattccattgccatgtcagctctgctatgtcagccctcagtggattattcagcagtctcttctctgcccccatattcccctcccaccacagccagttgaactatgacttccccttgtgctctttgttgatgcatacaaagtccagtactcccagcctggcagtcaggactttgtagcatgggacatggcctcttgcacctctcctgcatttgtgattcttggaaagtggcatgcatttgcccacactatgacataagcctggagtttctgtgcccactcaggaagaccagatgacacccgccaacctcttcctaaactcatttgtgtcctttccattgggacaatgttcttttcctttgttttcaccagggggatccttttctcccattataccatctctgttttgttctttactatgccaaggtggctgcatatgtgccttccccatacagcagcatggaaagaacgatggttctctacctcaagcacctagtgtcctgccttgcccttcgaggtgcccagtgaagtctgttctttttagacacagggtctcgctttgtcacccagactggagtacagtggcgtgatactagctcactgcagcttcgacctcctaggctgaagttatcctcctgcctcagcctccccagtagctaggactacaggtgtatgttactgtgcctggctaactttttaaatttttttgtagagacagggtctcgctatgttgcccagactagtcttgaattcctggctgcaagtgatccttttgtcttggcctcccaaagtgctgggattgcaggcaagagccactgcgtctggctgaatgaaaaatcttaatgtaggtcacgttggtctttctgagtaccataaactgagcttggagtaaaggcagagaggtatgatctgtcacataacatggaccttttgttttttttgatggagtctgtctctgttgtgcaggctagagtacagtggtgtgatcttggctcactgcaacctctgcctcctaggctcaagtgattctcctgcctcagcctcccaagtagctaggattacaggcacttgccaccacgcctggctaacttttatatttctagtagagacagggttttaccatgttggccaggctggtctcgaactcctgacctcaagtgatccacctgccttgtgctcccaaagtgctgtgattacaggcatgagccaccaccacatacgtggacttttaatatatatattttttcaagagcttagtatccaatttcgttttctactaaaatggtcaaatatgattctgtggttgaatgaggaaatttagtgtcttgtgagttcccccagaaccatctttataaatctgaaagcttttggaaaatggttaactaccacatacggacaaggggtaatcactggtgtctggccaaacagggaggttctggaatagatattgctggaaaatattcatcagagcaaaaaacttgacctttgtatgtctcgagggaatgaactgatgccaacctgctgatcacgcagagaggggtgaaaaggggagataaagatacaggcttctgggtcagcaagctgcaggagtcagaactggttggtctttccttgaagattaaaatggaaagcaaggtagattgacaggtgtctttgcagccttgcagaggctgggagaggggctgcctcatattcctttggagcctctaaattgtacttcttccccaaatggaacttggaacttttttttttcttttaaaattggttaaggccgggtgcagtggcccatgcctgtaatcccagcactttgggag

SEQ ID NO: 133533 - DNA, 1051 bp, Homo sapiens
aaggcaggaggatcacttgagaccaggagtttgagaccaccataggcaacgtagcaagagtttgtctctaccaaataaataaataaataaaataaaataaaataaaataaattatcagggtgtgatggcatgcacctgttgtcctggttactctggagatgaggcaggaagatcgctttagcttgggagtttgaggctgcagtgaactatgattgagccactgcactccaaccttagctatagagcagactctgtatctaatacaattttgtgatgtcaatacatttcaatatgtgtggataataaacaaatcagtagactaaaaacttaaatacccatataggtaggatacattgattttccttattcctgattgaagattagctgattttaacatacgaaatttaggaattatgtatacataaagcatagtcgacaggctataaacagagctgagtagtgttttattctctcccatctaaggggctatgctcttcagtgtttacttaattttcttttctctttactctgcctccttctcatctttatccatctcttcttcccacttctttccaaatcaacaagcatgtggtaccaaatgcccacactgtggtattcgattaggatccacttgactgtacttatccagttccttggaaatgtgcagcctttgttttaactttccacatgcttagtacttataatagaaagagacaggaaccaagatgtttgctttttctagtgagagaaaataaaacaagaagacaatccaaaggaagccatagtgagatcatcagtagataaacatttcacaagagaaatgataaccactattatgagaagcaaatgcagcttcttttttcttggccatagaactttaaaacagtctctgaaaacatcccgttatccctcagctagcagacacacatcttccaatatttgacaaataccatcttgaatctttcttagtgcaggtggtgctaactatgtcatgctgttactctcttctcagttaaagtcacatttctttttcaaattccttctgcacagg

SEQ ID NO: 133534 - DNA, 1091 bp, Homo sapiens
atgacaggcagtccatccatgtgaactgaactggggaataaaagttttcagtttgtttagagaatcccagggatgggtgaacaaggtggggagtagggtttagtgggagtgggaggggagcagcaatagtgaggatggcctttaaaatgacctcaggtcaatttctaggtgagggcaacacaatcaatattagcaatatgtaggattgatttcaagagcagaagtttaacttgaatgcaatcttgcagatagttttccccagatgctttaacatttgttgtttggagttattgacaattgtctgcacttcctattttcacttgaaaatttctagtctctctccacttagtcagaagcaatatttcctctaaactgtgtggttttaccagtcttcaattaccaccgcctaaggcctctatttgtaatcagccacccactctgcttttctggcaagaaaagcacacctgaaatgaaaataagcctctaggcaaatgcagcatactgataagaaaacagccaaagcttttgactctgggtctgcacaaccaatttctccatggtgacaggagaatccaagagaaggatgacacttctaagaagcatgaagatccaagcggaagcaacttgaatggtataaaaagataagactgtgtgtgtctgtgtgcatcttttggtgagtgtgtgtgtacacctgtgcgtgtttgtgtgtgtgtgtgtgtgtgcatgcatgtgtgtgtgtaggcctgttctcatgcacattaaagagaacaatgcagtaactagattttttttcttagacctactttgtttaacagctgttcccataaagatcattaacgtagagaatggattttgcaggcctaagacgttatgcctgaaaacagttcttcctgcttaaatggttctcactcttaacttttatctgcttctttctttctcaagttcattcttttggtgtctattctttctgtccatgcttgctttcagtccattctttggccatcttctctctctctctttctctacccaccctcccccttttctctctgaaaggatgttcctgtggcccaggccactgtggtatcatgccc

SEQ ID NO: 133535 - DNA, 1582 bp, Homo sapiens
ctctgattggttggtggagacgcctaccgcaacgggggtgggcggggcgcttggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagtgagtgcgggcggcggggcgcgggctcgccgggtgctgggggattccccgcgtcgccccctgcgcaccgagttgtgtcttttggccggaggggcgtggagagccgcccgaaatcggcgccccgcgccgggagcagcccgcccgccatcacccccaccccccggcgcggtggccctcggagggggtgcggagaggcaattgagttgtagccattttcttattgttgtctttgaagcccctggaagccgcgccgagccgtttgcggtccccgcgccgcgactcctcgagggggggtggcgagcgatgaaggaggcgcgactccgcgcccgggcggggagggcgccctcggcagcggcgctgctgggctggctgcggtttggaagtgcggggcgccggcccctcgcgccgcgggccgccggggcgagcgggcgaacgaacgagccgagagggtggcggccgcctccctc

SEQ ID NO: 133536 - DNA, 1043 bp, Homo sapiens
gtaggttttctccgtctccctgcttcgcctgtgatgtgggctaattaaatattttattgttgttcttcaggcaccgcatcagcctgctcaaccctttaaatttacaatttccgaatcctgtgatcggattaaggaagagtttcagtttttacaggctcaataccacaggtaacgatattgactttagctgatccttctgtttgcttagctcttgtctccccgacaaatacacacaaacacttaccctcctccttttttgtgggggcgtcacaaaggtattatttttttttctcggtgggcagaaagggcaaatcaaggcctccttccttaggcaggtgtaaataaattaaacatttcttctaccgtaaataaaaagaaggcagaacaatcgaaactggggagacttggaaaacgctgaggccaaactttcgatattgatttattggggccgggagaatgaaaggttgggaagattctggggccttttgacatccttggttctttattactccggacttgattccttctcacttttttctgccattccactgaagagctgagagcccagggaagtcggagtgagcgatttcattacttttatgctaaaaaaaaaaaaaatgttttcatcttatagacgatttttagacttagggtgcctttgagacatttttctttagctggctttttaatgatgcctaattcttatttcataaatgcaagaaccaaaacaaaccactgaacccgattgacactttgcccctgggtggtggtattcaacttgtctgtgtgttttggagggaaaaaaacaagatatcattcataagacatgcttgattcatattttcattaatctctttgtagaacattaaagaaattcccttgtgacgttttggaggacttatttgtgcttgtatgtgcagtcattattgaagtttattttcgtgtttgttttattaagtgaatattcaattctggaggaagttcctgaattaaactgattagaggatttgtttccttaaaacttaattaaaaaaaaaatccta

SEQ ID NO: 133537 - DNA, 1262 bp, Homo sapiens
aaatctagcaattagttcagtagcaaaaaaaaaaaaaaatgattagtcagaaagcactgagagatacgactcaaacagtcttctttttgtgcaggagactgaataaaatggtttggcttaaatttcctagacagaagaataatagcgggtatatctatctatatatatatatacacacacacaaatatatatacatacatatatatatataaatattgtttggcgatagtaattcctctaggaagcatttatttttagtgatctcctagtggaagcacttcaggtctcatcagccatttcagaataggtgtgtatgtgtttgtctgctgggaaaaagacaagggaaaacttactgcttttcatttcctatttatggtcaaggtggatgtcattactttctaagttgagaaaatatgaaatgagcacatactattaggccttcactatttatggattcctttttgggtatagttattttctacatgctcagaacatcccagatagtagatctttaagagatggctgttagacaataaggcaatctgatgaatagtattggaaaacaaaaagttggaaaaaaatgagacgttgcttacattgaggacttttaatttcagatactgttttactttgtatgctatttggttatgtcaatattagcattatagtatagtttgaatggcctgttgaaattaaattcttattttggcatctttgtcatttctgtttagattagtaatgtaaatatcttctgcttaaacaaaatctgttcaatcttgtggatggacttctcttagttctaccttacaggaataaattacatgagagatattgtttgttaattatcccattacatttcctttgaggtctggatcttgtgtatgtctctttttttgtctgcaccccactccccaaaattaattagtgtctttttaaagattggaccagatgattaatttagtccctttatttctccttctgtatcttgtttaccctaaccacttagtttccaggtctccttgtaccatctacatttctaagaggcacatagcttgtatttggctgtatgtatttctttttcgagggggtatgtgaaatcccttaattttacacattttatactgctataattctgtcatcttcttgtccagctagcctcaaatgccatccatttaaaattgagaacagtacattttccctttttttcgtttccttttaaattcaatcatatcaagaatcctgagggcagtttatcacattat

SEQ ID NO: 133538 - DNA, 4700 bp, Homo sapiens
tagaattagtggattttttttttttttaaaggggaacttggtgatatgacgtggaattggaacataaaatatgaatctaaatttctggtaatctttaggattgatagagctaagcagatgaagcaaaaaaaaaaaaaaggatgaagtattctaggctataatgggaattaatgctgtgccattgtctcaagttctagcataaaagtgaagatgacaaataggacatggttagaaatggcacatgttttagtgtgacgtcttcaaaatggaatttttaaaaatgaaagaacataggcccttattccctaaggatttccctaagtgtatggtttttgttttttgttttgtatgagacagctgacccagggtttagttgttaagtttttttgctgattgttcttctttgtaaatacagtgtggcttctaaatgggttggtggcttctaaatggcacagtggggtgatgcatggagttgatagcattactaaatgctgcttcttcccatctttcacctgtaatgctgtcattaaagaagtcctcactgatggactctgacagcagtggttaccattctaaaaagtgagtattggatatagattaggaacagtaggtatgtgaattcaacctataggaactatatggagatgaacataccatcttttgaaaaggggagcatgagaacatctatgacttccttatagttagtattctacaatgtgaaagcttcttcatttgaattttagtaatcatcaggaaattttagaaatctaaaacgcatagaatctgaaagtaagtactgcacatttatgtatgttttatgtgtgtatttttatatgtgtgtgtatttgtgtgtgtgtgtgtgtatatatatatgtatatttaatcaaagcaagaaaactcctgtttcacttaaagccatgtaaattttattacgagacttgggccacaaccatttgagtgctgctaaaatattaattgaatagaaatgaaagggccttgccaactgataggatatcataatcatagcctctttggtcgatggtaaatgatgataaatgacattaggaaccttttagcaaactgtaataactacaaggagggaagcagtatggatttgcattgtatctgataccctctagtaccaagtggattgccaatactgcttgtttagcattttctaagggcaataagatattgatttctgacttacaaggaacagctctattttcaccattgaaaagtattgcaggttgttaagaagaaattgacttgaagaggccgactgctgcccatcatggagcaaataaagcaaaactgccgaagcatggtggagcagcgagacgggccctcagcaatttgttgctattaatttaccatgctcgacagcaaatcaatcggcatctacttcatctgctggagaaaatgctgtccagggcagataaaaggctcggcatggtacagagaatagactggattggccaaaagcaggctgcagttaatgtgtaaataagtgaaatcaaggccactgttgcagaggaagctgttgttaattaggttggtgttttttagtgaactattttagaaagcagctaggatttggagagtaagaagagatttattgagattgaagtaatacatgactggcatgacattctagccttgagtgtacttgaatctagggtgcagtaaatttatttggggacactgcttgctatgaagtttgttgaaagttcattttagaccacatttcccttatgataactttttttttcaaccttgccagttttttgcacatcttctgtcttattgtgtactcttagatttagaagagtagatggaggagtaggtgttttagtatggaggcacaaatgtgtctgttatattcttacccagtgcctttttttttttcagagataggtataattgaactcttgtataataatgagagtgaactatcatggaagatggggtgttctagctgaaagtaactaataaatgaagattttgctgacagaactttatcttgcttcagaaatattaggaaataacaatctagagggcctgaatagtgggtagatactactagattataaaatcttaaagatgacaagtgaaattttgatgtctgcataaacttcagatacaattataagactatgtgtgtgggggtgggaagggttcttgtgtttttggttttcattaaggtttaaagccaccttttctaatttaagattatttacacgctgataatattccacaattaatgttaacggagtgaagggtattggtggtgttttttcccctttacctctcatttgggcattttaaaataggaggccaacttcatttactcctgtttagtaaatctaaatgagtgtaggttttaaattagattttttcccaaaacccttcagaaggtctagtattagggcagttgataagtaagtggaagcaccttgggcaggacccagtgacctgtccttttacttattacagcacctgcacgggaagcagatctggaggatgaaatttaacctgttacagtgtgtgtatgttttagggtgtgtgttttccgaatactgtggggagttccctttttccttctcccatgatggattcttttgtctttctagagataccataggaggatatctggatttttcacctaaggcagtgattcttgagtgaaattggaatttcctttcaatagaagtaaacatttattatatatctggcttgcgcttaccactggtctgggcacactgccaaaattcttatcgttagttctcataatgatcctaagacagggattatatccaatcaaaagttgattaaacagggtcagctctgcacaaggtgatacagctaatagttggtggattcaggacttcaaataaatttatgtgggaggatatctcctgggagatgggtttgctatgggttagagattcaggccccagttcattcctgaaatagagagtccctgaactttaggctcatacgcagaacctcttgagttgggggattctctgcaactgcctagagtccatggatggctcagcctgccctctgcttgcagactgctttcagtgggtgagagggtgaggttgctttcactcggaatctcccacatgtgggctagggaagctgcttgcttatcaagatggaatttgcttcctccctaggcaacctatttctcatttgtttacaaacttgttcttctctttaacttttatcttttcctgtggcttatgagagtgcctacagacaaggggctgtttgttaatcaccatcttgtgggcttttgaagggggaagctgggaggggaaaatgtgatgttttgtagcctctttgtagtttagaaagaggttcgtcgatgcaggaaatcacacaactcagttttaaatgaaggcagatgttttgcttttactgttaaaagaatttctttgcagcattcaaacaaaaggatagttccttttcactgccccttaatccctgctggatattatttatttgtatttattattttgatgggcaaagttctttgtatctaggtatatatcactttgatctgtgtaggaatgatggaccggactaatgagctacatctctaggtgctgttgcagcactggtgaaggagacaatacaagcaccagcccattgttcttcacattcttcatttaatctttgctttcctagaatacatcttttttatttcttcttttttttcttgtgttataagataggtagaggaaaccagttgggaattaaatgtttaaaaaatgcatttataagttatttgtgtttgtttttaatgtggctttttttttttttttttgcctttgatgtgattcgatggtttggtttaccacttctggacagcaataatgtatttggtggctagagaaaagagggacagggatgtgagttctagaaggcactttcttgatccctctacacaccctcttaaaatgactccagcgttccagcaatggtggtaggttcagtggtcctatactagctaagttattaccagttttgtaagctgggctgttggagagaagcaggggggcagcacatttacgcatgggcaatggagtatttacactgataatgacagtttgcaaggcttaggacttgttcaaagtaagtatactgcgaacagtttatgaaattattactctaaagaggaagggcctcagaagttttagtcagaagcaagagttagagctgttttgtctttgccttagtaatagctctcagtggtagttgttttctatctatggagagggatttagctggcattcatcaccacaaatctatataccctctctcttttcattggaacttacccagcatttatgccaggctgttgctatttctatatcattgacccaaaacttatccctggagagctgcacgtgtaacccttattccatccaggggtgacacatgggcagggtgtggattttcttagctggttcatcaaataagcagaagagaagtactctgggataccccttaggtactctgtcctctggtgagtggatcgcactgtcatctcttttgaggatttgcccacacacatttcaagaattgtatggtggaggcagcttctgcgtttcacggaatgaaaggataacttctctcccggtgcgagacaatactctatccccaacctgggctggctgtggtgtgct

SEQ ID NO: 133539 - DNA, 1865 bp, Homo sapiens
ataatatttcacttattcttacaacaatcttatgagattatagtagtagtattatttccattttacgtatgttggggctgagacacagagagcttaaatagcttgcttgaaatcagctagccggtaaaatagatcttgggtttgactcaaggtcagaacgctggtatgacagatatttctgccttattccagttgatatgtttggaatactccaccatcagcatacttactaccttcccccaaatgcttgactgattccggagcctcagattctagttctggccttgctagtcaccagctttgtgatattgctgagtaccgtacctttaagggccatgcttttctcatctttaacttagggcgtaagtgaacgcccagatctcttttagctcttttggttaaaatgaccatttcagtttggtttgttgctgtgatccagtgaacagaaattgaatttttttttttcagtcttagaaagtctcttttagcacttattttcagaatttttaaaatccaaagttacccaatgtgcctaggagtagaaatgtatatttatatactattaatactttattttttataaggtactttctcatccttttttttcatgtaaaccccaataataaagcattccccccgtcctgtggatgaacacagtgagacgcagatgttagatgacaaagttcttcacttaattagtaggtggtttacaattcactgattctcttatggccagcgttcaggctaaagtaatgttgacacagaagtagagcaattttcataaaacatgtaatataaaagtatatataacataaaatatatcagtatgtctttaaagtgattagtttttgtacttttcctttggcatatattagaaaacttaggctgggcacgtggcttacgcctgtaatcccagcactttgggaggctgaggtgggtggatcatgaggtcaggagatcgagactgtcctggccaatgtggtgaaacgctgtctctactaaaaattaactgggcgtggtggcgcatgactgtaatcccagctactcggggggctgaggcaggagaatcacttgaaccagggagtcagaagttgcggtgagccaagatcgcgccactgcactccagcctgacgtcagagcaagactctgtcacaaaaaaaaaaaaagaaaagaaaattgtgtgacttctgaaattgtatgaattataaagtgatccaataattttcttccaaagatgtgcaaagggactatgtagcagtttattacctgttgtgtaattagctccgggggttactcttctagaatctaaggtaggtgtcagtttctctagcttgaggtaaagcgtgtctgtaaactgtggcttacagtgagcttgacatctcaagtcctcaggactttcttgctttgtcccatcaaggaccctttccttagggaagataaattcattgtaaataaatgacttaatcataagtagaagaagggagaaatgtttaatcttggccttttggagtttataaatcaaagacacagtagagatcaagttccttcattaaagtgtagttccaaaaaggaagaatgtggttttggttttaaaaaatttttttatttttaatttttaagagtacatagtaggtgtatgtatttatggggtaaatgaactattttgataccggcatatagcatataataatcacattcgggtaaatggactacccatcaactcaagcatttccctttttttgtgtgggttagaaactttctagttatactcttttagttacttttaaatgtacaataaattattgttgactgtagtcactctgttatgctatcaaacactataccttattcattctgactatatt

SEQ ID NO: 133540 - DNA, 1920 bp, Homo sapiens
actagcacctaaaacaatgcctggaatatagtagaagaaatgaatgaatgaatgatggaacagctaaaggagtggtttaattttttcattttattgcatttcatgtagcatcacatattctgagtatcagccacctttatataagctgtcttcgtttctgagtgcttagggagggcctggctttatgctgagcaaaaaaggcctagataggcaatcagagagtgggagttcttatctcagtctgctacaggtccttgagctgctgattggcatttttaaaatttagaattggattcatactttgccagatgatttatttctaagatatctttcaactcttaacatcatatgatgtttaaatgaccagcttaaaaataaaattcatccctacttccattgctcggtactataggcatgccattttagtaagttaagttttaagataatttttataagaggaaatacagccaggtttttttttgtttttgtgtttgtatttttgtagaatctcactttgagcaatgttaggctattgtgtggacagctaaaacaatcctaatattgccagtgtttcacaacctagaaccatctgctgtgttgctttttttgcagttgtagctgcatcttcctggtccttctataggctaagagcacatcagtaagtacatatagttaacagatttttcatatgtatatcttgggcaagtgttagtgataataagagcagttaaaatttatcgagtgcccactggataccaggtaaagcactaaatgcttcagatgtattaatttgtttaatttgtaatcttttgaggaagggatctgattatccttattgtgtatgaggaaactaaggtaaagagaagctgagaaatttgcccagggttatatatagctggtaggttacagagtaggggtgtcaaggccaggcattctggcttgagaacctacattctggttttgaaccactggcaataaatgtctcataagtgactatggtaaacttctttgtttatccttgcgtgtgtgtgtgtgtgtgtgtgtgtgtgttttgagatagagtctcgccctgttgccaggctggagtgcggtggcgtgatctcggctcattgtgatctccgcctcctgggttcaagtgattctcctgcctgagcctcctgagtagctgggattacaggcccacaccaccactcgcagctaacttttttgtatttttagtagagacggggtttcaccatgttggccaggatgggcttgatctcttggcctcgtgatcccacccacctcggcctcccaaaatgctgggattacaggtgtgagccaccgcgcccggcctatccttgttttctaaatgaaaaaacaaatcgtctgcttctgtgttctgtacacagtgagcttaaatgttaaaaataatagctggtatcatttgggtattttgttttgcaaattaacacactagattagtggactcattcattggttcatcttttatcacagattctactgtttgtccgtggctggataaccacaggcctctagatatttttgtacctctgactgtgagatttctaaaacaggcatggcaccttcttttataaccacgtgtcacatgggaatgttcagggaactgtaaacttttgagtgcctgcctggggtggaggagagatggaggttcttggctgggtttgaaaggttctatatagttctggaatttatatgcataattgtgtaccttttttgtgggggcagaatccatagcccttactggttcaatgaggaaactggaacccaaacaaaagaattagggaggtactgtgctagagcagtggttgcaaactggagcagttcctttcctcagaggatgtctggcaatgtgatgatatttggggttgtcacaacttggagttgctactggcatgt

SEQ ID NO: 133541 - DNA, 1044 bp, Homo sapiens
gagccagtagtcctggtcacctcagagggaatgcaaaggctcttattctttcatccagctaatgttaattaacctcatactatgtgcaggttgctttgagggctagcagttaggaaaggtaggaggcttgcctccatggagaatctagtctttttacttcatttggaccactgtaaaaaatataaagcagtgcagtggatacacagttgtgacataggtggaagagaagggggtctttctggctccttgagtgattaaggatgctgttacggaggaggtgggcacagtttagtgagacctcagaggatggggagcacttaggcaggttgaaaggaaagggtaggattccaagtggaagccacagagactggaaactgctgtgcatattcaggctgtgtttagtgtttccagctttattgagtggtagaggagagaataattgggaatataggtttgggatgcattatagaaggccttgaatgctggtggtagtgcttgggctataaaaagaaagcaaaggggagattaatcagtagttggtcaagggaccatatctgttttgctaatttgttcagcagctagcatgaggcctgagaacaaatgtcagtgaatgttgttgaaacgatttgagtggagaggggcgtgactggagagggacagggtggaggaagtgaagtctgaactagggaagtagaactggaaaggaggaatccctatgacttgacatttcattgggtgaggagtatggaaatgcataggaggaaaggccctaagacattgatgtctgcagagggacagagtcatggtaccattcattgatagaaaaagatactttagaaggggagaacttggtgttgataatgctgccaggtgtggtacctaggaaggagggagtgaaagaaggaagaggaggagggaatgaatgagtttgttgcttcttttgctttcgttcatcaccttactttcatctctcctgccaaatttataatccttccaagaacctcaaggattctttccacatcttctgtataccacagtggactt

SEQ ID NO: 133542 - DNA, 1025 bp, Homo sapiens
atgaaattaaaaaggccatagagtacatttttggtaaaccaaaatattgcttggtggcataaagccacagatccattccaaaaaaaaacgaaaaccgaaatgtggttttgctgtctgtcatgcagtctgtttcaactgtcagaaacatacgttgctttatgggatgtttttttcaagtctgaccgcagcttttaatttccttcattccacccacacctcctaccacacacccatgtatctagtactaatttataggcaatttgaatctaatgacataatcatcagcaagcaaaagggtcagcacttgtggcaaaagtttctttcttggtgtgctaattatcagttctacactcttggaaactctaaacagtcagaacacagtgattgtccttgttcatggacttttcagtctaagttagattgaggcctttaaaagatgggtttgaagtgctttgtatttttgctaaaaacataatattaaagaaaattaaacaatattcagtgaattttagaaagcaaaagaaagaaactcactcatgttcctacagttgtgccttaactgctgaccaggcagaggcatccctgtgtctccatcatatatgctgtgtctgatggagatcatgtcacccaaatgaaaaaatacttttctagtctaggttcaaagggtgatacataaaatacataccacaaaaaattaatgatacaatgaaacctcagatctttaaaattattattgacttattggtaactttacagtttcttcaactccttataggcaatacgatcctaaatatttttaaaaatctagtcctaattcagccagtaacttcctgtgacattggtaaattatttaacttttctgagtctcagttcctcatccataaaacaagggtctaggactggatttttactttttataacatgttggttcccaggcccctgatctgggccttaggcatcagtatttttctaaaagctacagaggtgattttgatgtacagcaaggttgaggaccagcgaactag

SEQ ID NO: 133543 - DNA, 2488 bp, Homo sapiens
agcaaaacataaatactgagaatgtcttttctgggtaaaagtgcaagaaaagtagaaaaacagcaaattttctggggctaggcctgtgagctcactccttccaatcagtgaggaggcacttgtcttctgccactgtaccagtgagtctggcatccccatcccactttagatctgttccctagccacctcatggtccttgcagcccttcccctgtgtagtataaattagtaagggatgctttcttaattgagagacagaaagagccctaagcttgaatcgatacctaacaatacagccactcaatttgtagcactatctaatctcagttctgtcttaaaacagaactacttaccttaagggattttattcgtaagcctaccctcataaatatttctgtcagccagatatggggcagccattcttcccatttcatgattatagaaatggagtccagaatcattttggagtttgcttattaaagtcatggtttagctagtctagaaattagagtcacactaggatttgggactgcacagctgtatagttcgtaatatttggtgttcttttcagaatgttttgtcacttgattctgaattcttcccatgcctttccataattgtcccctaaccaaatcttgacacgagcctgtgatttccctattttaatgaatggtaggaagcaccatatcatccaggttttacacactggaatcattgattccgtactcccctggttgtctaatctagtgaagccacatagtctgctagttctccatgtgcagcctgcctcctttccttgctctcaccacggtcaccatcactgaccatcagaccttgttgtcatactagaggctatggtggtctccaggctttttgtctgcagcctttgccttctctgttctcttatctgggcttgctggacctcccggtctacttttatatctaccttttggtgttgggtcattttttagggtcccttctctgaccttggaaaatcctaccagtatttccaatatggctctgtcctcttctctgcttactttgcccttttatttaggtaattttattcactctgagtagatgaatctcagggttttttttctactagcccagacccttcctctgagaccattgtatgtcctcatttgccttgaatgtctcatagatacttaaactcaacaggtcccaaaatgacatagtccccccacaagcctgcttagtgattcctatctgaggaaatgccaccaccatccacccaatttctcaagccagaaacccatagaggcagctgattattgtccttccctcttattcattagccacacccagtcaaacatgaggtcttctggtatcaactcccagttactcttgcatttgtttacttttctccagctatatgatcatggtaaattaaccactgtatgattctttggctttatctgtaaaatggggacgagagtaatcctcttaaaattgttctgaacattaagtgaaatatctggcacagagcaagcgttccatgaatgttaggatggtgaacacccttggccaccatatttaaaaggactcactggcctggcgtggtggctcacgcctgtaatcccagcattttgggaggctgaggcaggcggatcacgaggtcaggagatcgagactatcctggctaacacggtgaaaccctgtctctactgaaaaagaaaaaaaaaaaaaaaaaaaaaaacttacccaggcgtggtggcatgtgcctgtaatctcagctgctcgggaggctgaggcaagagaattgcttgaacccagggggcggaggttgctgtgagctgagatcgtgccactgcactccagcctgggtgacagagcaagactccgtctcaaaaaaaaaaaaaagaaaaaaaaaaaagactcactacgagtaatgcaatagcctcctaactggtatgtcctggatagtgataattctggtccactaggttcttttggatctacttctccaccttcaccttgtgctgatactaccctttcacttttttatttgaacgtcagtgtcccatgctggtatggcaggctttgctgggaatggtcttacccttttctctgcccctttctcctttgtgtgtcagactcattttaccctcagttactcagggaaatagtcctctaaaaagcatttaaaaataccctgcattctgtatttgtttcaatgtctgtctcatttgctagattatggactctgtaagtcctatcttgttcctgtactgtttttttcagactataatgcagtatatggcagagtagcagacaataatcgaaagttatgaaattaatatggctcacattactctctccccaaagccagaagggttttcttcccctcctcactcttagatttccagggctcctctgtgtagtagctagggcacttaacacatggcgtttgttattgtgtttatttatatttgatcttccccccccagattataaacacctcgagt

SEQ ID NO: 133544 - DNA, 1113 bp, Homo sapiens
atctttcatcctccatctttcctcttgtggtatgttttgtggttataaatctcttctttccgtccacaacattaaatataatcagtgccaagaggaggatggaggacagaaatgcactgtggtgtcttgacctgtctggtacttatcataactttcctaggaattgaccttgatgggcccttactgccttctaaataaagttcaaaccccttagtgtggcattcaagaccttccatagtctgaccccagtgaacctcttctgtccttattttccactctattttttattgcatgcatcctgtgctctagcttaatggttttcaatcctgcctgcacattagattcacctggggagctttaaaaactgaagccagggtcctgtctttggagattgtgagttaattcgtctggagtgaggcctgggtgtgggtgtttgtgaaaggtccactagtaatgctgatgtaaggccagggctagaaactactgacaagctcagtgtttcccacggaatatcatctcctctccgaattttgacgagaaagggtcccaaagtcaaagaagcttgagtagtaattgcttttaatgtgctcctttccaaagatgtacaacgaacactatcaaatgaaaggctctaagatacccaacagtaaagaaaactgtttaactttcttcatagtgtgtgaggtcgtctgataagagacacttttatgtatataatacttgttaataacatctgcaacatgtggtatagaaaatgtttttagccacttctcaacttttgagtcacttctttttttgtccttccctgatcatgtcatccaaatcagacccacctcctgccccagggctctctcttacacccccaattttgtcttcatagcacttctcagtatctgaaattcctctttatatacttgtatgtttgcttctgtctccctccacctatgatgtgagctccatgaccgcagggatttacttgtcttgttcacccctctgtcttcattcagcatctacaatagtcctgacaaatagtaagtagatatttaataagtatttgttgaatgggcaaaaatacacgggcagtaatgcattcgtggtttaggctttttctaa

SEQ ID NO: 133545 - DNA, 1004 bp, Homo sapiens
gggttaataagcacgaactcgtctacacattgtagtgtgtataattcctgagctccaccaccacaccttgaattatcaggaactgaccttttacttcctgtggacctagtgatgccgtcgcatgagtaggccctttccttgggctattaaaatcatcaagttggttcactcgagataacattatagagatttctcatgaacgctgtatacaaggtgctctcctagggtgcttctaacaaatccatcagtccagtgggtcaggtgatcagcaatctggtataaataatctcaagaaggaggttgagctgcatttcctttattatattttaaaataatctttaaaacacatattttgccaaggtttcagataggaagctttaatcatttattcacccatcaggaattgtccagaatgaatttgcatttccttttgttgcacactatgataatttattattcttttgaatagcatggtatcctaaatgccagaaaagatgtgtgatgggaaactaaataaaccatatcagaatttaagcaagttttctggatagatattcctttatggttgatatattaatgtgctttagctacaggcataccttgttttactgggtcttgctttattgtgcttcacagagactgtttttcacaaattgaaggctgtagcaaccctgaatggagctgttcttccaatagcctgtgctcacttcgtgtctctgtgtcacattttggtaactctcacaatgtttcaaactttcttattattactttatctgttacatgatttgtggttagtgatctttgatgttactattgtaatagttttagagtgccgtgaactgtgcccccatcagacagcaaacttaattaatgtgtgtgttctgactgcttcatgctattcccccttctttccctctcctcaggcttccccattctctgagacaacagtattgaaattaggccaattaataaccctacacgggagggcctctaagtgtacaaat

SEQ ID NO: 133546 - DNA, 1774 bp, Homo sapiens
agtctgttttgttttgttttattcctgtatccaaaattcctttgtctttaggtatttctcacatcattttgatcatacatatatgttgggaaaaatcaagatgaataatctccgtttactctgggaacaaggagtatcttcttccctctactgtggctaagtatggaaaagcttaattgtaaatcagcattcaaagacaaccaaacatttatttatgtcagtaggaaagaggaaggtgtgtgagagagagaaggaggaggaggaagaagaggaggggagggagagagaagagaaataaaatgtaaagcaggcagctggcaaggcttgctctgacacactggctgaggaaagagctattggtagaacttggatgtcttagtaatcagagtaatcaggttctctgaccggttccaccttgttctgtgcaggctgaaagtaagctctctagagaaagtaattttctttctctgctccttctgacatcccacttttccctcccatccttcctttctattttccctgcctctcccctctggtagaactgagtataaccgtggtaacattggttacagtgttttctagacttgagaactgaaatgatttgaccttgtacaagtaactggatgtctggcacaatgatcgtcattctcaaccttgataatttatctctctcgatcactgttaacattggagcagtatttaaacacaataactagagcccagaatatgcatgtaggcgaataggcacctatctaggatttctcttaaagatatacctctagagagctcacatggtaggaggaaaaagagggtgctcttttttttctttaaccattgtaaaaatgcttcagtaaaatatagcttgagctctggggatagactggaatagtaccatgaaatgtgggtataccgtgattctcttcaagaaggactttgttctgcttattcccacatgagcaccacaaacagtagccccatgtatcttgttaggacaaataaatgggacacttgagaatatccagttaactgagccgcacattgggtactttaaagcacacttaacatgcagtaaaatagcataaatatgagttcaaaacacaaaccaagttgacattgcttgtggtatcatcattagtagaatcattgctttggttaaactccctgggggaagcagtggaagggaggtatgggggttgtgaaaagagattcaatattgacactttcacattgtttaagatgatacaaattaactactctgttatagacagtatccttttctcactggagtaagtaggatgggcagagcttttaaaaacagcaagtcttagttttaatcagtcctttaggaacctgatagatggcctactaattcgattcttataatgttatcaactttgttttattgctttattaagcagtagtagttgttttttttttttttttttttttttttttttttttttttaacaagcacttgaactgaaataaagcttaggcatgtggtttaccaacttgctagctatactgacgatacctttggtctaaatctttaagctttattccagtcaggcttttttttttttttaagaatacctaagattagtgtgtgtgtgttttttttttttttttaaatactttttaagttctagggtgcatgtgcacaacgtgcaggtttgttacataggtatatatgtgccatgtggtttgctgcagccatcaactcgtcatttacattaggtatttctcctaatgctatccctcccccagtccccca

SEQ ID NO: 133547 - DNA, 1582 bp, Homo sapiens
tttttgtctttacatttttctgagatattttatccaaaccaaggttttctttagcagggatggtgatcatttttattttatttatttttttgttggagaatggtgtaaaggtgggtaattttgagagagaggaaatagaatggtagtgagttgagggtaggaaaatacatctgcaacttttattgttttttaaatgagcatcttgatagggaagatagaatggaattgtcaaaaattgttaatgtgtttgacaaagtgtggctgtcagtatgatctttttgttacattttgacatgaacaattgtccttttattggggctgttaatgctattttagaatatcatgagcatctgaaggcaatagtttagcagtgtccataaagcatcaaataccattataatatctagtaaccctaacagcaatatttcagaatccctgcctgtttaaatgggctatctgtgaatgtacttgctcagggatgcatgacccacatcacctataaatttgattggaagctaacagtactggcgtagcctgatggatagcagattagagccctgattaaccatgtgattcaaagactgggaatatattgtctaagcaagattcatcagatgcaatcagaatttcaagtggtcagatgaaattcaaatgtgtgttgtggcttttcctcccctattgcttttcctcctaggttgcctttttttccttctttccccaaagctgaaaaatacttctttgatgaatctgctccttaccctaaagctgtctgtctgttattcatcagaaagcaggtcgcagttcagtgagcagaagaaaagattttaatagaagctgtgccaagggctgtaatgcatcattttagggccctaattacattacaatgacaaatatcaatggtgacaacagcaataacctacatcctttaatggctgtgctggaaaaggagtttgggccccacgccattatattagactcagtttcaaaacataggccattagaagtgtgtgtccacagtgttattggctgatcgctaaagcccagtggaaaggcctgtaaataaatgatgcctccctaaagctgggtcctgtgggacaaaagaggcgaaattagatgaccatgggagcagcagtgtttccgaggcaactttagatttcaaagtgaagaatgacctgcttaattttatgaaatcacacacacaccccacccccccactgccaattagcctgaccatgaaaatccattggcatgacaacttaaagaaattaagaagtcttttaaacaaaaggagatctttaacggaagtttggaaggtttctgccctcccgtttctgttgtgtgtgtgttaacctatgtgattgaataaaaaggctcttctcctttttacatttatttttaagaaaatgtagaatttttttaaaaaatagttgctcagacttaatacagcctaggtccaaaattttatttcaccagatgaataagtttccttagagtcgtttttattgcctagattatgtaggcgaactaaagaactcagttttcttatgtgcccacacatttttcagccctcctagcaagggac

SEQ ID NO: 133548 - DNA, 1044 bp, Homo sapiens
atggttctaagcattagaatcatcagtttggtctgccccaaagtgtctcattatcttttattctctccccctccacctctccctgcaaaaagcttaacaaccaaatgcatttgagatgctgtactttcagcctggtgaatgctactctatttttattgctcaccctggaatttcaccccataaccactgtggtatgttcgtccaggtggagagtggtttggtgattcccattgcagctcttcatggtggcttaagcattcttaaaggatggctaaatgctccatggggccagtgcagtaaattaaatcaggtcagcacagttgggtccttattcactgcagcttattggtgctgggtttttgtccatactgttaggaatgcaggctggaatggaaagcttggatttgaaacttcatggtgaatttgtgttttcttttggctggtaaagtttttaaggtgctggcatttaaaagattgcatagctacacagttagaagggttgctgatgaaagaaggaagcctagattgcacaagtagagtgtcactgtcattctggtaatgacttggcaagaaaaggcattttgggcctcacataaaatgaggaactgaccctggatggaatttaagaatgtcttagggatagtaattgctttacattttctgcctttcaattcttcttagctctctttcctccattccatcattaaaatataaactattttgtatgtacgtgtattaaaaaaaactgtgtatttatacatcacaaaatatacaaggcaccatctgaaaaatacaaattaagataaacattggtaaaactgtgagtaactttttaaagaaaacatgtagtggtggtttttcttttaacttactgtagcatcttattggtttaaaatgtctgtacttataaaaattattagagaatagactgttctttgacattgttgggacttttgcatatccacagtaaaaaaaaaaaaaaaaaaaaaaagttcccaaggatagtttccagatacatacagattgcttcctgctaagtgtaat

SEQ ID NO: 133549 - DNA, 1046 bp, Homo sapiens
cttaggaaatatgccagccaaattataaagtatgttttaatatcatcctgttaatatttggggaatctgtaaccagctgactgttctctttattgctttcctttcccttattttttgcaggcagagattgtcaagaggctgaatgctatctgtgcacaagtcattcctttcctgtcccaagaggtaaggtagttgattttaggcactggactagaagttgccattttagtggttttgcagaaaagggattgtagaactgactctctggccttgccagtctcttggtgtttgtattttattttcatttctaagaaacagtgttctcactccaacttgtataccttagtaactttctgtgggatataatttatatgtgtttacataatggaatattttctagttgggctaagcaaaattcagtcgttaaaatattttgctatctttgtcgtgttgctcagaattatgcttgtttgtcataatggtacctaatagggtagactgaaaaattgccaggaaaacaggagcttactctgtactattgtcattgggcattaagaattggcagaagacatatcaaatggaaagactttttgtagtaaacaaactaatgaagcttttggctagctacttttaaacatttacttcttgtttcctgattaagtctttatattattgtgcttttgggaaaagacctgcaagatgaactcattgaactcgtttctctgagtgccacttttctcaaaattaggctttggtgatggtaggcttagcacattgctaaggcctggcatgcggctcactagttctcttgctcacctacaggggaagtgcatgccatcagcaaacaggcacaggttggaataaagcgatgcatttctagtgcttgttggcttccttgtggtttttttttctctccctgcttacttttggtagttacaaagttgaagtgagaatactggaaaaagataattttttgcttctggattactgaatgccttcatttgctcaggtaagatccactctaagaaggaaggagctaatgaaat

SEQ ID NO: 133550 - DNA, 1987 bp, Homo sapiens
gagaggttcattcacctgcttgccagcgggcatgtgccaatgttatgtggccaatatttgagcctgcatgtgtattatagatatgcagattgctgtatatgatttttttctttggtctggactgggttagacttgagtaactatgggtacccttcataggtatatactggggagggggcactcatattcacaaatcttgttgacactctgaattcacatgctcttttgggtcttgataaacaaagggtatgttgtcttttctcctcctttagctgtgaccacaaaacctaccaccagtcatgtccccatttgcctgtttttacttaggatttgcttatggctagattagatggcttggtgaatgagagtcaaggggtgtatctgcatttcttttggaaacctgactgccccctgcctgatccagactagtgtgtattttttactttaagcagctctgctttatggagatggagaatgggaagaatgtgtgacctacagagctgtaaccaggctggggtgtcatgttctaaggtgacagggaaaagttcgaattatccctggggtggtattagactttgggcctctgtaggcacagacccctgtatatgatcgctggtatggctttggtctcatcacatttctgcaggatctgtgggttgtgttcagaagtagaaggttgtcttggggatgttgatgaagctgatttgccaatgagttgttttcccacatgaattatgttgtttgtgtgagcaggcccagtgggaacagaatgtataatggtagtggtgctgagcaagactggactgaaattaattgtctaaggaagttgtacctgtaggtgaaagccatggggagatactgacaactcatttgctctagtctgggaagaaaggtgtcatacttaactgttgtcataccacttaactatttatttcccaaatactttgacatttcttggttgaaatccttgactcacgtataatgatttatgccaagcttgtgcaaccccagggcctgtgggccacatgtggcccaggatagctttgaaagtggcccaacacaaattttaaactttcttaaaacagtatgagatttttctttgcaattttttttaagctcatcagttatcgttagtgtattttatgtgtagcccacataaaatgggatgtgtgtgtgatttcttcttccagtgtggcccagggaagccaaaagattggacacccgtgatctatgccatggttttctaaatgctagttctgtgtatatattttcttttgcttactttagatttaatttactcatctttttctagtttcctaaggtatgtgtgtatcttttattgtgtgagacacaaacatgtttgtttccttcaaatcagggcatctctgatgttttttatctgaacatcgtccaccttgtttcttcttctgtgcattctgtgagcattggactccttgcttctgccctgaagccagatggaccataatctggagggaggggaggagcaggttagtagaggaagatgaattctgtttcctgtctcttcagaggcatggaaaatcactcttgcatggctgtgagcatcactgtgccaggactgaaggctcttaatctgatcttttaacaccggctctctgtgtgacagtctcgctaccaaaacggcagctgctgcattagaatttattttaaaatgtttttatttaaaaattaaatgatcgtatttaggaaaaagcaaaacaattcctgaagagtagtgcataagctaacagaacattggctggagcgattgtgagcatctgaagtcaggctttttggagtttgacaggaacaaggggtatatttacatactgttagatgaagtctctttttaatttagcccccatgtgttgattaatatacctgcttaatattgcttgcgtctggtttaccgcatttttttaaacttaaaaaaactatatagtactgaatgataactattaaatttagc

SEQ ID NO: 133551 - DNA, 2065 bp, Homo sapiens
ctctagctttgactatgtaattagcacatctcatgtttttcagttacataagatataaaataatgcatagttcttgttatagaagtctcttccttaccattcgaatgttggagaagagtcacccatcaggtattatttatcattcatacattcataggggatggaaaagaacctacatgaacagtatggcctctgtgggctgtctatatttgtgtttcttatgaccagtggcttcctaattctcatttattaaactcatggtcattgttacctttagagaaatggcattcatttttaaccttgttattagcagacttgtttctagtcactgggtgccaaggaggatggacattttcctccttctacactcctgtaattccatgactgttttttttggtggtggtggttgttttttgagtcgaaacagaagccgagctgctcagaggctgatggaggagccctgcaggctagtcctcacagcaatgatgaggagcacacctgggggcctgcacttgcacatgaacggagctgtttttcccttgcatcagttattttaagaaaatattggtttaacaaatgaaataaagaagacgttattctttttacaatatttaacaatagttctctgatcattagaatattgagaatataaaagggaaattaggacctaaaaatggaaaccttccatttttatacttattttacctggggaaaagggaacttccataccaacctgaatgctttctggtgcaaatttaattttaacttaaaacttggtttgtattgccctgttagcttttctaacacgtagtaccaagtagtgtttgggcactctccattgcatttatttggtagaaaataatagtcaattacataatagtgataatatgagtttatttgaattataaatccaacaggctagaaaagctagtcacatcaaacgatacataaactcctgttttggacatgccataaatttggtccatgtaatttgatggaaaacaaaccccttctactacattgtgatatatgagtatatctcagatgctgtttacttgggcatctcggttaatatggtactgaattacttggagccacattttgcatgtatagaataattgtgaaatgaaagttgaaaaatgtgatcagtcactttcatattgtgccttcgggaggaaatgaagaaaatacagtggttatatgcactggtggaagtgttatcgccttacagtcgtgccaggttaacttgtcttattgcttgttaactttgcgaggaatcaatggcttgtgataacaggtttgatataggagagcatggttaaaattgcagagatcccctggcaagtatgcagtgacatccctaagaccatcttcagaaagtgcttgtgttaagtgccagcagcctgcacagggcacgtctgcttcccagttggagccattttgtcagtcttggtaatatgttatgacagtgccatatatcggaagaatgtcctaaaatgaataatagacatggattggggcttctggggatttggcccagttttctgattttcacattaggttgtgggcatgggtaacttttcatttaaaaaatatatattttctcataatactgaatgagccatcagagagcgtaattctgtcccatattccgtggttgactgattggcttgctgtacctgaccatgtattttggtgacagttggctgcttggtgagattcatctggtggcatcatggcctgtttgacctcaagaagtgaaagatgattctcaggaggtagaacttttttcctgtggtttaaatgtgggtctctatccaaaggcagcaatgccaacctttatctgtatgtctcaacaaattaatgagtgtttgagaactgactcatttatttgacttttagttaggtagtgattagattattattagtggagctaagtttgaaggtaccttgagtagagctgcattgtccaatacagtagtagctatgtaaagttgaataaaattaaaagttcagtttcttagttactctagctacatttcaagtgctcagtatccactcatat

SEQ ID NO: 133552 - DNA, 1125 bp, Homo sapiens
acctgtgtttgtgtacgtgtatgtatgtgtctaagtaatatctaaagtaatatctaatttcttgggtgactgtgttgggctgttcttgcattgctataaagaaatacctgagactgggtaatttataaagaaaaggctttattggctcatggttctgtaggctgcacaagcatggcaccaacattacttggcttctggggaggactcagggagctttttttactcatgatggaaggcgaagtggtgaaagcagaaaaggagagagagattgagggggaggtgtcatacactttttaagggccagatattgtgagaactcactctctgttgcgaagacaacatcaggccatgaaggattcacccccatgacccagacacctcccaccaggccccacctccagcattgggaattacaattcaatgtgagattggagttgggacaaatatgcaaactgtatcagattaatgtttctttgaatactgtataggaaaggctgatttggggagattgggttaaatttaagttgatttgtactagcaaatttaatagagttgctgaaaaaggcttttagtgggattttttatcctgacttagcagacatggagcgacactttcacttgaatttgatctgcttggccatacctggagtaatgtgcactacaaggagactagccagaaggatggatgagtgggctagagcccatgacacagagaaattgttgagtgaccttaggatggttaacctagaagagataaaattgagaacatgcattatgcattgtcatatacttggagtgtcagtcaatggaggagaatttaaagacaaaactgggtccagtggggaagaattaatggcagggtagatttcaacttagtattagggctcattatcccaaaatggaaaaagcttgtccatgaggtagtgaattgcctttcacaggaggtgatcaaggagagactggttagggtgtgacagaggagattgattcattggatagagtagtggcctttgggctgtggttggtactgtagttccgccatcccaatctgctcagccccggcagtgtttagaaatttgcgtgcttttggtgatagggagagtcttttgttgattggttggttgg

SEQ ID NO: 133553 - DNA, 1103 bp, Homo sapiens
agaactgatagcacatagctgcttaaaattttttaataacatctcatttcctaccaggataaagtccaacttttttgcatgtcatgcaaagccctttgctgtttggcctcctcctgtcttgccagaattcatttcccactaatacttggttctttaaagcatttccatgctacactcatgtcttcatccattttcctttatttttctttgtgtgcacaccctttccactttaaagtgttcttgcttatgtgtcttatcatacccaagaaggccctatgaaattctactctgcttgtctgcagctgtgtcccctacctgctctccctcttccagccacacagacattcttgctcttcctataaggcccctacccagttctcttccctttgcctggaattcttttatcctcattcttcatctacagaattcctggaaatccttcaggtctcagttgtcaggtcagcttcctaagggaatcttcccctagccccaatattagattaagatatttccctgataaatgattgggtagcatcctgtaatttttcttatggaaattatcctccagttgtaattatagagccttttgagcattaattcactgactgttttccttgatagagtttaaattctatgagatcaaagactatggttcttgttccttactctaaccttagtatctccctaccacagtgcctggtgccatagtaggtgcttaataaatatttgaatgaatggatgaaaaaaacaaagccttcccagatgccgcgggaagtgcgctggccatttcctcctaaaacttctttctgttttatatcctgtattcctctaagatgtgctctgtgtatgagttcatcacgtgagaagcagggccattggtcttactttcacctctccacatgttggagactttaattaatattgttcattatgagaatcctagtttattttgtttcattttatatctatctctacccttatactcttttactaccccagtcaatatggggagtactttttaaatgtttttttaaaattttaatttataaaattttgaagcatactttagagagagaatatactgaacctacaggtacccatac

SEQ ID NO: 133554 - DNA, 2287 bp, Homo sapiens
ctcatgataggggttaaaacaccaacaatttgcacatttccagaagaaatatgtatgttgcattatgtatgtccttccggtgtcttcgctaaccgttatcgggagaaaatttaaaaataattacttccaggaaacaatttttaaaaattttaatgtagatagcaaagagaaaaggtagtgagtacaaagaaagcaagtgggatgggttctgttttgtttgttagtactaatagcagatgggtggtccaagtgtaccataacttttaagtgaaatttaagctgttgtaaaggagcattcttcatggggtcacagagatggtacctgcagttggatgcccagtgactcctcaactttgtggacccagatgtaccctagacatctagtcatccatcacctcaggcttgtattggaaacctggagatcccccaaatgctgttttgcatgtaactgaagttagaggacatgttaggaaaagctgttcttgactgagtagaaaacaaataattgtattctgtttctgatcttcatttatagcaccagcaacaagtggtgcaggctgtggaacgggccaagcaggtgaccatggcagaactgaacgccatcattggggtacgtggcctttccattttagctctgatcttagtgtttgtcatcagctctctcgctctctctttttacattttgttccgccaaaggggcaaaaagcaatagatgactacaaaatgaaattaagcactttgccttcaatctcctgtgaaatttgatggctgccttagaaactttggatcacattctcaccaatttaagtggatgtgttcatgaaaactctcctctaaggagactggatagctctttttcatatttctttgctttgcaatcagcttgtgttgctaacctaggccaaaaaaaaaaagagatatagattgccctgacgttaaaatgacctggtttcttttttctttccttgaataatcatgtagagtatcttactatcatttttaatgaggtgtacattttcacatctcccgttctacttattcttccttcccctgtcatgagtggctcttatgggttagtgtccatttgaaatagaaataatagatgaactacactttatttttaaaaaaatcagtggcccatttagaaaatccttcctggcaatagtggcattaatgttgcatagaaattgtgctggaattcatggatttgggcagtcacttcaactctgcttatatatgtatgttttttttttctcagattaatgtaacaggcaataaaataatgtgctgaaacttagaaataacaataaaggcaagaaatcacagctgtaaagagcataatattcacctctctatttatgcagattgtacaagcagttccttgggttattctaatgaagacactacaactgcactttcctctttctgtcccctcccaaatactttcttttgtgtatagattatacacaaaagtcttttttttttctgtcagtgtatcaaacacactttgaaatgctaattatttcgtttactttcattaaaattcaaattgctgagtgaagatgtggataagggtcgcctgataatcaatctgaagtgaagatattgcttcaattattcctctgtcttttaacaaggaaatcagaactctgggatcactgctgatgttgagggcgccatagtctgattgtagcttgttttttaatggggtatttggagctctattttatgtccctctgaccaaaaaaaaaaccaaaaaaacaaaaaaaacctggtaggaaattagcagatgtaatgaatggaaaagagtgacctttatttcctccagagtgccccttggaaacaagaggctgaatcagaagaagccatgtagaatcatgaataatgtttgtcatacattttgtgtgatgggcaggggaagggacggatagtagagacgaatacatttcgcaattggttttcgtttccaaaaactccaggaaacagcagtatattaaatttttaaaagttgagaaaggtttaattttaaagttaagtgtgtgtgtgtgtgtgtgtgtgtgtgtgtgtgtgtatatgtataaaccagctgtgctccattgacgtgtgtgcacaagtgcaggtgttgtattcactgtggatatttttgttaccaaatcttccaggggtcagaagggatagaacctacatttctctactgtctctactgtttaccatggagagaatgtgcagagtgatccctgataggagaggttgctgggtcatttttagcttagcgtttactgtttgt

SEQ ID NO: 133555 - DNA, 2597 bp, Homo sapiens
ttctaggaaaacagaatggattattattatttttttttcctttttttgagtcttttaatgactgtacagtggagagattaagctaaataaaaaacactttgtttatgtgttggatgttgcttaatatgagggaagatataaaatcagaacaagttcccttcacttcacatcaagaatatttttaatattgttttatatttattcatttttatatactttatttggaatggaatggccgattgccttttcttggggaaatgaggatttattagactgcagccaagttactgacatattgtgtttatatgtatttaattattaaaataaagctaacttaattttgtgacctaaaaacttaaagaactaactcagcagtacattctgtcaaagcagcgttacgtgctatcaacgcggcatatacttggatatagttggatatagttggatctgatgagtcttccaaactcttggtatctgagcagaaaatggagtcggaaatcacattatctgactattctggaaaatagattgcagaaataggaaaacaaacccaacagttttagagaaccacaaaccaagtgagaaggaaagagctcagttacaaactcacttgacaaatttttgctgctgaggttctctttgtctttttagccatggtagtgcttgcatccagtagtttttgcagttgtaacattgtagtattttaaaggcacttgctgttctctgtcccttgagcgtagatggctggctgagttggtggtattttgacacgctaccaaaaacaactaggggtcagtttttagatttttgttacttggtttttagaatgtagtcagcagtgattttctgcactgaaggaatgacagttttcctttgagaggcaaagacccatctaagcccctgcagaccctcatttatttatcactacatatgtgtctattttatatgtatgcacaccatccagacaagagcaaatgttcccagatttaatgaaatctgatgaagcacctttttaactctgcaatattattctaccttcattggtaaatgagccaaacgagtgatccatgcagtttaaatgcaaaatgctgaagtgatcccgtaatctggagaggcggctgttctcttgacaataagctggttgtgtttaatggaatgaaacacagttataatgatttctttcacaggtcatgttcagtttaaaactgttgatagattgaaataagttaaatatcatttatcttttatttataaggaagaaaaccaggaaaattcctgtgttggtttcccatcgttgatattttgtgttttgttttgaattggtgatattacacatttccttcaggccttccccaagttccctcagttgggctaggggaacgttatggatctagtttgattttgtcatgtgtcctgctagccactgtgtttttaaattagaatctctgcgagatcacactgttggaacaacacacaaattgtagttttaaatcagtaatatgatctaattagaaatgatgttttcatttcctgtattattaaattgagtcacctgactatcttaaaatgctttttaaatctattacactatataatcagtacatgctgtgtgaatgtggttatgcttaataaaggaggctgacttggaacctcataagaatttcaccaaagaaactaccattaagaaaaaaagtttagtcagtgtgaatagtggaaaagaaaatgtttggcttataaaaatagacgatgtgggttcctttggaaaccccctaacccactttttaaacctaattctgaggaaaaaaaaatgatagaaatgtatgcgtttggaaaaaagctcacccccatccccaataaacccttaggaaacaggtatgccatggtgttgtaggaattgcagtttagcacaagaaatgctgaacctcaatttttagcagtgacattttaatgataggaagtctgcaaaattatttgccatcaattgtgaaggcaataacaagccttggtggtttttcacactctctgtgttaagtgctttcagaatgacagcgtaaactgtgttagagaactccaaggaagtaaaactgattaaaatgttcatgcttgaatggtgctgatggaatagttcatttggactttctctacctcctgcagctcaagctgaaatattaaaattcagtggatttaaatctctttcctctcagctcaggaaaaaaacattacattttaataggttttaaacccataattcattggattggagcagcactattaaatctatttaaatattacttgtattactaaggaaatgatttaaatgactttgcctttaccatcctatgtgtttgagttagtttaaaaaaagaaagacaatacctttgcggtcccccccttagtattttgttttcttgtccttgtcatatgattgaaccttaaatgtgtgtgtgtgtgtgtgtgtgtgtgtgtgtgtgtgtgtgtgtgtgttttctacattgacaacgtggtaagagggtcttgcagtatgactgtttaaaaatgtatgtctcttcttttccgttatagatttcaaaactgccattttaactttcaaaggcatt

SEQ ID NO: 133556 - DNA, 1149 bp, Homo sapiens
caatcctctcacctccaaaactgggactagccagcaatgctacaatttttctttctgtttggagctgagccatcctttcctttcccccagtgaatgcacttccatcgctgtagagttgagttcaaagtgttataagagttgcagaatgtgtctgggtagatgtatctgaggaagggatatgggcattggcttccactgagaagaaagtagttctcccagatccacagagctcggcaggctgagcttatgcagaggtctgaggaatggttatatagaaaaacaggctaaaacagagaataaggcaacctgcaagcttgcagttccagagtgttaccccattttataggttgttttgttttggttttgtgtcacttttgtaattctctgatgatttcctgccagcagtgtttccacaagcagcatcaccaacttccgtatagtcagagacctttttccttgtggtgtcagactgctttgtacccctcgaagctgagagggagggaagaagcatgggctataagagacagtctcacaccaaacaggcaactaaagggttattgacagtggttaactgtcaagcacttaggtgaggtttttaaggacttttgttgcctgttctcaaagctccctaagaaaccagtttgggaatccttctaccccaaaatgcatgtgtggtcttaagtgttgtccttaagacctttgtgaaaaggttagaactctttagtgaatagcaagagttatttaatgattatgtccattcattcattcagtaaatatttgagtactttcaccaatatcctattaaaggggcatattttattttcattttgagtgatattttaaattgtcttctgaaatatattctgaaatgatcctcaagttacatttaaatcattctattaaaattttggtagctgtcagcttgctggtattacattgtacttacaaataatcaacttttaattaacgcattttaatttcaataaagctagtttccatggataacagagtaaagagaaatagttaataaaaaacataagaatgaagcagcatacatttacggatttgtatttttttatatttgcagatacattttcagatatttggattaggaatttagaaattcattattgatattctctattacat

SEQ ID NO: 133557 - DNA, 1689 bp, Homo sapiens
ccctgggtcactccaagtgtgttctcgactgagggtttgtgcaccagcttctctgtcctctggatagcccatcctctggatcctagagtggtcttccttatgcctcttttcagagtgtcagctcagatgttatttcctgaggaaggactttcttggctggcactctttttactctttgcttctaattcattctctgtcccattaacctgttttattgtcgtcattgcacttaccattgatttgttatgcatcactttcccttgactagctagtgaaatctcattcacttttgtagccatgaagcctagagcgataggtatctcataattttcaatacgtatttgtatgataaatattcagtaactatttgttcaataaatttgcagtaatttgttcataataattttccatagatgtttgttaaatactatgctctgggatattttctcatttggatattctccgtacaattttgagccaagatagaaaaggaagcgcatggactggtagaaaatatacagttctgggtttcacttatagtatgatattaggaatttcatttaggttttttcatctgtagaatgcaaggctggagctggcctatttattttgacgttaatggaatttttattttaaaacttggggtccttttgtgtcatagttatttttctaggtttatcacctccctaggcttgtattcttttcctgaaaaaggtaactaaatatagtagatgttattgaatattcgctctgtgttaagcatttacatgcattactttgtttaatcttcacatcaacctcatgtggaaggaaatactgttccagctttacaaataatgaaaccaagggctttgaagaggtaagtcattttctgaaggccacacaaaagaggagtggcaggactgggatccaaactccagctgacttcagaactcacacatttaaccattatgctacacttgtctcttatttgttctcttgactctgttctttctttcacactgtcatcaataatctctttatcttgagatccactgataggattgtccagccagagctcagtgttggaaggaaaatggaaactgggtatgctgggtccacatactaagtggttagtctaaattgtctgaattatattagttccacaggtcagttggatactcttgactcatacgttgttgcttcctgtctgttgtatcttactcttatgaacaagaactgaaagttgttataaacacagctgttaaggcaggtgttttaacccagtgtccttggatcttctggaatttcatgcttgggcattgggctgtcaattaaatgcctgaattgcttgcagaattgcctgtgtgtgtgtgtgtgtgtttggggttggtaggagaggagtatgtatagtttttggaggagagtgttcacaaagggtcctgtgacacaaacaagtttgaatccatgccttagtagaataggattgtgcaaaatcctgatatgaaatagcaaaatatcatgtggggtgcatgtagacaaaaaatatttgcccgtagcagcgtggggacacattctaggatggttgttcagaaacttggaaatcaggagtttacttttgtaggagggtttcttgattaagaactattgttggtactctagttgcaggcagcagtaggtgaggcaggggacatgactggtggtgaagac

SEQ ID NO: 133558 - DNA, 1023 bp, Homo sapiens
caggagatataaacaagttagaacttacagggattgccattatgttgtggggagttctatctttgaaattacttcattgctttgtgataagctctatacttctctgcttctatttctctatcttgagaaaaccttgtatgcctgacttgtgaataacaattatttcatgagatagagtaatattgcaaacttaaaaaaatggttttgactaaatagttagagctaactgtgcctttgaccccaacctcttaagaaaaactcagaatggtacattcttgaatcctttttaaggcagctctatagctagtctgacccttgtgattctcatgcttttttttttttcttggtagattcataaaaatggtgagagtttatctttgctcagattgttttctgtgaccatcaagggcagtgccactatggtcccgaagcaaagtggcagtaatgttgctttttttctttatttccctagagtgtttctgggttgactcaaagcaatttgtagacacagctctgcacaaattaatatctgggagaagaaacagttgagaggaaaaaacagtttaagttgagatctacttggattgaaagctcagaggttgttcttgggtttctttcagctaatagcttcagaatggcctctgagcaaagatagatgtcgaggcaggctttgttgtttgttggttctcccttgcaggcagaggctaccctctgctatcaaggctaaagcattccaggagctctttgcaggcttccttacagaagaactgtgggcaagtgaccctatccaggtcagcgagatataaaaagatgtggttttcttcttaacagaaacccatggagagagaattatcctcccttctgcattttaatatggttatgtgaaggcatgaggtaatgtgtggagctgtggcagccatcttgtgatgggaggggatgggatttgagggatgccacatgaatcagggacccagagccctgataatgttaggtcatctatccatccctggacttgtagtgtga

SEQ ID NO: 133559 - DNA, 2705 bp, Homo sapiens
tgctttggttgttacttgccatccccttaagaccagtccagagatttggaggactacagagatctgtggtttgtttagcttgagaagcttatcctttcagtgataatcttacttggattgctctaaatgcatgtcttctccctatagtaaatctcatgttgtaagtcatcaggaatgagttacagataagcttagtttgaaaagtttcttcctttgttctctttattcttgcttctttccatatattcacttaacctttagctttttctagagatatttgttaaagtaaggtaagaagggcacatcttattttcccagcctctacaactacagagaaattgaatgaatagtagagcaaacactgtatactcgtcacctagatttaccggttaacgtatcgtcacttttgttttctgtctctgtttatatactcatacaaatacatgtgcactttttggaatgtgctgaactaattgaaagtaaaaggcaatcatgctgtttcaccccctaatatttcagtgtgcttcttctatgaacaaggacatcttcctgtataagcataataccattaacacattcctataccagtgtgacagctcataatcatatttctccaattgtccacaaaatgtccttaatagcacttttttattcaatccaggattcaattcaaaaattgtctttgctgtcatgtctttttactcttctttaaatcacagtgtccgaaagcattttgctttttaagatattggcattttgaagattccaggccagttttctggaatcttccacagtctacatttgtctgtttgtttctgattgttttctcaagtttagatttcggttaagtgtttttagtaggaatactaactaggtgatgtgtatttccagttgtatcatattactggtgaagctaggtgatccatggggtgatacctgggcactatgaataacctgtttccctgcaactttttacccagtggttgtaatatcgatggttgagtctgtcttgcattagttaatacatttgacatggtaaaacagtaaattttaagttatttctttcctttcaaattaatattctgtaaagaagagcttttcctgttttctcctctcctcgctccctcactctctgtgcatatgaaaatgtgggcttctggtacctttccttaatactagcagtcaccatttattgagtgtttattatttgccaaacactgtgtgatatggtttggctgtgtccccacccaaatctcatcttgaattatagttcctacaatccccatatgtggtgggagggatctcgtgggaggtaatttaatcaggggcaattttccccatgctattcttgtgatactaagttctcacaagatctgatggttttatgaggggcttcccccttcactcggctctcatgcttctgcttcctgctgccacgtgaagaagggcatgtttgcttccccttccaccatgattttaagcttcctgaggcctccccagccgtgcttaactgtgagtcaatcaaacctctttcctttataaattacccagtcttgggtatgtctatattagcagcatgagaacggactaatacgctgtgctaagggttttatatggatcatgtcatacaattcttccagcaaccttgggaggtagattttgtaactaactgttctcgctttttacatgaagaaacagagcatcagaaatgttaaatgacttgttcaaacaggtaataaggattccagtgactctgaggccacttcattgtgatgcttcccaaatgtcagccagactgtgctttctcacacctagcccgacttacagacaggagcgaggccagcagaacaactgtccatagtaaatagtgtcttcacaagccaaggagtatggctaccagcccagtcctgggcccttccctgtgcttgctgctctatttcagagtctgttgcctcttcctttttggctcctttcaaggtctgctgagtcttcccttacttctctcctagaatggaacagtgtctcctggttggattgaggcacacgtgctcagagcgagcagctcacagcttggctagctcctggtggatgagtagtatggttgtgggcttgggagacagccagccttgaacttaggagctggcactggcctgagagtcattatctgtctctagtccttggccccagagtgccctacatcttcacctattttcttggggtaccaaaaactccattcctgaaaatgttttttgaaaatgtgttataacctataaagtcattattcttaatgatgctgagattgtctcaagttttgccagtggggatcccttcaatttggctcattgtccttttgacacaatatccgttagtctagatagctttcttgatttctggcacaagatatagcaggttcaccttgcacttgcactttttttagaaaccaaaatatgagcacaaagtgtgctcattgctactgagatgttgttgtttctaaggaaggtgcgtgttttttgagaattattctgctgttgatagcgtagtagagttggagtgggggtgaacaaggaaactgctgcctggccttcaattggaaatgcccaaaattcctagggatgtcagtgactgcagctctgtccttgctggctcctgcttggtcaatgacttgtcagtcccttgtcatcaagcagttggggacctttgattac

SEQ ID NO: 133560 - DNA, 1435 bp, Homo sapiens
attaattatcttaatggagtacttacttgcttaagtttaaagttcactccattttaatgtttattttcttgagtggcccatcaaggaaataggaagaagtagtttattttgtattgtggtttgagataagagaggtttttatttattattaattttaagtaaggcacccaaagataataaaggcctaggaaggatagtgagaagaattttgccatgatacatattttcctcaataggtcttcctcagtggtggttatgtatgtacgtttattttaatactctagtctatgccctctttaattctttggcttgatctttgttttgtttttcttctaaagcctatatatatatatattttttttaacctgctagtttataatgtatcttaaattacatccgtaacaaatctgtgttatactgtgtactcttaatgtacatttcccttccttttggtctttaaaaagcaaggggttttatgtttcttagtgggactgtaagataaagtagaatatctttgcaggttaattgctctgtaattaacccagatggggcagagggcagaggacagttttgacttaaccctgttgggaaacatcagcaagctttcactttactgtagagcaatccattagattatggtactctcagctacttgactaatatccagagaaaccttactccttttccagggaatcctgagttcctctgttgataagatgacttaatagaaatatatttttaatgaattcttgacatttgataaattaaggccatttattttagcagagaaaaaggtgaagttctacttagccattggtgacttactacttttatttaaagaagatgttttctaatatgttttattgactaacccttatcagttataaaatacctgctactctagttctaggctagttcctaaggtgaaaatttgcaaagaagcttaaaaatgaccactaagtacagaaaggggtctcatttattaatgtatacattttaaagcctactgtaatattttaatatctctgtcatatgccttttggtgacttaatttcattttatcttatagtttaatatttttaaaacacttgataaaaattgctcccttctacaggatgcctgagtataatttttctgttttgatattttgtatatgtataaaacggtgactgataaacatgaatttatggtagctgcctctcatttattcttctttaagatcaaggcatatactattaagcagtatgcctgtaggttggttgttaccattcataaaatctttgaaaggactttataattttggtataataacaaatgaaaaagcttctctaaatgcaacgttgtatgctggtttggattctgggacagaaaaatgacattagtggaacaactacagaaatctgcataaagtctctagtttggtgaatagcaatga

SEQ ID NO: 133561 - DNA, 1049 bp, Homo sapiens
atagatacatttttaaaactatcaagataatgtgtgaatatttcagggtctgcagttagctaggatttgtgagatgtagactcatagagcttagattctaagaagggaggtaagaaagatgagcatgcaggatcttaataaatgcctgctcattgacctctgatctgaggtagaaagtggctgtgtgtccaaaacatacacaaggagtattaggggaatttagaggagaaagaattggagctatttctgtttttgaaacaaatttgccatatatttacttcaagtccctattttgttttcttcatagacgttattttctgcactgttaggaaatataattttgtgtgcatactttttgatccccactgaataacagtatgtaaagaattatgaacatgattttggccacttaaatgaagagaatcaccttatctcaaaactacccagttaagaaaaccttcagcaggacttggagcgtgggtggggcttggttggtggagtatctggatgtggctcccattttccattttctgcttgtaaacttgcttttcaaagtgttcatactttattctattgactatattttaagtgcatgtagccagaacataggtacaagtcagtaagagaaaagaactaattaatactgtacttggacttttgtagtcaaacataggaagacatgtgggagtggaagaaaataaacctaatttggagaggagaaaaaaaggtccactttttttctctgaggtattaataaaagcattttgagatttttcttggtggaatgatcgatctctctctctctctctctctctctctctctctctctgtccctgtccctatctctagatattttgtgaaattttgcttggaaagaaaattatagaagggactatttggctatcacaggttaggcctggaatgtgatttctttaaaggcaaaaactaaaattcagtcactacaaaatttaacctgagaattactcaatacttgttgtcatacaatattgctaagcagggtttgagttgaagggattcctattgagtaa

SEQ ID NO: 133562 - DNA, 1147 bp, Homo sapiens
tatcttaatgctatggtacagagttgatgcatgattgtaaatactttgaaaaagtctataaggagcacagataataagaatgtccagctttggttcttctgaaattgtgtcaaaggtagattggtactttatgaatttggttgtgcagtattaataattaattttacagcacagttgacatctgtgtaatttattatttagcagagatcaagtttgataaatcagtatgattttatgtaaactaactagtacttttcttttcttcttcccaccactttatctgcttgtgttgctgctgttttgcatatagacagagactccatcaaggtaggactcaaaatttacagactaaggaatggcttaaaagggctgtaaatgatttgaatgaatctagtaaagaattctttgagatttagagaatgatttcattggttagtagtggttaactgcatttttaaaattactttcaggtgtgtggttgattttttttttttttttttaaaggtcccatttctctatcagaatcagatttgttgacccaggttgaattgcaagatctggcttgcattgctcattttattatttgccatgtgaaaaaaaaataactgcttttcttcacttaggctttggctgtaagataacaatgaaatgaattaaataaattggtttgtaaagagatacatattagtttcatatttgaggaaacagctccaacctacaaaaatatttgtttaagtgaatggtgcatttttttttttttttaccactagaaataattttctcttttaaatttaagtgaatttttttcaccaacttttctttcaaattaacattttggtatctggtataacaagttaattctctttaggttttgcatctgtcttatctgccttttgtatctctttatagacaagttgtagggaaagaggaaaagtatttaaggtctaatgatttgggtatgcttctatacctccagaatgggatgtgctaaggatacctgaagttatttagtaagcaaacaagaaaaataggctgccatggcaggaaatgagtaaggcatgaaaattaatgtgatcacttatgaaccagacacaatataaatacaccattgtaggccgggcttggtggttcatgcctgtaatcccag

SEQ ID NO: 133563 - DNA, 1525 bp, Homo sapiens
attttgccttgatttattatgggatggcatctataaatagatgttttggttgggtaccattctcaaatttgaagttgtattacgtcaggtctgggactgtcctatagttctacaaggtgagatagtttgcttatttttctgaatgtgttctgtgatgctcagagaagcagttgtagttgcttgttccatcgatcgtcctcccataagtggttcctggttaagaggggctttttatgattgtctgctgtgtgactctagatggtttttatcagccagagcgtgccagttgcctgcagctggagtcgagcttgtatgaaataatttatttatgcaagataatgctccttaacatttaacaggtaatgaacgtgacataaatttccttcttgcttttaatttttccctttcctcttctaatgtgcaaacaggcagctctggtactctaaataataagtaatttttggccatctgtcaaaaggaaatttcaatacaaatttaaattaatggtgcctgaaattttttatagctcctctaaaagcctctaatgtgcagaaaattcggaatctgctggtagtaattagtgttgcatgtaatgaggatgtgggcaatcttatacagccccagtggaacattttgatatggtagcaaaattttgatttatacaaggttgtagatgggtttgattgtgagagatactttaaaatgttttcttgacgttacagattgttaaacagggcagatttcagaatagcttataaactataaatttaaacttactgtaaagatttaagtaatttaggtactttacctttagatgccaagtaaaattcacttgttaacatgttgggccttttttttcctttgtctttctcttctgggaagttctgtggccaccaaattgcacgctgttggctttattgatctctttttctatagctcctgtagccaagttcattcctaagcctgttatttgcagacctgtatctgaagtttttcaacaaaggtggagaatgtaaatatggatctaaaggagaaaacactgtaggagcccaagaatcagtttccttgatgatgagaaactagaccagtgtgtgttgtagggctgttgaagtcaggagccatggcacctgcagccttccttgcttgtcacttggctgtccagtgactccatgtgcccaacagtaagtcccacatttgaggcctgaaaatgacaagaaacacagactgtgatccactctcacccttaatggtagggcagaaagcccaaatttatctctccaaaaagaatccaacgtaggctaagggggagtgttctcaccatcttatgtagtatcaagaaccatttctctcatccctagaaaagtcgtaagtgacaccaaggaaatgttttctgaggtgatggaatcttccattgcccaccccctctcattgagggctgaggggtaaaagtgatgggctctaaaatggtgtcagaggggacattcccttgtgctgccaggagcttcccacttgatggaggttccag

SEQ ID NO: 133564 - DNA, 1205 bp, Homo sapiens
actccctaactcataatttccttctcaaactaatcttcgatttgtcctcttatacaattccacaaagcagattaagactcttcccctcaagaagctaaaaatttaggggaagagaactttacttagttagggcatggggaatcagggataccacctaataaggaaatagaagtacttaatatatttttaaaatcatattttaaaatatgtttttaaaagcctatcttgagcaatacttatttggacagtggatttgtatttcaaatacatcatagcctgtgtttcaaggttaaagaatagaaatagaactctacctttttacggtcagcatacatttctagatatcttactcccttgattattggtaaaatccatttcattgttcatcaccaatgtatacagacaaacctagatttcattctgtcccattctcccatcataaggaaaaggcttttcctggtgtaattcaccatgaagtattcttgacaccacaaggaagcacactgaaacatttagaatatgagccattctgtaggaaggctatgccaggttctgcaacaatcctctctaccactgggtaagctgaatatcaatagacaagtcacttaacctccatggatctcaaggctgtaactcaaggcattcttccaagtatttggaatgtagctattttcttatgtgttatttagtcctgtcctagaaacaaattttgaaataaaaatcttataccataggttatgtttcagcaataaagttggccataccattagccaagtaaacacagtggttagaagtgaggaaatcatttgaggggttcggtggtagggtgataaagtatgcctttcaagcatttaacgttataactctttcaatttcccaaaataacaaaataagatggtaatttgaaattaagtgttttagcattgctattgctttttaattatttgtttacaagacttttaggtatttatttctaccatgtattttactatttacagttatcaaggaacagttaagaagttttgttctatgaatctatgatgcagtaatttgttcagtattaattgatacctgcctctaggcatgtaaactgtgtgaaacgtaacaggtgtcctaattctagaaaaatgtgtggtaattgtttgtttgtcaaacagatgaataaatatctttagggcatagctggtcctcaggtggtgagcata

SEQ ID NO: 133565 - DNA, 1178 bp, Homo sapiens
acgcttgttttgcagcaccctcctccgccgatcgctgaagcagaacaaatactaattaacaggggcggcctggttggcaggttggctttctccagctgatttggcaaaatggtttattcctttccctccataaaccatccctcttagttattagacattttcatactgatgtttagttaatttctaattttcttaattaggatgcatttcatctcttgcaaaaatattataacgtttatagttaacatttttaaaaatttagaggggcctaagatttaagttttaatagttgacgcttgaatttcaaaaacatttgtttctcaaaatgtagataattcttccaatggaattattccaaagaatcgttcaccatcttttttttgtattcttacagtaacactaaccccactctggaaaaattataaaatcactcatggggtagtttaatactcttgttcttctttcttgaattatttctgcaacactttcctctgtccaacttatgtattttgttctgtggtgatttgaagtagctcagctatcttctgggttaaaagactttctacgcgtaggacccaccactttaataagggctgtaattttggacttagagagtcatatctgattactgccatggcaactgccttgtgaaagggttgaagagaattcaggcttcatgagagagtaatagaaaggaagtttgctgaggagctgagtagtactttctgaaagagtttttgatgcttttaaataaggttgctgttaaatgaagataatacagttatttcaaaactcagtaatgctgcttagacttggcaaatcaaaacttgaaatgttagcattgaatacttagttgtttttctttgaatctaaatattgaataaaataagtcacattgctttaactttatcagattattcattatttagaaccaatccaattatttttgtatgtaataaattttactgcttaaaaacagtgtaagctgagagttctagtattgtaatgtaacataagaaattcccgctcatttgtgatagttggaattggtggttaagtaccctcctcctcccaacccctgggttcagttttgcctctagttttccttcactagaaactggagaacaacacacacatacatgtaatccgctcacgtgcggtccacctttcttccttca

SEQ ID NO: 133566 - DNA, 1602 bp, Homo sapiens
tagattttttttttttggtcacggaactggttgagcaatataaacatgggtcttcccaaaatggacccctaagagatgcaatttaatgtttctagatagaaagttgtggcagttttggggggaagggaggagtgcttgaaagctatgcataagggtgctctttataatactcagaaggttaaatgtggataaacacaaaacaaggcttcagaaaagccacactattattatgcagcgtttctcggactatagtccccgagacgcacttcataaagccaataaagcgcgcactggtggtctcccgttgccctagcaacgggccacggggcacagtgtatgtgaaatgcatgaacatctgtgaattaatcttttttagtttgttcttttcttggcactgattggaccactcgggcttgtgcctgtgacactgcgtgcagaggggtaatctggagcagtccccagggccttgccctaaagtggatagtggaatggaaagtgaagggagatttatcccggcagtgcattcagcagtgcagggatttagcctgacagcactctcagcgggatgttattagcttactttctggtgcatggggaaatgaataaaaatttttctagtaaatctgggcattattgggtttattgggttgccctgaaaaaataatctgcagagaaaattgaaataatcacttgtgtttgtaccacagttatcaggacttgaaagctgagttattccacatccttggcccagcccccgcctcagggattataaccaaaccatattggactgtcactgctctgaatgagactcctgaattggatgcgtaggctggaatctgatttgatgataaaatctgttagtaacctagtctgaccttatttagggaaattttaaactaagctggtgacatttttgcctttgggagaatagagcaaataatgactaaatacgtaagcgtccaggaacagtacttttgttagttagtcccccacccctgacctcttctgttctttccctcctcctgcctcccgctgccacttcttccctccctcttttcaaattgccatcctccttctagacttcagcatgactgtacagactgtgttcagttcctcctgtcaataccagatgttcacttgtaaactgttttgctcacccttgtcattttcaattcccttctcttttcttccttttttctctttgtgcctccctttttttttctctctccattcttccttatgggtcaaccctctttcctggggagaaatgaaagaagaatattacatatgaaatgtttcacgatggatgtagtctatttggttaattgttagggtgaaaatttcctttataacaaatgtattaaaacagaagttcgattgcattagtactgaaaggtatttaggtgggaagaactccttgtcaattctgtatatgttttcctttgattattaaaaaggcacagctatacctctgtatgtagctgagagatttttctgatttgttttttgttagacaactgactaaaaattatattaatggttcctgactttgaaacctgttggtattgacagatgaacttgcagtccaaataaaatatttaa

SEQ ID NO: 133567 - DNA, 1025 bp, Homo sapiens
ttctgagtagaataaaatatattaatggatcgttcctcttcatttctcagagcttctggtgagtcctgaattctttaaaatgtgcatataaaaccagtttatgatgatgggaggactagctctgaaggcagtcttcccaggaagctgcccgggctgatgtgcaaatgcatgcaaacatgaacctttagcaaacactgacagtaatgccagtggcaacgttctgtcgactcccaatcgggatatgggccttttactcgaattcagaaagtgttttgtaggaatcggcaaaacaattgaactacagagctaaaatatttatcatctgattttttggcacttgaataccctcacttgcttttcaggtggtttctctgttttcaaaattagtaaataattttatttgtttttttgctgctcccatttagctctgatgatattttcttctttcaagagtatttttaaaaattgccagctttctagttgttacttgaagccagcttcagaagtagaacagttaacacggattattagagacctttagaaggaagtaaaattctcaaattttatttctatgtcttggactgttatttggtttttgaaagcacaattttttatgccaagaactaaaaatctgtagacactggtggtaaaaagtagaaattccacaattacaagtggcagtgagtaaactggctagagtgagaagcaggaatgaggtggaatgagtatgaatctctgctgtttccttcatctgtgtgtgtgtgtgtgtgtgtgtgtgtgtgtgtgggtggggttttttttttttgttttttttttttttttttttttgagaaggagtctccctatgtcacccaagctgctgctggagtgcagtgtcatgatctcggctcactgcaatctctgtctcctgggttcaaacgattctcctgcctcagcctcccaagtaactgggattataggcacgtgccaccacacacctggataattttttgtttttggtattttttagtaaagatgtggtttca

SEQ ID NO: 133568 - DNA, 2705 bp, Homo sapiens
gagcaaggtaaagatagtgtggagcttcgaagtcaggattttctacacgaccccaccctcaatctggtccacatagtaaagattggatgctagtgaaaatgccaggcaagggttaggcctaaaaggattagtcatgaagattcgagattcttaaactaaagattatcactgggaactaactcgggtcatgatttctcttttcatctgcctttgttccttttatgcacttccacagttggacagctggaagtgccacagaaatatttgaagagccctatttagtagtttacgtgaaaagtcgttgaataattcacataacaaatgattagacaagcacttgtccatctgactgaattattctacatgtttgcccaagcaacaaaggagaacagcgtttcctcctacagagggtatacagtggtggtattgacccatctagttactgggtgggtttcagtcttttgttgacattgttgttaatgaaagcagcccagacgagctgtgagcagctgggctggataattgtgaaggattcatgcttgttgctgttacccccagtgtttgcagtgggttgtttgctttgacttttgttgaactgttgacaaaagcattagatacaaatgggaacaaataaagtggtgagatgccaggagggcttggcaggagtagtggttttctttctgactgaagtggaggatgtcggaacgtatctagatgggaagtggaaggtgtattcggtgtgtgtgtttagcagtttacccttccgataccaaactggaaaattttgttgcttatgtaccttggctcacagaggtgagagaatcaaggaggtcaccgtatcttgtaaccctcaaaaagccacgctctttaccatgccagtcaggtggcttgcaggccaagaatgttacaacagaaatagtttccagattccccctcctcaacttaaaacaaaattttaataatagaagtattttggactggggagatgacaggcatgacgttgaggtggggaggattaagaagaacagtatatgctaaaatagtatagctagcaaatggaagtcatctactggaacgcttttaatttgctttaaacaaaatactcttttgtatattcaaatggagagtagctcagctgttgtgaagccagaaaattaatggtatttttagtgaaatagcaaaagcatgtcaacaatgtagctgcagatgataatgctggcattttattcatgaggaattatcaatgcaggttactggacaacatagtgtgactgaaaatgattgagtgtcggagaagcccgccatccttctgctcgattatttcattttgcatttaggcttccccaggcttcatttgtgcatgtattttccctatcacaaaccaaaatataaagtctccctggcttaggattgtatgcatattttttcttcctttaaaatgtctccaaatgaaagttccccttgagtattgactcagaagctgaggagttcattttcagtgcacacatggtcagtggaggtggttaggcttcagagataggtccctctgaacagtttatctaaataggtctatggcagttgtttaaaagccagcaaaactcaccaccgtttgatagatggaaattgtcacagaatatgccttctctgacaagtagaagatttggaataagtagtgaggccagaaaaatgtttaaaaaacatgggcaagaataggcagaaactgtatttaggcaattaaaatgtcttttggaagagtgcgtttcagtgatagttgaagagttactaaaaatatatttgaatagtcaggaaaattaagctatgtctttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtgaccagtgagaagaggtcaggattttctcagaaatgggggcatgcgttacatggctgtgctccactcaaaaaagttacatgaatgctccccacgtttcagctctcagaagatattttgcttgtttcagtactagatggtcaaatggtaaaggcctagatctgaagttcatgaggaagaaacccctgaaatgacagacactgaatggggataaatgcatctatgtgattaagtagttggtagttcttccagggtttattactcaagagaggaggtagggaaatcgtgcaagtagaaaacttgaaaagactcaccttagaggggatagctaaagagtaaaatgagtaacagttaaataagaaaaaaaaaagaaagaaaaaaaaacttgagaagacaataaggcaagaagtttatcaccattaacaagccagaagaaagaaagagactacaccgacttgactcagcatgactccaaaattatgagaccctgggcaaaagcacaacaaaaggctcacaaatgaaaagaatgagttcaagagaaatttacttaggccacgtcaaaaag

SEQ ID NO: 133569 - DNA, 1306 bp, Homo sapiens
atttgaggcggttcattcttaccaaccgccagacctttgtttttagagaagtggaatcttcaccaaaggcccaagaagcctttgtggggtcagctgtgcttgagaattcttgaatctttgttactctttatcacctacctgagatgccacttttgcttgcttagctcaggtttggaatttgatttaagagggattcacatttctctgtttatcagaacttagcatcaattgtgtttctttgtagagatgtatgttacttaaaagataagggaaaggagcatgtgtttctgtagctcagaaaaccctaagaggaaggaccagataaagtggaaactttctacagcgacaattagagttatgttaaagaaacaagtgcaagtgagggcaggtggagcatagaaaactctcagcacagggactcaattaaaaatgcttttaaaatgtaattccaatcaatgtggatagtcttagaacattgcaagatgtgtgaaaacatgctttaaatgccagcaaccagtgaaaagggcacggttttagaaaccctgctataaattatgtgcctttggctttcaggaacgtggaggatacatcgctgaaatattcagaataaatatcagagagaattgtacagtcttttcattctgcaaggaatgaaatttttaaagagctagttgtgtttggcgtaagatcctgaaatttttttatagtgtcacaacatttgttttgggagatgtacaaatcaaatctgattataacaaatattataacaaaaatatccctctaaccaaacaatttctagaccccaaccagtggtccacttatttaaaacaatattgaatgtaacccaattccattaaggcaaaataatgtgagttagtcttggagtttttctttcatgagttccttaccttttggaattcatataggcaattggcagtgattccaaaaatgtttatttacctttggaactatatgattttaaaagtgtagtttatctttcaaattattttctgcatagttccattttacagtatctgtttttgtgggaagagactactccaaatgaaattctggtttctgattggtttcctccttgcctattttagtttcttatacttttatacctaaaaagtttttcttgcatttaacagagtaatttccccctaaaaactattgaagtagtagcataatttacatgttacttcttgtcaaccaccaaaaccacagggtacaacctgatcaaatacactaaatatgaaacaaaacacaggctcaaaatagagtagatggccattgctgcatgtga

SEQ ID NO: 133570 - DNA, 3226 bp, Homo sapiens
taatgtttcctgactcaacctgtccctgggttcagaacccagggatcttcttcctcctaattacccttgccctctttagtcctcccaggcttcaggcttccctccaagtggggatcccttcccagataaaagagttgagaagtggtttattgcttttctcaatgtttaaggaaaaccactagaaggctgcttagtatagagtgaaaaccatgtgctttgtagccgttgccatgggctctggagacagctctgcccctgctagctttatgaccttggacatgaataataattagcactgtgggtgcatatactctgtgctgtcatcagaacagcccattaaggtggagtttgctattatctccgtgttgcagatgaggaaagtgagacacagtgagactaagtaagttgcctctggttcacccagaacataagtgatgagctgactaggattcagttagtcttcagagcccatgctcattatctctattctagggtcagttttaaaccctcatctggatgtaccttacttgatgtaggcaaaatgcaaagattagagataggaggagccccagcaaggggcctgccacgtaggaaaatacttaagattataggagcttcctccttttcctgtcagatcagcaaaaatccaaagtatcgattttgtatatgtgtatttgtagtagtgctgttgtgatgtgttcttttcatgtgacttgtctgtcatatgtccttagagtgtaaacttgtcacgtggggcgggatgttttaatacttcacaatttttaggaccttcaaagtggcggttcaagaccatttcactttggagcattttggaatgtcatcacacagtcccgtgcgtgtttttgtgttaaatttctcatatccaacagatgtatcctcctcttctaccagttcagaatctgctatctgattaattaaaatgtatgcagatgaaaaatctgacaaagattttaacttgtagcctcatcagtttgctggaggttaataggaatattcttgcagtaacagaatcccccaatttggattttctagcttgatgtcatttttatttcatgaagaaaaaagggtagtttttgtttggttggttttttttataaccactaaccagatgtagtgataatactttataacttaagtgtctataatttttaaatctctttgtcctttctgcccttccctaattgatgaacaagcacttacacttgcaatgttttggctcttgtttcctatcagctgacttttggagatttacagcatggattaagtagggaccacttgcttatcctacttttctttgttttcctttccagtattccattccctttttccctgccatctcctcctgaccctccagaaaaggacatcttagtaccttagttgggtggcagtcacagaagaaaacttgattccagtgctatatcaaattgttggggcagcctaaggaattaagttgagggctgcatatcatagtgatttatactttaagaataccaaattggggcccatggctttacaaaggcattttcttatattaatttgtgaatctacatgaaaacaattaagacatggaaattaaatttcatttattcttcatttaaccaaccactttaaaacaaacataaaatcctgaaatcagtatatccttaaaatccagaatgtgtaggcattaactatttgtgactggtggcttaatcattttcaaggttcttctttgattcactaagcactgtcactgccactgtggttggtcattttgcttctcttttaaacacagtcctcagctttacattagggagctaaagtgaggtgagagataatgtcttagaatcttataccagttaagtatcccttatccgaaatgcttgggactagaagtgttttggattttggtttttttcagatttgggaatatttgcattatactcactggttgagcatccaaaatctgaaaaatctgaaattttaaatgcgcaatgaacatttcccttgagcgtcaggttggtgctccaaaagttttggactttggatttcagattttcaggtgtgggctgctcaacctgtactggccactttgaactgattagataacaggcatcacacaagatgcttgaagctagattgccctggtagagtgacaataagggataatgactttacactcgttttatactactgccatatttgatgatctgttaattgccagtcatgtttgtttagatattgtttagtcactgtgcctccccaaggcctttctggcaaagggcacaacaaatagagtaaataaattattgcttttgttactactgaaactattttggctcaatactctaaattaattgttttcatgtagattcacaaattaatataagaaaatgcctttatgaagccatgggccccaatttggtattcttaaagtataaatcactatgatatgcagccctcaacttaattccttaggctgccccaacaatttgatataacactggaatcaagttttcttctgtgactgccacccaactaaggtactaagatgtccttttctggagggtcaggaggagatggcagggaaaaagggaatggaatactggaaaggaaaacaaagaaaagtaggatatgcaagtggtattgtattttgttttttaaataaaatatgtggaaagagagaaaagccaaccagaaatatggtagaaagagcactggactagattcaggggaggcgtggccatcgtctagccttatctatgacgtctgttctctctgagcctcagtttcctctactgcataaccacttaggttcttctgatgtatgatggaccctatgatttattttacttgatatttaatagcagagctttattattttaaaaaatcctcaaattattagtttgagctaaatgttattctatatagatattctcagtgaaatgttggagctgcctcagacatgtaaatcaaagatgtgttcagtattttaatttctttcatgtgtttgaagatgcatttcccatgcatccatggttttagccatgaataaaacatagtattatggaaggtataatggtataaaatccagaaggatagatctgggctcaaatcgcagactagagatagatgacttagcaagttactcagttttccccaactagattctttttaatagtaacagtagcagcaataatatctatcttattgggttattaaaaga

SEQ ID NO: 133571 - DNA, 1461 bp, Homo sapiens
cctggcattttactcaattctcagtaaatgtatcatgtattcaaagtagtaattttggctaattcaaaaactatttgcatgctaaaagttgtagtgcctagtattaatttagttcgtggcctctgtatgattttctgtccttttgaagatgtatccatgacagaagtaataataagcagactgctagagcatcctgagcatgtgtcatgggccaggcattgggctgtgtgccttatgtatgttgtctcattctaagatttccttctctttttcttcaaaatgttaactctacttagttgaaagtattggactatgataacagcagagacaagatgccgtggtagaaacttttttaatttttttgaattggtaatcatgggtcctgataacttgttatagttgtttcttcattttttttttttttttgtaaaacaattctgcgttttgaattgtgtataatctgagatggattcaattttttttcttttgtggaaacaaacttaattgagcttatactattccagaagttttaagatgtggcatcttcacaactatcctgtttgtgaattttgtaggcttgtcattgttttcacatctataaaaatgtggtcaatttgtggatgctcttttacttatagaatcagaagtgggtggtgtaagagattctacacatttatcaaactatggaactttagaaggaagagtactgaaaggttagccttaccaggtacttctggcgtaatttctctcttctattttgaatgcttctttatgtataaagatgaatatcaaattcagtagcttgttaacaaagcaactagtgagtgatgtcattgctaaacaaattcagtacgctgttttatacgtatgcagtctctgtctcagttaaagaaattagtagatatgtgaactataaatatattaaatgaggcagaaaaaaatcatgcatagcctcatcaagcatctagatgcataggtccacagataatgatcttcatcaagttatgtacgtgaatctgcctgttcaataattagtaccattcttttgtcataatcctgactttataatgaacctaatgcagtaaggccaaaaaactttgtagatgttaatctatgtacattgtatttgagtaaatgtccttgtttatcagcagactttcattgcaagcttgaattggaaaccacatacagacctttccctaatcctaacttcatctttttttttaaatcagagaaaaataatgaatttattctatcaataattcttaaaatagcttggtaataactatcatttataaagattaccactgtatctgagaaaaaacaatacacagtcagtaattctcatcaaaatcacctgaacgttgctttaggtttcagtggcactctagtttaaggaagtactttattattgtttttcttttttttttattattattatactttaagttttagggtaca

SEQ ID NO: 133572 - DNA, 1602 bp, Homo sapiens
ttttaaaagagaaaataaatatacaggctctttttaagatcaggcaggcccacagtcttttatccactattctgaaatccagaaagctctgaaaactgaaaggttttttttgcatctcattcataacaaaactgaacctggcttgaagtgatgtaaaagtgtattaatgtttgattatagactgttattccagcccctgttagagtatatgcatcatattgcctttaggaaattccccagatactgaattctaaagcacatctggccctcaaggatttcctgacatgccttttccaagtccagccttggaacttgtgtgcttaccttatctctaactctcattgaaaagaggcaaagcggtcaaaaaccttgtccttttcagctttgagccttcctgcattcctgtgaggggcctgcgttgtagtagtcgtttgtcataaatcagtgaagggagggaggaatgttcaggcaggtgttccaaaccagtcagccagcaatttcctgtccagtgtcctaggcttaaattaagccatgaaactcagttgcctgatgaaactgaagttatcaagtaacaatttaggacctttccccggcatttaaaatcatgagaatgaaaatgctcaagcatctcagggtggtaaaatgactcttggttggggttgcagatcacactatgcccacagccattatctcacctcctggatcctattgagagcatcctaagaagagaatgccagaaacttgttatgatcgttgtggtgacagtcttcaggttataaaaaaatgtaggaatacactacattctcctgctcttacatagacaaagggatgagtaaactatggcccacaggccaaatctacttcccagtttgtttttctgtggcctgtaagggaaaaatagtttttacatctttgacagggcataaacaagtaaacaaagaaaaaaatgtacaagaccttatgtgggttgcagagcctaaaatgattgttgtcaagctgtcaaacactttacacaaaaagatttgccgacctttgatgtagaccatcagtttaactcccagccttactgctcctatttttaagattgattctttccttctccattcctattctcctttgtcttcaagagttggctgactctgtggtcattcagggctcatagttacttttttgcatgaaatgagaaccctaaaagatggtttatgtcccctttttgaaatgtacacaggaagaaactcttaggtagaattaaattgagcgtaaacatgaagtttaaacttattttgatattcaggtgtggagagaaccagttaaagagtttacatggtacctatgccaattttacaaaggcaccattactctggtcccttaatcaacaatgatccatgtctaaattatgtaattctggaatatcagtataatttaggaatcatactgtgagccattctatttttttctaaattatgtaagttacatcaacatacaactttttatatcttgccttttaatccatgaactgataaggtgtggttaatctcactgatcttgaaatattctccgtattttgtattaggagattagtaaaaatcagttgagacctag

SEQ ID NO: 133573 - DNA, 1543 bp, Homo sapiens
ctagcttgactcctctagctttgtgaccttaagcagtcacctaatctcacaggagttctgtttgctcattaacatggcagtaataatactatccaaataaagttttgtggagggcatgtacaatgatgaaacgtgcagaaatggtattggtgaagctgtaatgaacttatgacgacagtttatcatttatacatatactgactcatttcttaagatatcacaaaccataattccatagaaagcctgagaaccaaaaggaatgaggttgctttttaatttacattattttcatctatttctaatatggatgtcttaaaaatgagaaggagtatttattcctataatgcatatcctcaattaaatggttatattagttaacaattactacctaagaacttcctctaaaccatactggtatgaaatcgaaagcatttgctacatctgattggtctctgtgttggctgcggtggaagcttttctctctaggctgggcttgaatttgcttatatgtctgcagtcagctgggtggtctagaacagggatccccaaaccccaggccatagaccggtactgacctgtgtcctgttagaacccaggctgcacagcaggaggtgagtggcggctgagtgagcattaccacctgagctccacctcctgtcacatcagcagtggcattagattctcataggcatgcatactctattgtgaactgtgcaatgcagggatctattgtgaactgtgcaatgcagggatctaggttgtacacttcttatgagaatcttaactattgcctgatgatctgaagtggaacagtttcatcccaaaaccaaaccactaccgccaccccacctccgtccatggaaaaattgtcttccatgaagccattccttggtgccaaaaagattggggactgctggtctagaacgtcttcagctcaactgaccaggctctccctcatgtatctatggtatccctctagcaggctagccaaggcttgttcttttggcactagtccagagtctaggagagcctctctttgcatcatgtgtgctactgtgccattggccaaagcaagtcatatggctgagtctagcatcagtgacagagccctaccaaatgtggatacagggaggtgtgaaaaattgcagccaatattgcagtcagtctaacacagtagttttagaggtaaaggaaagtctgcccaagtggtgactggcttgtagcctggcacatgcgtcatggttgggcccgtgtgcatgcgaacggcttggtaatttcagtgcttcccttctcatttctcatagctgcactagaaccgtggcagccttaccatctgactgcttcatgagaaatagcccacgcccaaatacacacctcttgtgtttgaaataacacaaagagtattgtttccaagacgactttgatgaaatgtcagctttccctgggttctaaacccatataagaagcattgttaccctcattcctgctgggtaatttgtatactgcaatagtttgtttgaaaacatgcccgttgttctttaaa

SEQ ID NO: 133574 - DNA, 1074 bp, Homo sapiens
ccttggcctcttccttgccctcttttcttgatgttgccttactgctctttgtacaggctggtttcttttcacaatacacaagtgtaatttgctgagcctcctataagaggcagtccttaaaatcagaggcctgtcttcaactatcagccctttgtgaccttgcatgagttacttcgtcccctaggattcaagtttcctcctgttcaaagtgaagaggttgaggtagacaagtgcttctcaaacttttaatgagcgttaaaagcacacgattcagtaggtctggcagtgagactgggattctgcatttctaacaagccctcaggagatgctgttggacagtggaccacacttttttgagtagcaagaggctagatgatttctctggtccctcccacctaaagatgagaacttccttcccttgttccacgttgagaaggcccaccttgctggtcttcacattttaatagtctcaccatctctgcacactgtctaccaaaggaaaggtcacagtatacttcgtgctgtcctatagtgcttataaggacctgccatctgcagttcttattttatagcttggccttctccccttcaacccccgaaagactgaaaacccactatctaatgcctaattagaattagccttcaggttacatagtttttgtgactgtttcccttggttatctgccattccttcatttcacagtaatggtagatttataacagtcctcataactgattaaatgtctcaattcttttgctttatgtggcgttcttgggcacttaattatactacattaaatggtgtcttgttgctgtcagtgcagttggattgcagtatagatagcatctttggatattttttaatatgttcctatcatacactttaagcttgtaaatagaagtgctgagcatgcataaatgtgttttaagaaattatttctttattactgtttagctgaactgatggtgacactaaacactgaggctttgatgtttatacgatattcttccccactaattaactgcactaatgaagttaattgtggggaagaatgccgtataaaacatcaaagc

SEQ ID NO: 133575 - DNA, 1828 bp, Homo sapiens
atttctctaccctctaattttattattagcttgacccactactccattttcctatatgtttccatatgttgctcttataagccacttctctaatttctgataggcatatttccttgatgaattcagactgcaaaaccaaggaaatgtgtatgtgtgtgtgtgggtatgtttaaaggcatagggcgtatgtaagtggaggctttgcaaagttgataagaattcttaaatgaccagtagtagaacaagaactccttctcaggtcaatttccctgtggtgtgtgttacatcaatttttattgttgttttttttttttcttaatcaggcagggtttacaatagcaataatgtaattcaaataagcaattattgtaattgaccttggcgatgagtatccttggcttttaccacagtttgcttaatacctgaggatgggcaattatctcataatgcccactttattgagattattgttttaattatggcactcaaaatacatcactttgtcagcattgtagagtcaagcatggaagcactgcattcagtattcagaagtgcgtaaagagcatcttgcctcatcttatgacatggttatgattgcgttttttctctctcccaactgtggttttgaaatgtagttcatcctgacgtgactggcttatagggagagaaagtctgggatttgttgctgagctaattgtgctctcagaaaggatgaaggtgacttgtgctgataggtaagcaggtctagttgattaggagtggtaattgatagcaatcacagtggcttgttgattatctgaatatgccttaggtcagaggttgtcaactttagaatcacctgggagcttttaagattgcctgtatccaggccacttacttaagcctaccctctctggacagcgtctgatttaattgttctggggtgggttccagatggggctttttgaaagctccacaggtgattcttatcccctgacagaccttagaaccactgcccggtcctttgaattatttactccttgctgatttgtctcattccaaccatgaccccatcccagattttaagactccttttgggggtccttgttgctctataccttactcttcctctctttctttccagacttagcctaagcctagccacctcacatgcacatgcttgaaatagcctcagtgcagatttgggtcctagtaatgctaattcttcccaagcagttccaggtctacccctcccataggaagtgtcagtgggtaaatttcacctcttcataaacgtgaagtgtcatttcttactaatgcctcattatgctcttacaattcagttttctcttggtcacataaatatggcttaacctttatctaagttttttgagtaaggatcagaatttattctttaacatctgtcttaagtactgggtaccactttgtggaaatttaattctggttgattagatcagtagttatgaagttcctagttgtttctcaccttctttgataaacctggaggatactgttcacacgcatcttgcagtcccttgattccctaaggataggaatattcttttaggttacctaagactcctgcttctttttttttttcttttttcaaatttttagacgggatctcactctcactcaggctggagtgcagtggcaccatctctgctcactgcagcctcccaggctcgagatcttcccactttaaccttcccacaaggtagttgggactataggaatgtgccaccactcctggcttttttttttttttttttttttttttttgtattttctgtagagacagggtttcgccatgctgcccagtctggtc

SEQ ID NO: 133576 - DNA, 1025 bp, Homo sapiens
acccttaggcagaatctcccccacccaacctctgtggtctagctggccctgtcaagcctgctaataacctctccagtctactctctattctcagtggaggaaggtcagtgggtatctgttttagaaatgttgtcagtggctcaaatgtctgtgacatgccatttgtttaatcccatgctcctggatacttgcttgtacgcattaggttgtgggatcttctgcgtttcaattactataccctggaagtttataaaccataagacttaccagatagcagactgttggctgtgttagcagagagctgtcctgcggtgggacatgcatgcacacatgccacacgtgtgcatgcatggaaagagagagacaaactcaaccacaaaagttgtacctctgctttgagttattttaatcttccttcatttgttcagcaaacacttatgaattgtccttgcattaaaaagtgcatcatgtccttcgaaccatatttagtattaaatagcaaaagcgcatcactgagctagcattctttttaataaaatagtgattgatcaaatggcattcacctcatttctctgtgtggtgagtgagagtattttcttgcagtccattttcagcatgctgctattactgcaccacttagcttgatgccaaattgcagttggctccattcatttctgtttactgagtagcgctgtagtgattaaatgtcactgggtacaccaagtatacaaaagtaattaacctaaaaggacatgttagaataagggtcaacaacctctttagcccacagtgccaccagcaagacagagtattgacagaggtattgctggcagggcaagggcggaggggggagtgtggagaacggaaaagagagaagcgaatggaaggagaaagagggagagggaaaggtcagagaaacaggagcgatagaccaggactcacaattgtctgaaatggcaagtagaatggagctaagatatttttcatcagtcctttataatttagttctctgacctgtgatcttt

SEQ ID NO: 133577 - DNA, 1042 bp, Homo sapiens
taaaaatttacgtaaagcaccaggtagtcatctatgacttaaatatcaaccaatgtaaacatcttccttaaaaaacaagtattatatctgtctgccttatatttggctttttctttcatcatctgtgtgtggtgacttactaaccagaaaaaaaaaaaagcaggggggaggactaaggatgtttttccttttaccacatacctccttgggggataaacatttcaaggagctccccagggtcactattctctaaatgagcagcacagaaaaactgctgatgcgtgcattcttccctgggtctgtcaggcaggattcctttaaatcctgtcttttcagtggtcagacttaagtaagatttgtttccctgtggtcacagacagctgaggagtgtgtgatgagagacaaggaaagggataacctgttgaaaactttccctcttataggaaagattaatttctattacaatttttaaaaaggtggccttcatacatttatccaacaatgaatattcattgcatgcccacccagtggccaggactgggcactgaccttgggggaggggcctgcatccttgattggtgaggagagcagcagtgaaaaggcaccagctttaactgtcttttcaacatagttctgaaaattatcttgtcaccctattactttcaaaattactatttttgaaggctgcctccctcctttggtgtgcctacaaatgcatatctcacacacacacacacacacacacaccactgttcttgtattacaggcattatattaagcactgaggatgcaaagaaataagacacaatagtgcatgacctttaggaatgcataatctcctatcttaatataatgaacataatatggtaacatgaagcatacatgagcagaaccaagttttgtgcccattcatttgttcagcagctgtcaattaaaacaccgaagtactggattttcgtggtgatccaaacgggcgtggtccttgccttcatggagcttctagtcaagtagatgagataaataatcaaaagagtagccacag

SEQ ID NO: 133578 - DNA, 1021 bp, Homo sapiens
tatcctaagtattttgactcaaggagccctactgaaaaacaaggtgtatatttcattcttcaaggtgtgtattaatattttattcaagacatttcatgtgtttctgtacttagtgggttaaatacttgttgaatgagtccataagcagacaaaaaatatgcggttgtttccacatttgccaaaagggaatagctgtctatgggggcttactagtactagatgctaggttgaattcttctttatccttatggcaacttacaaggaagtgctgctaacaccctcgtcttacctactggagaaatggaagcttaaagaggttcatgaattttcccaaggtcacatagcaagtgttacagcctggtcttgaacccaaggctgtctgacttttatacctgtagcataaccattgtagacactgcctctcttctgttattcttctgactgttggttcctctggtttgataatattttgattacctgcaaaagaaatttaccttgatccaggtttctcttaccagtagagaagcagagacaaaaacaatagaacattttaaagaatatattgttcatgaaatgttacagaaggtgaaacatttgttaagaatagattcattactttatatggagattatattaaatcttcttttaacaagggcagggctttagaaagtcccagtcatttttgaaggtgagttttgatttatgttaatttgaaaaaagcaagttctgtgagagttttatacagattgtgcttttaatgacttccttaatcaagcaggttataaaaaagaaaaacctcttactgtgatgagcagtaaactgacaccagtgactggctcagtcagagctctactatattcaagttttttaccaccagcatgctataaattttaagttcatttacataaatttacatgtgttatgtgttagtatgtgagacttgtgcattttgaccaagtaattttcattttaaaggttttatatttacttttttccaattgaggattatttcttatatata

SEQ ID NO: 133579 - DNA, 1162 bp, Homo sapiens
ttgtctttccctttatatccctgttttcttcctttcgtctcctccgctttctcctatctcctcttaacagctttgcaagtatatgctaaagaataaaaagaaaagaaagtctcaagtgacttaaaaatcactcggctaaatagatgataatttctcaaccatgcttcctctccttctaattccagagctcttcagtatccccatcagccagtttccgaggtgctgagaagcacagaaactccgcagactactcctcagagagcaaaaagcagaaaactgaagaaaaggaaattgcagctcgttatgtaagttcattcacctttgtgttaggggaggccagcttgcctttttatctgcagccattttaccctttgactattaccagccaacacaggaacacaggataacatcctttaggagacaaaaaacatttattgtatttatagctctgtagccattggctagctgaagtcctgtgtgtgtacagatgcatgtgaggatagaatgcttcattgggcagctaacagaagacctggatgatccatattattgtttctataggtgtatttgcttccccattcatttcagagtggttggattttctgtggttagctggaattgttaagcagaaaaatataaaatcataaaaaatgtgtttaaatgcctagatggattcatgtgctgaaggatataccaaatgttgtggaataaaacatggagagacatccaagatcatccctagcctggaatgaagctcattttcctttagtggctgggcaggtcacaggagtgagatgggggagcaagctggatggagcagtgtggaggcaggcggcccctgctctgcttccctgctggtgtcctacagggccgcaggcctcatgaaaagctggaaatctggatttttacctcccaatatgcagttttttaaaataccaacaaaccagaccacacctatctgtaggccggatttagcctgggcctgtcagtttgcagcctctactctagagtaataagccaaccatcagcttcaagtttgtaactgaaaaatgtaatcaggtcaccctcttggtgcagtgggtagtgcatcagtctcataatctgaaaaatatattacccacctccatagcatcatcatgaggattaaagaaaataggacatt

SEQ ID NO: 133580 - DNA, 1116 bp, Homo sapiens
catgggaaaaggcaaaccgcttgttttcctctctgatggttaagcaaactaagagcccatacagtgactatgagtgtgcacctaaatatcatctgtcacatgtaaagagtaacttactgcctcatgtggcaaatactagatagcccctcagctgcttcattggccttttcccttgagttccttaggaaatgtcagtttagtagaatttttgctatagcatgaggctacatcagttgaacataattaaatatacataagattcccgtaacctcatgagctaggaggaactttttttttctgtaacttaacactccatgatcaagtcttgcctctggtgcagctttcatcaaatgcatgatgccctttagtcacgtaatgcaggcccaggcaaaaggaacagactgccagggatctaccccctgaaactttcttgacatcagtagcaggacctttcaacagcagaactgagcctgagtctaccaaggttccaagtttggatactccaagactgtgagagctcctgcattagtgtacgtgtgtatctgtgtgtgcaaatgatgcaagcagttggttaatttggtggtggtgggagtgggtctagagctttgcattttgatgctaattaagattaaatatctcagtactacattttgtagatcaactttaagtacttccctaatttcatgtaattttctagcattaatccactttatcattgtcataagtataaacggctcattaaaccaggagggaacacaatacttttatggatttctgctctcatgttaatgctgttttcctttcctcatgagtaatctcttgatggtttttgtctctacagaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggtaggttagcaggatctgttaccaggt

SEQ ID NO: 133581 - DNA, 1009 bp, Homo sapiens
tgcttctaaccctgttttctcctggtgaccttggtacgttttgccatgagtgattcctgggccagtagttcacactgagtgtctttccaggtgccttacttgagagcctcgccttccgtcttgcacagccacccacagacacattgctgctcactggcaggactggtcctgtcgctccctgtgccatccccagtccttctttaaagggaaaattaaattctctctccctcataccacagtaatagaataggtctcagaatatatctttagttagtgcatatatgtgtaggcgtgttttcttttgttaatttcagagatttttttcccattagtaatatcagtcatgttttcatgaaaaagtaatttgaggaattcctaagtattcaaaaccaagcaaaaagtacaggacatgtggcatctctttgtatatgctttgttattactttgaataattagaaaccataataaaccaaaatgaaatctacaaataaggcctgcattgaaattgaatcatcaaggaattctaaattgattttaactaaaagctaacttttcaagggctttccctccattttgacattttcaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccaggtatgatccgtggctgaggcattttaaagatacggttttaggctgaggtgggcggatcaccaggtcagggaatcgagaccatcctggccaacatggtgaaaccccatctctactaaaagtacaaaaattagctgggcatggtggcatgtgcctgtagtcccagctacttaggaggctgtggcaggagaatcgcttgaatgcgggaggcagtggttgcactgagctgagattttgccactgcactgcagcctggcgacagagcaagactctgtctg

SEQ ID NO: 133582 - DNA, 2385 bp, Homo sapiens
cgtggtggctcatgcctgtaatctcaggcataatttgggaggccaaggcaagaggatctcttgagcccaggagttcgagaccagcctgggcaacttagtgagaccctctctctacaaaaaaagtttgaaaattaggtgtgattggacacatcagtgtcgtagtcccagcatctcaggagactgaggtggaaggattgcttgagctcagaaggtcgaggctacagtgagccatggtcacaccactgcactgcagcctgagtgactgagggagaccctgtcttattaaaaaaaaaaaaaaaaaaaaaaaaaaaaaaaagcagcagtactgtccatgaccacctttcacctttccttgactgggctttctgtttggtcaaggagcacattacatttgcatttgctctaagtcctccatactcatgggattttctttcagtatttaacatttttgattatatgtttctttcctagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaagtaatgtgggtttttttcactgttgctgtttttgttttggttttgtctttacttgagaggagctagaa

SEQ ID NO: 133583 - DNA, 1044 bp, Homo sapiens
tgggccaagggagatattttagaacacaaaatttatgtcaatttagcctgctgttttttatatattccatggtttgtaaatatgatgaatgtgtatgtatgcacacatatatagagaaagctgagatatcaatacagaataaaacttttcaaataaaaataatgcagaagcagctgctgttctctaaataaaagaaacaataagcttgattttaatttttaatttattttcatgtaattttatggctttcaacacttccttattctgtcgttaaattctcagtttttatagtttaatggtatattctctgtagtgcaggcattatatagctctttttctgtagctattcatctatattcataatacttataattaggaaattgttagaagacgttttcagtatgaagggaatcaagttgaaaattatgtaggaataagaagggagagaccaaaaattggatgaaatgagtcacttatcaagaagagtaaaacagtgtttccaaactataatgtgatcagaaagaaccataatctttggaaactatgaaattaatattgttaaagaaatttttgatcctccaaattttaaaatgtccaggaaaacagatactgtgatgaaaaacataataaggtcattaagtttgggttaattggtgtcttagctactgacatgattaatgcaagggattctgaaagtcatacaaaattatacaatatagaagaaaacaatttattttacagagaatctttttattcaatagtttttaattctccactgaaattctctttactttgctattcttgaacatattaagcacagctattttaaagtttgtgtctgttatctctatctgattagaatccttgtaggtctgctcctctgggatctttttctctggattttcaatcacactgtcttgtcctctcatatactgagttttgattgaatgctggacattgtatataaaaaattgaagagataaattgactttcgttaaaggcatcttccttttgaaaagaattacatttgcatctggacataaa

SEQ ID NO: 133584 - DNA, 1007 bp, Homo sapiens
tgatgttgtgtgtagtgacccatatccttctgcataaaagacagtcgagaaagacaaagctcttggtctttgggtgagtgattcattggttgattgcctggagttttccacttgggagcaaattccttctgtggtttccaggctttaagagacattagtttgcttttcaatttacatggccattctactgaatccactgcacagctctctgccattgtaatagccctgatacataacttcacatttggaatgtagagtgcaaccattcttaatagtttactttaatggccactcttttctttcccttatggtttcttgtatagtattatttttttaagcagacagccattgtagtgccaccacattctgcatttagcataccctctgcagcgaaaatcctttaaaaacaactatagttccttggaaagcaaagcactcagtatgaagaacattgattggtggggaaagaaaatgacctaatgagcccttgtctggaattttcctttctttttttctatctaagaaaagtgagcatgatgtctaagacagcgcacgagcaggtggtccaagccacagagagaggagctgtgtggaccagcgggattaggtagttacccgcatgatggcagtttttaaggtctgagccaggcctcactacccgtgtatttgttttacttgaatgactagtttttgaaataaaggaaaccctgttgtgtttcttttaaccttcttagaaagtttcaggtcacttccaattccttttcttcttgacccccttctgctgattgagggagttgcagcctgggctgattgtcctcttcaatgccgtcgtttgagaccagcgaagtaagagttcttgctctcagatcttgggggggcagcacccctgatgccgttgtcagggaaaccagtttcagatgggtgcaaagaaggtaaaggattcaaacatctcatttgaaataatgaaataaaaacgcaacccataactctcccctccccctcaccta

SEQ ID NO: 133585 - DNA, 1006 bp, Homo sapiens
ccaccacctcctccttcacgaccctccccctaccttccccaaaactagagtggtttttagaatcctgtaggttaaggtgtgttctctgttatatttacatatgagtttgtttaagggatttgtacattgaagaatgtatagttttccttcagcagtgtttgatctgtggcacatattctcaccatctaatgcaggagtaggagatgattttttgattcctaaataaatagaacttgagaaatctgcagaatgtcactaagagtagagaaaagtcacagctcctctgaaagttcatttatttaccccgcaccagagagctcaaaaaaatgcacagatacctcagtgatacccattttattcctcatcctttaaaaaatgaactggtggctgactagatttgcagacttttgaaataatgtataaatggcaactttgtagattgtgaaaagtattttgatgtccaatgtctgaatgtagacttgttttggaaaaaacagtgtttgccattttaaatgctttctggtggtagaattgttctttcgatcatgacttggcatttattttttaccttgttttgtaataaaaataattctactcagaaaactaggacagaaacagaaaacaagcatatatacttctaaatttcatattcctgttaacattttgttgagtttcttagagtcttgctgttttcactctttcccaacataagcaggatacaatttttgttctgcctttttttaaaacttcttagagaaattctcaaatacatatgagtacagcaaatgtccaagcatttatgaaagcacagagaattgtacaataaatgccacatgcccatcgctcagcttgaagttatttggccatatgataactctcgttcccacccccagacactggattattttaaaataaactctagcagcatatcattgtatccataagcacagccatgcaccatataaccttttagccaaggacagaccgcatatgtgacagtggtccc

SEQ ID NO: 133586 - DNA, 1048 bp, Homo sapiens
ttacactgacctcccctcagcagctctgctagttgccttgcacagcatctgtgctcagcagatccctgttggctgatcgtttctgatggcgatttttgaatgaagcacaaggttctttaaagaacaaccttgtgctccgcttggaggcagagtcttgctgaggtgcccgtgggtctgcctcagcaattacctgtgtctctgcccaatgcctctgaggtcaggaggccggcatgcgtgaccctttgtctctgggagtccagatttcctaatgcagggctctttctaacacagaaagcaaggttgagtaaatacatgagctcatgctctgttggcacgtagggcattgctgtgttgattcactcatggaaacaggaatgcttctgtacaccctgtgcttgtaacgtccccatttctttctctcacggactcaggcctgcacgattaaagaacagacctttatcttcccataaggaatacaatcgggattttgtgtgtttgtcttttattttctatttaacaattaaacacttttccagacctggaaagaattttaccttccagacggttttgtcagagtagcatatttaagttctgggtagtgacctgcagtggcattccatttctttagcacttggatcgtggaaaacagggaaagacaatcgcaggtgctgtttcccctcctcctcaggggaaggttagtttgatcttgcacatcagcagacactggcgggatcacacacacacacacacacacacacacacacacacacacggtccaaaactaacaacacaacagtgtttaccttgagctctggcaggaaatcattattcaatctggtttgttttatcaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccaggtgactgagtggcttccgcctgccctggagtctgggaggtggctggggt

SEQ ID NO: 133587 - DNA, 1061 bp, Homo sapiens
gctgtgtgcccagtaaatgaaaagccccttgctcttaatgggtttttatatcattcatgttttacatctgtgaagtcgagtgggctttattcttttcgattctgacaccagacttcagaagcagaagcgatcctgatctgtaggagcttgattcagaaagctaggtgggggctgggtctcagttctgaggctttctgagatgcaggtgggcttcgctgtatggcccctaaggagggatccaggactgactgtctgccctgcagtttgccacgattctatccaaacgtccatctctactctttgggcgtttgttctagtctttgccaactgccatttcccccactctcacctttgatgacttaagaattttgtattttttgttgcctcatcactgcccttgtgctttcctgatccccaccctgcgtcttcctccctttccgcattccctgacccacatacttgtccactggttgagataaagccctcaattcaacgtatcttcacttggcttttttttaagtcgtggtggtgcgataacaatactgtcatttcctgaagactcactgcaggtgtcaagtgctgtgttaagtgttttgcagctgttaccactttaatccttacagcaacccctgcgacctctgtgttttattattattcctatcttatggatcacgaaacagacacattctagactgcaggctggctgattggcaagaccgcagttgacgtagccagagaaccagagagaggttcatttaacagcaaagtttgggcacttgatttgcctgtggacctaatctaatgtgttaactggttacgagccttcccctcgacttcctcttgaataagtaaatgaatctaaactttaaatattggaataccatacacatacagaaaagtgcatgaatcatacatgtctagctcagtgacttttcaccaaaggcagccacctgtgtaaccagcccttggatcaaggaacagagcaggatcattgcccagaaacccctcccatgccccttgcagtcaccaaggttaaccaccaccttgactttcaatactgc

SEQ ID NO: 133588 - DNA, 1173 bp, Homo sapiens
tacatgctgtccttaacgctgcacaaagtagggaatccatgtatgaatccttaagcattaaattagacccatgtatgcaactggggatgattttgtcccttgaggacatttgataatatctggagacacttttgattatcataactgggggtgggagggggggcaggtatggattcctcttggcacataaacagtaggggccaggaatgatattcagcatcctgcaacgcccaggacggcccctaacaaagaaaagaactgtttggccccaaatgtcaatagtgctgaggttgagaaatcctaatacaacatactgctctgtgaacttgcttgcaagtctaagggaagtatttaccatggggaagtggttctcagtgcacaaatagatcacatctcctctctacctcccaaaaaggaagtgggtcttgtggcgttcaggggtgcttatattacctcttgcatagtaattaaaaagaaaaacactaggccatgttactgttcccatttatgttgctttggggatctgtgagtttctaatgaacagtattgatgttcacaaagtgcctgctgcaataaactgagtctgcaatgccttatttttgtttccaggtggggtttgatcctccccctcacatgagagtacctaccattcctccaaacctggcaggaatccctggggggaaaccgtaagtacctcaaagaccttggttttgttttaaaggtggttactcagtcattggtattagcagactagaattccaaagggagtacaggcttgggcgtttccaaggagatttctggtgtcttttcctgaggagtgttaacactttctataaataggcagcttgtaggtgtcatgcctctgtcttctccctgggggtgatctccttagttatttctggagagaaactgttggagatgaggacgaggtgggaggaaagagctggaggtggctggccctcttcgcctgacccctcagaaagctgctctgctctgctctgccatttggctagagggcagctgctggagattcccaacagtgctgtgctgtgggcagtcagctgtcacgaactcttgcaggcttagacacttttttgaaatgtgtcatctctttactcagctctgtgccacctttttcttattttggtggaaacaagagttatttgaagggta

SEQ ID NO: 133589 - DNA, 1011 bp, Homo sapiens
gcttatatcaagaacaacaatgaaagcagcgtcagggctggaagaagtcaggggcaattatacacagaaaactgggttcatgggagcaagagtaaaaggaagcggtctgtttttggtggggtagactttaggtggaaagcctgccgggcgtccggcagctgcgtgggccagggatccctgggtctgagtgtggtgtttctgggcctttccagcccacactctgctgccttgttttgagtcagttttacagcatcaaaggtatgatgaggcatcttgttttgtaacttgttgaagtctgctgttgaatggggcccattttcagataagcaggggtgctaattactagccctgtccaccacatttagaggaactttcagagcttttcaaaacctattcagattataagcttcatttaagccgctcaagcggaaattacagtagtaactttgaacacatagacgcagaggcctcaaagcttgacagtcttaaaggtccagccacggaaaggttattgtttctaacagaaattgtattgtttctaacagaagtgtagtttacttttacgttcacagtaccatttgacatcattaaacgacaacaacaaaaaaaaacaagacattaagaagctgtcttggaatggccctgtggcttggatgcgcagtgctgatgacagcaggagggcttggaaggctgtggagagagacttgaacttaaaactggtcagcacacccagcctctgtgccccattttgctgggcacttgggcggatttaaagttgaataagatacagccctgccgtggatgctgcacagagtctggaggaggagacctcggggctgaagtaaactaggaggggtgtatttaaacacgtttcccatgtgtgaacaagcagctgctgccccggcccagcttttcagagggcgtgttagcactttgcaagagttaggtctcctgcagccttgtcagctgggggtctgggttggaggggttagcttttagcggacatgtatc

SEQ ID NO: 133590 - DNA, 1051 bp, Homo sapiens
taaataattgtatttattgtctgctccagagtttgttttgttttgcctggaggagggtagaagggccagctacaaatgagagggtggtgacgaaggcatcgtggttttagcaccctgtcctgcctcaacattaaccggccctgtgtgtcacctgcacagctatctttccatgagtcctcctaactgagtcacccacctggattctacagtgatgagttgcaaaatcgagttgcaggaatgcactggttctttcccatagtttgcatttaaactgtgtgaaacatcaatgtgtgcccttcagactggctgcacaggcagggttctgagatatgatatggttgccagtggacagattttcaactttgtccatgttgttaacaagtggggatctcattagttttatgggttaaaaatacattagttgaagtgttaggcagagtacgtgaatgaccagttggaccgtagcaaaaagtgcagcgcagggtgatggcttgattgacaccaggtgtagatggagaaggcacacagatgtgatggggtgcgtcgttacctaattgttttaatgttcaccgagaagttaattgtcagtgtggagtgtgctagtaaattaggttcctactgccttagtgtaactgaggataaatgaggtgtcacgagtttccaatctgtacctctgacacaaacacttttcctgcggggaggagaaagttcccaaggggaatcagcatggcagctaaagaaatccatttgaataatgtgctttatttttgcattagggaaacctgtcttgcttttgctgtatgcatgaatgggttttcctttccattttgctgctggtggtttcagggttcgaacttgttggcagagaagttgcttggaggtcttaggattcatgaaggcctctgtaactagtgtttgatagcattgacagggcagcattttattaaagttgcttttttttttttttttttttttagtagtttctgaggttactttccagaacatgttagtagatgtgaacaaccattactgttaaattgctaaagaaaag

SEQ ID NO: 133591 - DNA, 1079 bp, Homo sapiens
ataagggggcataagtgcctgggtggtgcatgagacacccacccagattactgggtcttcctttccaaattctattccttagtgatagtattttggttttgtctcatcatactactgtggtaagtcaatgcaagggtgtagggtgaaatggagttacctggtgacaggttgagagtatggctactatattgtgggatgcatccccacccccattttaatccctctgaaaacagcgtgagtctgaaaatctgtggcatcttagattgagtgacatgctggatctcatccctggaggcgcataaagacagaactagctcatgtttacttactgatgtagccagccttgcttaataataaacagctcccctctcggagtgagtgataccagaaagtgacagtgtagatgtgaggattatattttgggaaggtgggagaggtaattgagcaggtgaaagcttttgatgaactgaaagcactaatcgcattttttcccctttcctccctctctttcttggctccttttgtgtgtttgttgaacctcctgttctgtttccgccttcccctcctgtcatgtctgttttcccctggatgccgcctccatcgccatcactgtcaccactacctcctcctcctcctcctttttctctctcaccaccaccaccaacagcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagaggtgagaggccgggcaagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcg

SEQ ID NO: 133592 - DNA, 1085 bp, Homo sapiens
atttgagctgcagtgagccatgattgcactgctgcactccagcctgggtaacagagtgagactttgcttcaaaaaaaatgcatgtatcggctggtgtggtggcgcacgcttgtaatctcagcactttgggaggccggagtgggaggatcacttgaggtcaggagttgcagaccagcctggccaatgtggtaaaacctcatctctactaaaaatacaaaaattagctgggcgtggtggtgtgcacctggaatcccaggtatttgggtggctgaggcaggagaatcgcttgaacccagaaggaggagattgtagtgagccaagattgcgccactgtattccagcctgggcaacagtgaagactctgtctcaaaaaaagaaaagtgtgcataaattctcctgattggcagagctattgggttttggctatatagtagtatcagtatcactttttcctaaaatatattcaagtagcatccatactttttcctttgttgaaggtgataagtacaagattgtctcaggtaagccttgttgagaaaaaatgggcttccaaagacagatgggacagaggagcgctgtccttttggagatagctgttttactcttctagatttggaccctctactcatttaaataaatatgttatcttagaaatgacactttgtgtttataatgttaagcatctacttctgagaaaagccagagccagcactgttaggcttgattcttcttgacgtgcttctttggaagagagctgggggcaagggatagtgtccttttgcagatgtaggacaggcattgagaaggggggacaggagatggtactcatgcagtctaagcgtaaactcccccgtcactgccattaggcctgttggtgagggtggatttgtctctgtgtatgtagtatcaggtgttctcaagagcatctggttagctgagcagtgggggaaatgcgaagtctcagtagagaatggctttgcccttttcctttcttattctggagaacatgattgagctgctggggttacaggagaaatcttgtcctaggaaacaaaaggtttgtagccctcattctggctctgagc

SEQ ID NO: 133593 - DNA, 1060 bp, Homo sapiens
tagtcctttttattgacaattaacatttcatcaatatactgcagttgcttattcattcataagttgatggatatttaggttatttccactgattggctattttgaataatgctgctatgaacatttgtgtacaggtttttgtgtgggcatgttttctcttggatttgtctctgggagtagaatcactgggtctatggtaactttttgagcaacagccagactgttttccaaagcggctgcatcattttacattcccacaatagcgtacgagaattccaatttctctacatgatctctggcatttcctgtccatcttttttattctccgcatcctaatgggtgtgaggccgcatctcccgtttttgatttgcattttcctgatggctgatgatgttgaacatcttttcaatcaaaacctgtatagtttttgtagtggatccaccttcacatggcttgtcatagccttaatggccttccagggaaatgggatgagcaaggcagtggtcatgcaggaggagttggcctatgtggattagctgaaatggagaaagaataaagacaggccaggcatggtggctcacacatgtaatcccagcagtttgggaggccaaggcaggaggattgcttgagctcaggtgttggacaccagcctgggcaacatagcaagactttttttccactgaaaatcaaaaaaattagctgagtgtggtggtgcgtgcctgtagtcccagctactcaggaggttgaggtgggaggattgcttgagtctgggacttcaaggctgcaatgagataaaatcatgccactgtatcccacctgggtgaccaaatgagaccctgtctctaagaaaacaaaacaaagggctgggtgcggtggctcatgcctgtaatcccagcactttgggaggctgaggtgggcggatcacctgaggttgggagttccagaccagcctgactaacatggagaaaccccatctctactaaaaatgcaaaattagcctggcgtggtggcacatgcctgtaaccccagctactcaggaggctgaggcaggagaatcgct

SEQ ID NO: 133594 - DNA, 1035 bp, Homo sapiens
gctaagaaaagaaatagtaatttaacggtttagacatctattacaagtgtgaaagatcatgaaagagtaccctttaaaatgcaaatgagccgaaacattctcattccctttaaggtacaatcaaggagctttactgcttgcttgacagggctaaagatatttctctttatcaaacctggaaaaagtaaatcatctcaaggacatccagcttctaggttagttcaaggtgtgtcttgggcctgtgggtgctcttcgaggagacagagagaggttgtattttttctgtgcttgttgagtgaattaacagtccccatttctcaccagcatagaaattgtagttctcctgtctgacaaaaaatactgaattttaattctttctcaccatagcacctgccttcaacttacatagagtaccggtatttaagaaaaataagcttcttaggtatttgatactggagagactattgaaatatttttgtagacctttttttaaacagctttgacagcaaatttgatgactggcagaataataactacagccctactttttgactgttgcttcttaccaattcttttcctattaaatgtattgtagtcttgtcacaatgaaaaggataatttatagtgcaaaggtgtacaaaatatgtacaaggtttatttggtttgacacacagctcacttaggccttagaaaacaagtcgcattgtgggaggggaacttactcatttgagaccttgagtttttagatcaggatcgtttttacaccataagcaacatttttgtttgttttttaaaatttctattaagaatgatcaaaacaaaattggttattaaatgttgtaacatcttatttgtggaatggctaatggctgcctgaatgcagggataattgattgaaagactcttcaagaccacttctccactttattatttggggagtttggaactaaaagctctcttctacctgctctgatagatattgaataattgatttcagttgggattgggattttaaataattattgttctctttac

SEQ ID NO: 133595 - DNA, 1244 bp, Homo sapiens
gctgttgctaatgccctttcttctccttgttttcaaagcatcaacaacaggtggcccaggctgttgaacgtgccaaacaggtgaccatggcagaattgaatgccatcatcggggtacgtggcctaccaggtctacctcctacagtgtgtataaccagctttcatttcttattaatttgatggctttacgtgtgtgtgtgtgtgtgtgtgtgtgtgtgtgtatcttaacgttgacctatttgataagggtgggaggaggagaggaagagacttgggatgtgctaaggtatatggaggaagagggcttagcataaggaagatgacaggagaagcattttaggaggggacaaaaaatctattaattaaaaaaattctttttaaacagaccggggtcttggtattttgcctactctggcctggaactcaagtgatcctcctgccttagcctcctgagtagctgggtccaaaggcaggcacccccttgcccgtccctaaatctacttttaagtgggaaaataaatgtagttcatcctgtgacacctaaaccacccttgcttcattagtctagtaaaagctttaggttagaattttaaatactttcctcacttctgtcttacaatgttagatcacagtgaggtcaaaatgggtctctgaattatcatttcatttagttatccttgctttttgccttttgctttctggggtattcgaacctatagaactgttggctcttgttctttcttgtgcctctttcatgaatttttaagtcacacaccaatgaaaagagcgctctcttgccatggaagaattgttaattgtctgccctagtgctccctggcttttcaccggggttctgctctcctctcttgagttcagttagtgctccgtgctagccactggttgtcaatcacaagtcatttgctctgcattaatgaatctggtgaaccgtgcattccatcccctgcatgagttcatcctccgccccccactgcaggacctgggatggttctcatgtgttcgtccccttccacactaagccaaagaaggagctgaaacaagggaccgtcctttctgattttattcatatgtgagtgccttgagcagattcaaatcactcatttatcaatttatgttaattgcttgtgagatgatgccctgctggtctttatagttccctcagacactttgtaatgataattagacatgctgctgtacggattaagagtgccatagtccaatgacggc

SEQ ID NO: 133596 - DNA, 1049 bp, Homo sapiens
gtggcaaagaggtcagcaggcctttcttctactctatcaccttaggcctcatctttgaaaggtggactgctttgacagtgctgcagctgcagtggcttctgacacccgcttgaatgaacttgcaataatgacataaatgtgtcatggtgtgccatcattgaaaaagtacacttggctgggtgcagtggctcacgcctgtaatcccagcactttgggaggccgaggcgggcggatcacgaggtcaggagatcgagaccatcctggctaacacggtgaaaccccacctctactaaaaatagaaaaaaattagccgggagtggtggcgggcgcctgtagtcccagctacttgggaggctgaggcaggagaagggtgtgaacccgggaggcagagcttgtggtgagccgagatcgtgccactgcactccagcctgggcgacagagcaagactctgtctcaaaaatacatatatatatgtgtatatatatatagtcaccatattaaatgatcatatagccttaaaccgcctagattttccaactcaatcaaactactcatctcttattacaatgaagtgtgcagttgtggcttactttgcaagtgggattaatatctactgtttatttcaagataagtattagtaacataacctggggaaaccattttatacacatttccagagcaagggagaggaggactgaagtgttaggggtatgaagttttacctttctgaactgattgtgaagtattctaaacatttgtgtggctttgtctttatagactgaaatcgccaagagattgaatacgatttgtgcacaagtcatcccatttctgtctcaggaagtaagtaaaattgttcagctgttaaagtgcaattatgttgcttctctgtttgcaaattagctagttttaagatgttaattttatcacaaggaacaagtgtgaagaacatctgttacagctgaagtgtgtaaaccccctgctagtctatccaacacatctgagggcacactgtagaaatggtgacaatagctcaacccccaaattaattt

SEQ ID NO: 133597 - DNA, 1131 bp, Homo sapiens
ctttttatccacatgtctattagacagatggagatgaaaattggtctgaggtcaagccatttgcagcgttctcacagccttcgattttcctctcatcctcaccacagatcatctcaaatgattcagtaatgaccaaaagtgcaacattgacctttattccctggtggattactgtgtttcacagtccaaatggcaggaagtcttttctgttcttccagaaggagtgcagcattattgagccaacccagccctgtgggaaccacacaaatgcagaccagtgtaacagaatacgtgggttaaatttggtttctggtgctgtgggaaacgagaattgacatgtcctggaacccacataattaatggaagactatctaggatgttttctaaaaacacacaggagcatataaattgatttgtccacttgtaaaataacttgtgaattacaggagtggtaacttctggtggcccctggtttataaattgttcttgtttccattatcttcagttcctctctccttatttaatgcttccctagtatatcttagacaatactgtaaggctttataattttaaaattataaattgacatgactgagcataaagggatgaaggccttttttttggcatacttttaattatgtgtatttttggtcagtccctgtaactctgaatagattctgtcccatacgacactttttttcccatcctgaaagtaggttgattgttatcttggaggaatggtgattatttttctcttacttagattcctctgtggattgtataatgatgcagtgattggggttttttttggtaaagaagtaatttgtatttaaaatgttattcctgtttgcctccacatgcatgggtgagtcaatattctgtgaatccatacaccatggcacctgtcatctaggatccttttgcttactctcttctaaatacttaaaataatcttttccaaaggttatgctttgaaaaatttagctagcatcccagatttcattttaatcgtgactaaaatgcttttgagaaaataaaacttcttgactgttaactgttcacaggttctttttctgcctcagtggctccaaattttaatccctacccttgcccaccacaacttccaacttc

SEQ ID NO: 133598 - DNA, 1118 bp, Homo sapiens
gggatatgtacacctgtggggagtgtgtgcatgtagttttctttttgctctgtaaagtactgtgcaaaagttgtgagtagagtagttgtggtgctgtctttcttcgtctactccatgggcttgagatttttgttgacagtcaaggttcacagctgctgctgatgtactaatatttggggaagcaaaaaaaaaaaaaattgttgggaggctgaggcgggacaatcacttgaacctgggaggcggaggttgcagtgagccaagatcgcaccatcacactccagcctgggcaaaaagagtgaaactccatctcaaataataataataataataataataatttattgcaggggagaaaggcagagccattgggattggtcaaactggaagtttaggctgtttactcttaatcccaagcacaatgcagtagaaacttcttgtgtgtctttgtaagtatttgagataaagcagggcacagttcagacaagttgtgccagtacctgctctcaaacaagctccaaagttggccgccttctgatctgggtgtgctgagaagctccgcgttcatggctctttctgcttagcttgagaagtggccctgacaccctgaggatctgtaggggaagcactaggttcttgacaaccccctagcctgccagttggcctgggtcccagaactttttccatttgtaagtgggctggctcatttacagtgcttgggccatgagctccctcagagccaatgtctctgcacagctactgaggagattggaattggaccattgaaatgtatccaacttctgtactttttagctgaccaaaggccaaaatcataccactaacttaggaggggaactgctgacatttgaatcttataagaaatctgtattttataatcgactaccctagatgctatgatatttatgaattaaatggaagtataaggaggaagtataaggaggtttcaaatactgactggatttttctgagtatatagattttttttcttttttttttttgagacggagtctcactctgtcgcccaggttggagtgtagtggcgcaatcttggctcactgcaagcttcgcctcccgggttcaagcgattctcctgccttggc

SEQ ID NO: 133599 - DNA, 1033 bp, Homo sapiens
ctctctttgttctgacccctcaatgaaacttgacttatactttacctttaagatgtaaccagtatatttgctgggggaaatattgttagcaacgataggtaagaaaatagaaataattttgcaaaaggactctgattttgaactttgtgtgtatggaattgtcgtgatggagattttcagttggcctcagggaccttgggtggtaagggggtaaggaccagaaacaaaacctcattgaggaccccagtgtgtggaaccaggcccttcaatgctgtggccttccggttgctcctcaggagcatagtctttgtttcctcttggtgccctcttgatgccttgagcaaacagctggtcagagcttcttataagtacagtggccagccagtgtattgacacgcacagacacaatagaaaactgcattagaaggcaagccattgggatttgcagtaaatgtattacagaacacaagtgacttgctgatactgcttgtttagcagtttgcaagggcaatggcagtatggatttttgaattagaagggaagggctgttctttctctgtgtgggaacatctagttgatggctggggagaaaattgatttagagaacaaaatgcagccaccgttatttgtgccatttgaaaggcctctatggattagtgagtgaaaataaaaaggttgctttcggtttaggaaagagggtcttaacattgatctgcgtcttggtctggtatggagagaataaaggatggaccaccagatggagaaagggcatccaggccccatgcagcctgcagatacaggtacacactccattctcacatagttgtctttctcagctctttggctttcagaagtcggctttttgggtttattattacagtaagcttttccaatgacaacattagagttgtcatagcccccatccgtggagctcccatgtgccctaggaattggtccgccagaagccgccccctccccgtgtcaaccttcccagcctccctttgtgtggatactaattattccaccttgaaaa

SEQ ID NO: 133600 - DNA, 2234 bp, Homo sapiens
aaagcttttgggtgtttacctagatagtttatggcttttccaaattggtctgtgtttttacttgaagtgcaaatatgtgaggcagatgttaaaacaagtgacataatgtttacattaagttgcctgttttgttttcctagccttaaattggaatgtgagaaactggcaagtgaaaagacagaaatgcagaggcactatgtgatggtaggtatcaaagattggactttttcctttttcatatgatattagcaaacgtgttagcagagtgtaaaaaacatgagttaatgaaatgcttgattcttttttctctttacagtattatgaaatgtcatatggattaaacattgaaatgcacaaacaggtaagctttagttgaacttcaagctgaaatgagacatcagttcatatgatttaataatactggctttgttctcagtagtgggctctaggggtgggggtttgtatgctatttttctgccttggtttcctgtcctgtggattgatggtagtattctgcatcaagggttgcttcttgataattacaagtgtttaaatgactaggagagggagaggtgttttggaaatataaactagcctctttattgacagataggaattaagacttgagtttactttttcacctgtatagatttatcctcttgaaagggctgggtatcttctacagttgctgaagtttagaatagttaatgtttttgtgctgttttgcaaggaagtgtggacctgttggggggaaagaagggtattcaggagttttttttaatcgtggtaatcaaggtatatgactatctgtggagtattctttatgctttggggctgcatgaagcaatagtcaggattagtggcttattagcaaacaaatttttgaaaaatttctcagttgttgcaggtgtggatgtgaaaaaagcatctttttatggccagagcatatgttgggagttgcttcagtcctagtggtttttaaagcatgaaaagattagtgactggaaagctctagcaatgactatgagtttgcaagttcccataaaattcacacttatggctactataatggtgtataaaaagagtattgagctggaacaaggcactaaggacctcataagagaagaaaagctaaatgattgctcagcccaaaggaccctcgattgagtagtcattgtctgccaaagaaagcattaatggcagggtgtaagtattctggagatacgctgacattcactttttcatcaagacgctggtacaataagtcttttagaaatcgattgcctcttaaaaaattatcatcagatgaagttgcacagttggacacatttcaaagtgcaacaatacaattcttacttgatgtatatgtgctatttcatctcaaacccttgtttcattaaattaaagagcatggctgaccggctggggcacagtggagaaattgattagttcagccttcagatcttccttatattcaaagactttcattaagcaagtgtgtttcagagttgaattctgcttttgtaactccgcactctttgatttttaattcatcatagatttcataatgttaagttatcgtgtacattagatctgttctcagatttgtgtttggaaagagattgtgattttcagggccttttattaataatgtaattgggcctttaaaaatgcagattttactatgatttacaaagttggtagcctactttatgttgggtttgtgcctttgtttttgtgtgtttctcagtggctagtgccttattcaggcacttgtaacttcttgatagtaaatgggctagaagatctgtggctaacatctatcgtcatttaagtgaattatgcaaataaacttggcctaggcggtttaatctttttttttttttttaatttactctgaagggcacttttttttggataacagatattatggaagagtaagaggagactgagctttttcttaaacccataaactcaaaggatttaataacctcattgactcttttacaagggaacaccacctcagtgtgatgctatatgctggtgctgggtttattggaggagctaaaagaggtgtgtaattcttctgggttcctgtaggttatgtggcgggatgacctcttctttatcatgtagggagaaggggtgaagtgggtcagaagcaccatggtgtgagaatagttttctaatgagtttctatacagagtgaggcatttgtggctatatactgtctg

SEQ ID NO: 133601 - DNA, 1489 bp, Homo sapiens
cgccgtgggggaaggggcggcgacaccgacaatctggcctggtcttccctggccgccggggagcccccttccctttggcctggtgacccgggcgcacttagcgcaatccgccctggagactgggaagagcttccgagcctctttagaagccggggcccggggagggtccgctttccccctccccatagtgaagggcaaactcgagtttggggcctcgttttcagccacttctaactttatgtttatgtcccacccgttcttgccttctctgacttactgctttattcatccgcccgcattcccgtccctcggtccccctcgctggtcgcccccagacgccgcaccaggctgcaggccagcccttcaagttcactatcccggagtccctggaccggattaaagaggaattccagttcctgcaggcgcagtatcacaggtgcgtgtccggccgcgccatgcgagtggtcgcgggcgtcccggtgccccttgcacccagccgggtggcggcggcgcctgtacttagttcttgcgtccaggcggtggcgtgtggagtctcagttaagacctgtcattcaagttaccccctttcctggttcttcccgggccgcctcttctcttgtctcctcctcctcccattgtttcccttttgccggtttgcactgttccagggagtcctttttcatgtctttaggagttgcatgagaatcgtcaatatttgcacttcatgtatttatttttcagcagactgagctgaaacattggttcaatcgatgtctcagtcctggagtgtgggttcagggaagcaaagccatgttgaaatcgctgtttgccatactagaaaattgggttttctgaggcaaagtccattaaggaaggctagatgcttataacattgcccatcattggtgatggtgagggaggtgggtataatagtataaagaagaaagctcacctgctttggcgtcatttcggattggtttgggtaggatgagagagtggagtcacatttatatccatctcagccttagtttcttcaagtaatgagacttaccttcaaaggacttataaatttttgtaaaatactttgccaatagtgaacttcccagaaaggttagtttctttcccttgttcctatgaagttttacctgattctaactcagaaataactgtattgacattttttgcttttgtcatgcttgagaaaaagcacacagatgaggcgaagtggcttgggtgtgaattttcttactttgtcaggggctttctcattattgaccttttgtctacttgtagataatatctctgcagcttgaggcatacttgcacacaccgtgtttacccagcagggagaacttcaacccactttattgcagtagctacttgacatattttggcagggatttaaaaaccaaaggttttgaaagggaccagcaattgtaggagtaacttaacagataggattttcaaacctagagaccgtttgagttgg

SEQ ID NO: 133602 - DNA, 1078 bp, Homo sapiens
tgaatatttgcccttttctactgattcttggggctatcagagtttaatatcccaagggtcttccacagagttacttctgtatgatccctgtgcctctaccttcattgcatgtaacatgctgttctggtttccagaccggaaaagtttgcagaaggaagcagaagaggaaagaaagctacattcttttctgaaaaggtgattaatcattccccttctatcctgttcccaccgccttcttttttttttttttttttttttttttttttttttttttttttttgcatgttctattcatttcagggattccttgtagcctgctgtagttttgggagtgggtagccataggaacggatatgtgaatgaatgctttgaggagaggctatagtgaggtcatatgacctcacatacggtgagctcatggatggggggtaatgtgaagcaggattcagggggccccacccctgccaggctaacagatcctcatttccttgttctgatcctggctgcagctttggacctcctgtttcctgcagtcccctgggccagcatcatgataccaccctctttcgtcgactgttatgcccagaccctgtctgtcgggtgtgtaacagagcaactgctgatatccagcgactgctgtcttgggagtccctgaaagatgctgctccctctgtgtcccctttggcttcttcagcttctggggctgagtcatcgttcactctggcttccaccccctcagcaaccactccagaagacctaatattgtcctctcggcctaagccctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagcccagcctccaacctgaggccagtttgtctctgaacaccatcttttcatttggctccaccctatgccaagatatttcccaggccgtgaatcgcactgatt

SEQ ID NO: 133603 - DNA, 1046 bp, Homo sapiens
cttcctctcttgttgtcttttagtgattaagaagtgattttctctggtgatatacttcaattttttttacatttgtcttttgtgtctctagtacaggtttttgctttgtggttaacatgaggcctacataaaacaccttatagtcataatggcctattttgaactgatagcaacctttgatcatattaaaaaatgttacacttttactccaccttctctttccttcctgcatttaaattttttgatgtcacagtttacatcttttaatactgtgtatcttttaaaaattattgtggctattatattaataattttttcttaccttcaccctaaaggtataagtgatttacatacaactattgcagtattacagagtactctgaattgattgaatctgatttgcttttaccagtgaggttttatatttcatatgttttcatgttgctaagtaacatccttttctttcagcttgaagaactgtctttaatgtttctttccatacaggtctagtgatgatgagttccctcagcttttgtttgggaaacaacagctttatttttgaagaacagctttgctgggtaaaatattcttggcatcttttcctttagcacttcaaatatgtcatcccactcatttttggtttgcaacatttctgctgagaaatccactgctagtcttactattcccttgtgggtgataagcttcttttctcttgataattttcggatcctctctttgtctttgatttttgacagttttcttataatatgtcttgatatggtcttatttagaatgaatttgattggaaaccactgaccttcctgtacctggatgtttacattttccctccagatttggaaaggacattcctcttggcactgagtctaacttgtgagcattgatgactgatgagtagtgcttgtaggttagtcagagttgagtcttgaaacacaggcacacatggagggactatggctcaggggtacaggaaagtaatggcattatttattaaagtaaactttctgtccctttgtctctctcttctt

SEQ ID NO: 133604 - DNA, 1052 bp, Homo sapiens
gtacttctcagtttcagaatttttttttaaattcaatctctgttaaatttctcaatttgttccatgtattattttcctgattttattgaattgtttctctatattttcttaatgttcactgaacttccttaaaacagatattttagtttttttaacacagttcttacatctccattttttggggggttaactagtgggaaattattatgttcctttggtggtaatatgtctctttgatttttcatgtttcttgttgttttacattgatgcctgcatattttttggagcagataccttttataggcttaaaggctagtttcagtatagaaagaacttcccctagaaggggatgtgagagaactggctgagtagggtgcagaaattctagcaccagtgaggacacagctgtgtagtctctatgcaggtctgtcagctgaggtcagtgttgagaaagattacaggaatcctcagtggccaacactgtggatgtctgcagtggtgatggggttttgggggtctttggtagcaattgctagtaaggtcttcctgatctcttttccttccactttggaagctgtgcctgaggacatttctcttggcactgggtctaatttgtgagcattgatgactggtgagtggtgcttgtaggttagtcagagttgactcttgaaacacaggcacacatggagggactatggctcgggggtacagggaggtaatggcatttgtgcttggtatgcaggctaccctcctgacatgttggtaacaatatatgatatacaagtgcttgtgaagcatctagggaactgagaacaggagtataggtgtgcacagagtaatagtggctctgggaatggggcagggacctagctttttatggtggctaatttggtgcccagagcatggacatgctcagagggaccttggctccaggccctggagtgtgaactagtttgctgtggtgatgcttgtgatgtctgagacatggatgactttagtgtagccacagagcttaggtctagagtatgggtattcatggggcagccacttat

SEQ ID NO: 133605 - DNA, 1027 bp, Homo sapiens
ataggcaataacagaagtggcatcagtggacactttttgagcacttactatgtatcagatattgttctgttgcccactcaccaactcacttattccttacaaaaatctgtgagtaggaactatattaattcccattttactgatgaagaaacagacttatggaaaccaagtagctgatcaagactgctagctagtaactgtgtggagctgtctagaaggtttgtctccagagcccgactaaactccatgctgcctgtggctggttgaaatcattgtggttacctgatagaagtgcagccagtttctagaatcctttaccatcagtcagttgtgatttcaggagtgtattttttttccctgtcttttctgagggttttctttacctgctggctttggcttatgccaaggcctggtggtctcttaccttagtaaaatgtcatgcaagttacagagccatggaatccggtcctgaaaaaaacaaaaacaaaaacccagacacaacgtgacttctccaggtattgtttgtttgtagagaaacagttatatcatgttcacaaatgttaaggtccagcgagagctcagtggtgtgaggagtgggccatgcacaaggctgaggggccagctgctgggcagaaacattttctttcagctggtgtcagtggctcttttcataataataaaaattgccctaaagtaccagtatgtatctccccatattaatctccccattttacacgtgtcctccctggttctgatacgtttacaaatcttttattgtactgcctgtattctttaggtatctctgatctcaaatgtagagagatattcacataaacccttacgtcagctgtcccctggtcctattcttcaaaccctccaaagaacaaaattcccctcagataaaattattttaagaaatttatatttttgccaaagagaagacagatgaaatttacgtagcacgtgctacagtgtttcacaaagaaatcctcctgagacaagtaaattctctccttcctggcgcaaa

SEQ ID NO: 133606 - DNA, 1962 bp, Homo sapiens
cattcgaagaatcattgaagctttagaattttatacatgaggataccagcttttatagttactcaattggtcagtagctacacaaatcatctaattctgaactatctgtgtgtgtgtgtgtgtgtgtgtgtgtgtgtgtgtgtgtgtatatgtatatgtatatacacacacacatacaggtttttctgcatgtacgtgatcctctaaaataatggttgatgtttattaagcttttctccccctcccctaaagtagagtcgtgatctatttgacatgattatttaggtacaaactagactatttaaaataaactgctaatggacttttaaatatgttggataagtttcaagaggtgggcagtgtttttaaagctcagtagatcagcatatgttataaaaaagcaattaaaaaattttaaaagtcatgtgtggcagggactggcttcctttagagttggattaattttttttttctttaatagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactccca

SEQ ID NO: 133607 - DNA, 1214 bp, Homo sapiens
taaatgtgcctaccattttactcagtgagtggcagtacacagtgaaaatgggtggaggcattacatcttttgttgccttgggcatgaaggcttacttctttcataagggtgggcaatattaagtgccgaatatgattctaattaattctttgcagtcttggaggaaaagttggctcagtccttttcactttatggaatttttcagcagtaattttgaccatacgtaatttttgccttaagttgacttcagaagctagctcttcattagacaagattttactgtaaatgcagaatgtttaaactcatcagtcctcttttcctggtatatgttgggcatgtacttttagagatgttttagttttaaagttctttcgtagttcagttgatacataatatgtataatcatttgtacttggtgaaattaaacacagtgcatattatattttaaagctttaacttttgtttaagtatttttccttaatatgtcttttttaaaaacaaactttcagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacaggtgagtttgtaattgtattgaaaaagactgtgcagtgtgaattaaaataacctaatcttgtaattgtgattttggcacatttgtgttgtgtatgatatcttaatacactagaaaaataagtaaactgtgtctccaattttttagaccgtgtgtttctttgcagtaaattaatacttcatatgtaattaaaacaactttatctctgccattcattgactagaaagaagtgcaggtttagtttgtttctacatatgttgagttaggagacaagtacagagttctggaatgcccactcttttgaagataaactacttaatgaaatgtaaatcttgaaagcaattaagagcaatgttaatacatttgaaatacttttatttagtagatcactcagattataatagtcatgctcagaatggcagttgtaaaatagcatttattaaagacgggaatttgtcagaacaatgttctccttctttcaactattgattcccctgctgaaaatcgtatacaggtcccttattaatgtattcctttttctaatttgtttctaaagagaccacag

SEQ ID NO: 133608 - DNA, 1040 bp, Homo sapiens
ggatattgggaagcaatgcattgttaggccttagcagaggatcgaatataggatatgtgcacctatagtaggacctttgtgttagagatgaagtaataatcatttcttactaacatcaagatactgacataaaaaggatgcatctctgtattgttttgaattggggattttttgttttgttttgtttttagaggcgggatatcactctgtcacccaggctggagtgcagtggtgtgataatagctcactgcagcctcgaactcctggactcaggcagtcctcctgcctcagcctcctggaacattgggattatggtgtttgaattgtagcgtctgtagtaggggcctctatgaggtacctgtagaaactagactgtatggtgctgtgcaaacaactgtaatacatacttattttatttttatttagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggtatggttttggaagatgtacagctttaaaattgtggataaatgttcgtacttctaaaagtaactagtgttggctgtaaattactttccctgtcattaatatttaaatagttaaaattctttccttgctgtcgataacaatttttttaaaaagtgtgattccatgttaatgcttacgtgattgtcagataaccatttcatattttacaaggttcattggtatttagttattatacctaaattatttgcattagaacaggcaagtttttagcttttcttttagtaaggaaatttttagacaaagatcatgagtaacttatctccttagcaaaccacgaattgataatcatatttctttaagtctaaggaacttttttttttttttttttaagagacagagtcatgccatgttgcccaggctgggctcaagtgatgctcccatgtcagcctgggactgtaggtg

SEQ ID NO: 133609 - DNA, 1064 bp, Homo sapiens
aaatatttactgaagtatagttttgtgttatctttatgcttttttggttatttttcaaaatgttagcaatgtgtatgggagttgacaaaggtaaaacagattttttaaaaatcagttgtttatattggctgttgtaaattgattatggaaaattttgttcatacacaaatgtagagtgttaggaactttcatgcacctatctctgattttcaacaatgatatatagcttatcatgttttttatatatgccttcccttccttgtccccacaagattttttaaatctcagacattctgtcatttaatgtctttccgtttatcgtgacaaccagaagaatgcccctatatatttccaaaacaccttcttggcagcaatttccttatctgttgagatccactgctgtgggacagtgaggtagagtggtttgaagatgtgattcttttctgaatttggactgatttcttgagccagtcttttaatgtagattcctgggcccactctgaagctttcctatttggacagtctggtaaagcctaagcatactggtgattttggtaaagatctgagaatagtataagtaagtgtttctttatagcatgatgctcttttctcttgtctggttttatgtgtctggtccctggaaagcctttcttcaggttttatcggctactttctttagtagtctttctttagttttcacttagggaaagctttccctgacttccctttatgcttcctttggacttcatggttttacttgactctcattggactgctcaccttcagggagagttgtgtcttttatctttgattttccacagtactgcttgttaataaatattgaataaagtaagtgggaaggatggtcagtataatacagattaagtatactttatccaaaaactttttttttttttaaacagacagacttgggaccagaagtgtctcagatttcagatttttttttctttttttgtttttttggattttgggatatttgccttatatacttaatggttcagcattcctaatttgaaaatccaaagttggaaaatgctccaatg

SEQ ID NO: 133610 - DNA, 1022 bp, Homo sapiens
agttatgtctccataaagcttaaaaaatactattttttggtaggtatttgaaaggatgtaagaatagatgcatgtctttttttttttttgaaacggagtttcgctctcatcgcccaggctggagtgcaatggtgcaatctcggctcactgcaacctctgcctcccaggttcaagcaattctcctgcctcagcctcctgagtagctgggattacagacatgcaccacaatgcccagctaagttttgtatttttagtagagacggggtttcaccatgttggccaagatgttctctatctcctgacctgtcatctgcccgcctcggcctcccagagtgctgggattacaggtgtgagccactgcaccccgcccgatgcatgtgtttaatctagtatcttaccttcaaatcctaaaatacaataaaatgctatataactgtatgttcagtaattaagtcacttatttcagaataacgagggatatcaaaaattttggaaagcatttctgagtttaaggttaagaaacacaaatctagttttaccctctcattttgcatatgaaaaatagttaatctggataggtttgtctttgaagtcaaatctaagtttgaatcctaactaccagtttattagctgtatcagtgtgaggggaagggagacatctgtaacctctttttctgtgtctgaaataggattaaaaactctcttcctcgaaaaattgttgagtattaagagaactggcatagtagtagctaccatttattgactactgcctatatacctgatgtttgcatttatatacattctcgtttaattcttacaaaccatgtgttctgccattcattatattactatttcggataggtactaaagggaaaaatgagatgtctaataatgggagtatagttaaattatgacctgtttctagatatagaatatcatgcaaatggtgttctgtgaagattttctgttagttacttggaaattgcttatcttagataaaaggattatatatcataggattt

SEQ ID NO: 133611 - DNA, 1070 bp, Homo sapiens
atggaggggagtttctgtgtaacttctaattagcttattctgggatttcatagactgttaggttatgtgtaaaattttgaagtacatttacttgaaatgttcaggcagtatatactctggttttagaaagtgccttctgtcagtgcaaacttctgggaaaatattaatatacttagacataatttaaacgtattgagtcaaattgagcctttctttgataaggcaacttgccttagggtcatcatcacacacatgatttaacgttatactgtatagtgtggatctagaactatactgtccactttgataccatcacccacatgtggttaagtacttaaaaagtgagatgtgttaagtgtaaaatttataccagattttgaaaatttggtatgaacaaaataaatatcttaatacttttgatatattatgtattgaaatagtattttgcagatcgtgagttaagtaaaatatcaaaattaatttgaccttttattaaaaacttttttttcagtatggctgcttaaaatttttaaattacttgtggcttatatatatttctgctggacaacatcttatccagaaggttggattgaatcagtatagcaagatatctgagaaaaaaaatgtctgtgagatcattgttttcttatttgctttgttctaatactggacagctgaaaaactcgttatttaatgattctgattaacagagattgcttagctttttttaagaaagagcgtaattgaagtgtaatttgcctaccatacagttcaccattttaaagtctgtaattgatgtaatacattcacagggtcgtgtagtcaattttagaacgtttagaaccctcaaaaagaaacgctgtaccctttagcagttgcccttcgtttctccctgggccccccagccttaggcaactactgatctattttttgtctatagatttgcttgttctgggcgtttgttgtaagtggaatcatgtggtcttttgtgattggctttcacttagcatagtgttttcaaggttcatccctgttgaagcatgtgccggtacttacttcctttttattgc

SEQ ID NO: 133612 - DNA, 1021 bp, Homo sapiens
aaacaacgtgaacagttggtgacaggaaacaacaattcctgaaatgtacctatcagtttccccagggacagtaggtgattggggtattggtttaacgagttccaaaggtagtgtattttgtgaagcagtgaggtgtgtaacatcaaatgagagaaacttttaccaccaacagaattatcacttttgtttttgtctcccagtgcttgtaaaaattttccttaccatttttgtattttcaagcatgcggaaagttgaaagaattgggaagtggatacacatatgtccatcatctacaattagcattttacggtattataatcgattatcaagttcatttaattttggggagcaattcagagtaagttgcacgtatcagtagatgacaccagtacatgtcacttcagcattgtgaacttatttgcctaagttcaacttcattttttacgtttttttgacgtaattttggcagcagtgaaatgcatatggttgccattccgtgagttttcataaatgcttacacctgtgtagcccaagctcttatcaagatatagaacattataattgactagaaagttttttcttgccttttcccagtcatttcagtcacttggcctttccatcaaccacccagttttttttttttatgccctaagttacagagttgcctgttttagaacttaacattaaatgggatcccatagagcctatagtactgtgtgtatttttctgggtaaggcttttttttcccactcagcataatgtttttgagtttcgtctttgttgcgtgtatcagtagttcctttctttttattagtgtgtagttttccactgtatgtgtataccataattaatctattcactgttgaaggtcacctgggctgtttgcagttagttactatgaacagtcttatacaagtctttttgtggtcttactcttttatctttcatggttatatacttagacttggtttgagtaggtcatagggcaattgtatgtttcagttttgtgagaaactatgtt

SEQ ID NO: 133613 - DNA, 1013 bp, Homo sapiens
tactttatcttctaagactgttcactatagaaatacccttggaaaaatagtccaggccaggtttggtggctcacacctataatcccagcactttgggaggcggaagcgggcagactgcttgagctcaggagaccaagactagcctgggcaatgtggcaaaaccccatctctacataaaatgcaaaagttagccaggcatggtggcacccacctgttgtcccagctactcaggaggctgagatgggaggattgtttgcacccagaggttgaggctgcagtgagctgtgactgtgccactgcactccagcctgggccacagacaagaccctatctcaaaaaaaaaaaaaaaaaaaagacaattgtccagaagaaacacaatatattagtttgctattgctgttgtaacaaattaccatgaacttagtggcttaaaacaacagatatttattaacttatagttctggggatcaggagtccaaaattgatctgaaaaggctaaaatcaaagtctgtgtttcttctggaagctgtaagggagaatcgattgccttttccagtttctagaggctgcccacattccttgacttgtggccacatcactccaacctctactttcattgtcatatctcttctgactctctgcctccctctttccttcataaggatctttgtgatgatgttggacccactcagataatccaagattctctccccatcttaatattcttaattgcatcctgcagagtcacttttgcatgtaaggtaacatattttcaaaggttctttttttctttttttcttttcttttttttttttttttttttttgagacggagtctcactctgtcacccaggctggagtgcagtggcacgatctcggctcactgcaagctctgcctcccgggttcacgccattctcctgcctcagcctcccgagtagctgggagtataggtgcccgccaccacgcctggctaatttttgtatttttagtagagacggggtttcaccatatta

SEQ ID NO: 133614 - DNA, 1036 bp, Homo sapiens
gtaccaccatgcctggctagtttttttatttttagtagagatggggtttcaccatgttggccagcctggtctcaaactcctggcctcaggtgatccgcccgcctgggcctcccaaagtgctgggattacaggtgtgagccatagcccctggccttatttgtactttagattcccttatgctttcctcattctgctcttgataattcctttccagaaatgctgtgttgtttctaagccaataatttgtttcatctagatgtatttgttatgggttattttttatgttaagtctataaatatatatcaatttttaggttttttaatagtgctattaaatcaccttgatatatgcttttaaaataaaatagctagtagttttaaaggacataaattactattctaccttttcattacacaaaagcagtaatctgaacattttttgtagttatagtaacctgtgatttgattttggacatacttgtgtccccttgacttgctccccccacctcccaaattatgtggaaccaaaaaactagattatgtggaactcatatgcttaaaatgcaataatatcccttgatatgggtgggatttactaggataagacgttccttaagctgagtaaattagtaattatatactgaattttaacatcttaaacctagaaaagtaaatcagatgagaatcctagaaaactcttaaatgacttctataactcataggagataattttgaaattctttcagtttcgtttttttttttttttttacatttttgtatgttaaattccttcaataaagtttcatctttgtttctttttcatttacagatcacattagtaaaaagactgaggtaagtcttattgtagccatcttgtagaaaacactgatgattttaagaataatacttaaatacttagcagtaagtcttttttgagacataatcatttaaaggacaacccataggtttgtcttgagtgaacccagtcatgtttctgccattatataaggatgtaaaatgcattgttgtagaataa

SEQ ID NO: 133615 - DNA, 1133 bp, Homo sapiens
tgaacattccagttcagttgtctgtctatacagaaataattagtttattggtagaactttaaactttgagattgaagagcagtgggtataaagcattaaaaaaataggttaagagtgggataatgtgaacaaccgctacgcttttgagaaggttgaggaaagaagccagcaaaggaaacttagcagtagtcagaaatgtattaagaaaaccaagagatgcttgaaaaaaataatgtgttttggatatggcaataaagaggagattgaccttaactttagtatcagagaccagcagaagccagatttcagtgggatgaggcaggaaattgctgattattgtcttaaatttggtcttgaaaggtagaaggtagcaatgaggagggggttataggccaaggtatgactttttttgttttcattttaatgtttaagatgtaagggattgagtaaatgaataaagaggtatctctttatacaatttggctagcctaaattttggttttttatttgccttttatctttaaaaaataaactttaagaaacatattacctgttggtgagtttattttacagtttgtaaactgaacttaattgttgttggtaattctttttaggagtatgaagatgctgaaaatacttcaactcagtccaaagttatgaataaaaaagataaaagaaagaatcatcagggaaaagacagacctctcacagtatcactaaaagattttcattcggaaggtaatgtatatacaatgctattatgctaaaagaactattctacatctgttttatacttcagttgtaaatgtctttctaatttttaaacaataagtaaaagttattcatgtatcatgtagaatgtaaaaaatgtaaacctttgtcttagttcgttttgtactgctgtaacagagtacctgagaatgggtcatttataatgaatggaagtttattggctcacagttctggaagctgggaagtccaatatcaagatgccagcatctggtgagggccttcttgacgagtcatcacatggcaagagtgagagcaaaagggggccaaatttgcccttttataaccaatcccacctgtgagggtggagctctgatagcctaattacctgttgaagatcctac

SEQ ID NO: 133616 - DNA, 1020 bp, Homo sapiens
ttgcttgaggccaggagtttgagactagcttgggttaacacagcaagacactgtctctaaaaatttttttttaattagctgggcatggtggtgtgagcctgtattcccagctacttgggaggctgaggtgggagaaccccttgaacccagcagttagaggatgcagtgagctatgatcatcccactgcactcctcctgcctgggcaagaaagggagatcccatcttaacaaaaaaattcacagcattgattttgctagttatttatagttcaagggaaaaggaaaaaagttgctaataaagtgggctgtatatattatatgtgtttcatttccatatccctttctgttacctcaaataacgaagaatgaactgtaaccattattgttacatacccatttagacacaaagcaggaaaattaacaaaaattgatacagctagttttactatgatttaatcatttaaatggactgtcaggttacaccggaaaagtaatcctgtcttgctcaattaggagataaaatttatcaaatagaatattatacaaaggtgacttcttgctgttagacttatggatatatgtctagattctaaagctagaaggattacctgtatccttagaggagaaatagagtaaatagtgttgataaaatgtcgtactcccagccagtgttctttgcacagtcataggtgtagtactcaaaatcattgattttagccgacaataatgactaagagaagggaggaacttcttttgtgtgcaatgggtagtttgatgtgatgacattgatgggtagtcattgagataaaagtcaatattcaataaaacaacttttaatacaattgttttagcctaaggatttttataacagataactaaagtttgggatggcattttctttttcttttcttttcttcttttttcttttttttttttgagacagagtttcgctgttgttgcccaggctgtagtgtaatggcgcaatctcggttcaccacaacccccgcctcccgggttcaa

SEQ ID NO: 133617 - DNA, 1060 bp, Homo sapiens
tcgatctcttgaccttgtgatccacccgccttggcctcccaaagtgctgggattacaggcgtgagccaccatgcccggctggcttaaatcaacactttaaaaccagatatgcttcctagacaaaattggttgtggcaattagtttgttagaatagtacttaccgtaatgaaacaactttgaactgctaataattgctcatgcacatctgcgttatgggaattgaggattgtctattgtgcacttcacatatttctttttctacttgtagagcacatttttcactgcatagacagctgtgtacttgaagaatgtaaacatgaagaaaacactaagttcaataaatgtgtcttctatgtgccagatcctgtggtatttgtaagggatagaaactcttgtctttcaggatcttgaaatcaggatcataggggctaggcacaacaataaagagaatttttttggagtccattcaataatagtaagtttaaagtatggaaatattacagaggagggaatgtttaacttcaggaacaggtcagagaacgcttcatagatatgctagcacctgagcaggattttgaggaataaatggaagttttcagtggaagagatagatggcattgtagacaaaagagaacagcatagttaaagatatgaacaagtaaactaattgtgtgttcaagaaatttcaagttgttttttcttggagtacatgcaaaatctgaagaaagagggttgctagagaaagccctaacgcatgctattacatttaataagtcaaataattggctttttgggtatgaagtatatgtaaaataaagactttgttatatttttgacattgctgccatcttttttttttctttttcttctttgacaaagggtctcaggctgtaacccaaggtgtagtgcagtggcacaatcactgctcactacagcctcgacccccaggctcaggtgatcctaccaccttagcctcccaagtagctgggaccacagtcatgcaccactatgcctgctaactgttgtacattttgtagagaaggggttttgccatgtttc

SEQ ID NO: 133618 - DNA, 9867 bp, Homo sapiens
gttaagattaaagcccttgctgtagtgaaccgccactacaggtcaaactaggaggagagtgtgattcttaaagtgttaatagattaaatcttaattatgtgtggactccttaggaaactgcttggttggcagtttattgtttgatcacaggtcacaatatgaaggtacctactaatactaaattaattgacttattttaccaaagggtgctataaaatctgtgcttagttttattttatacttggtgttatttctgacattgagtactccaaactatctagtcctcacagcacttagaattatattttgatttttggtttggttttggcctggtcgtttttacaaccccaaatagatttttattcttataacaaacaggttagaggattttttagcaaaatctaagagcgtaggtagctattaattttagggaaaggcaaaataattttttgtctttgtatcttctccagaatgctggggcagtgattggaaaaggaggcaagaatattaaggctctccgtacagacgtaagtattaagagtttaaactactacacgagcagcttcagtttatatgtctatagaaatttaaagatttacatcctagaaatcatttcatagtttagctacaaagacatttgtaataatttattattacagaattgatttcgaagttatccattcctgttttaacaaaagcccagattgagcagggtgggggggtggtttctttcaaacctcttcacattttaataagagtccaccaaattattcacttcatcaagcaagataacatcttaattagaaatagcgacaaagtgtaaaaatccttgattgcaccatttcctgtgtgtgaatcaattacagtattactgaaaaccattgcaggtggctggttaaatccagaaaaatttttttgttttctttgggaagaaaaatgtccatctgttctttaacagcttgcacatggagcacaaagaatttaatgttgaggttgcatgatttaaatatgggtaaagaatagagtaggcacttaatcttataattgggaaactgttcgtcaatgcctatgatttgtttgagtcttcattttacagtgggttgactcttgtgattagacacattaaatgttggcagtgccagaagtgagcacatttataggacttggctacaccaaaatttctaaattttttttctcatagtgtacacatttcttaatgtttttcttgctaaaaatgaggcaaataactttgtgtcgagtacttatttgacagtatttcatttctctcttggtcgcagatctttgtatgttcctcttgattactgtaaactgaacttgaaaatttgtttaaaattttacaaacttgcctgttaggatctaggaatgcatttcaaaacctccagaaaaccaaaccagtcttattagttagggtttttggtggtgtgggaatttttgttttgtcttttataaacctctctcctcttaatccagatgttctgtataattatctgggttattaatttccccatttcctcaagaatttcagtaaactttgagtcaggttttgtgtctaccctcatgagccagcctgctactgaaacatcgtttgtttttcttaaaaaataaaaaaggctagaaccatcatttgaggtccttaatgttaagccacagtcagatttagagaagtccattattgtgttagtcttcagaacaacttaagcttgtttcattgagagtatgagtatagtttgtattaaattaaaatttattgcttttcccccttttccctctccttgtttttttggccatatatctccgttgcccatgtactggatcgacttacccctgcgttgcccaccatgacgttggcccatccgcccctgaacgcccatgtgaaaaccctggttggctatgcccaaaaatgtgctcgttgccaaacgggtaccatacttgacaacttctgattgaatgcccatgcccaatgccaacatccacgaacgccaatgaccaatgcagtacaatgccagtgtttcagtcccagacagcagtggccccgagcggtatgtcccaacagtttatgcctcactgcctgattagaaagagagaaatgtattttattacctgccttttatataattaaatagtatcccctttagacggtgtattgtttttcaagtttctgtcttattttccccattaagtctttttgtcactgaacttttaccgtgagttgcccacccaaacgatccactaattttatttcgatggaaggagcacagcttcaagtgttgcatatttgccgcattgtaaatcaaattgttaccaaaatagtctctcgctctgtctttgtggcccaccttgcttcccaacattgcctgttcataattttttctgatgaaatgctaactctggttcactttccttcacttctcatttgtgttgtctttgttttgtcttgcatttgtatttgttttcttgcagagcccattagtgatctaatttctaactggtattcataaccttactccagatacaatgttcaccacttgcatattcccccactttgcctaagagaaggtgtgccagttttaccaatgtaacagcaagggtatccttaactcagtggtggcggggaacataaatattcaactctgcttcagttctggtcagtttattgcccacttaatctgagcccttccaaaagcccattctctctgtctctctgcaagtctcctaatattgttatcatgtctgtattgggtataaaacaaaatgcatgtgagaaatctataaataggctactttaaatggggaatattaaataatcatgtgttacatctctgtgaaagtttgtatgatttggtgacaaacacaaaactcatttttcttttccaccttttttgtactatctggtatttgtggtgtttgacagcatattgagtatcagtgctgatattgaaacaattggagaaattctgaagaaaatcatccctaccttggaagaggtaggctcatttttttttaaatgtatttgacaatatgaggggggaatgtttaaagtatgttgtattggggtatgatgggggaggtggagagacaatggatatgacagtttgtagcagtatcttaacctgctacataattttgtacatgcgtaatttgtttttttttttttaaaaaaaaaaacaggctggccactcctggagtaaatgtgaacttaacctgtggtcatgtgctttcatgggtttagtatgtattttatgggctttagttatcagaaagatttttaaaattagaatatttgtgggaacatgttgaaaaggagaattagttagatttagttaggattttaagactctacataattcactaggtgtatatagagaaaaatattttatgttttgaatcgtcttaatgttgaataaagcagtttctcattatttaataatatagatttaaaatatgttgtagtagctttaccaatatatgcgacaatagcctgatcacgctagacacttaacctattactcttatttttctactttcagggcctgcagttgccatcacccactgcaaccagccagctcccgctcgaatctgatgctgtggaatgcttaaatgtatgtcatagtgccattgaaccccactgaagtatggagcctggcccataggatcgattatatttttaacatagtgtgcttttcccatctctatagaaaaaggcttaaaaacatgatacatgaatggtcttacaactcactgttgaccctgctccatgctgcagtgggaattaactacatttgcaaagtgctttgcagtcatttttattatggtgttatttgaatgttaataataattttgtggtaacagcgacatgctaaatggctgcagtgtgggtatggtgttgcaggacctgaaaataaaatagttttttaaggtggtgcagaatgtcctttttgggcctggctattgaggataataagcacataactggtaaagttattgaaatataaattcaggttgctcactgcaacagtatattattgttatgcttatagcagataagtgtgtattggggaattgttgatttgagactaaaattttataattctccctccacagtaccaacactataaaggaagtgactttgactgcgagttgaggctgttgattcatcagagtctagcaggaggaattattggggtcaaaggtgctaaaatcaaagaacttcgagaggtaaaaaaaaaaaaattctgccgtattctttgctggaaagtaaattttcatatagacttgtttctgtgagcttctctcgcttcccctctcagttccctccaaagattgcttatcgcaaatgacaaaaaatgtctggcactgctagacatgttattttgtcaaaatttttataccattgcaaagccctgtgataattaatgaagtttttatattgtggggggttaattgttgaattcaaatgcaattttcactgaacctaggaaagctaattttcttctaattattattatttttttttatgatcttactacagaacactcaaaccaccatcaagcttttccaggaatgctgtcctcattccactgacagagttgttcttattggaggaaaacccgatagggttgtagagtgcataaagatcatccttgatcttatatctgaggtacttcagaacactttttgtttacatttgattttatgaaacaaagtgataaccttctgcaaaagtagcttcagagcatttagtctaatagtctttatttgccctttccctagcaattttctatcacctggcttcagccatcactttaatttaaaaatggttttgaaaaagtggagagtggtaatttgttggtggtatttctatagcctttgagcctttgaatgaatttcctatagtgttgcttgtgtctttgtaactatgctgcagggcttcctatctcaggtgcctcagtatggattacaggcttgccaagactgatctcttcagcccttgttgtgaaatgtgcattgtagtttgtcatgtgtaaaatgggagggctttgtggtttcttacgatctaagtgtaagagcaagctattacttctccctgtataggcaatagaactcacttttgtttagcatttgccaaaagtattggatttctttggaatctttactttgctacttttagcgttgacataattcctgtttctgtctctagtacctcctgatgggggaatgacttacattttgtttgatgatgatgttagaaggattggtatgaagcaggactctttttcttcagtctgtaagtttgttccatctctgtttttagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagaggggggtaagttgttttttttgttgttgttgttttttcttcccccatctatgaattattaacctgcaagaggctgcacttagtggtagacaaggtagactttgatttgatatgtgtggcatgtaagcacgtttagattacaacaagtactatgcttgcagagacctcatggcctatgacagaagagggagacctggagaccgttacgacggcatggtaagaactttggtttattaccagtgtgttgggtatgtgagggttgtcacaatgtagttcacgttttgttgaaggttatagtgattaaaaagtttttcttacaagtaaattttgtttggattactagttaaataattctgttatttgctgctggaggattacgactttattgagctttgttcccctcgattacaaaattgctgcctatatatgtaccctcttttgttttaatgtaacatgcaaattaggcatattaaaaacagctctataacaaaatacaatgcgggttcatgttaatgtttttatctctaacaggttggtttcagtgctgatgaaacttgggactctgcaatagatacatggagcccatcagaatggcagatggcttatgaaccacaggttgagtatcatagttgttcgtgtgtatatcagtgataatttaagatgcttacctgctctccagtaagttttttattcccctgaggatacttactgaaaataggatacaggaggactttggtttcctgaagagggattttatgagattaaaatacttgaatagtgaagctgggtgcagtggtgctcactcataatcccaactacaaaagagtctgaggcaggaggatcacttgagcccgagagtttgagaccagcctgggcaacatagcaagactccattttattaaatgaatttttttaaagtaccggtagtaattacaacggcaaagtaattttctatttttttctttctgtttttagggtggctccggatatggtaagttctctcctttgtgaagtcaaacattaatttcatactttttaaatgaacttactgctcattatttaaatcagattattcctatgcagggggtcgtggctcatatggtgatcttggtggacctattattactacacaagtaactattcccaaagatgtaagtatctttaatactaccaggaacattttatcacttttatgattattcctcctttctgtatattttttaattcagaaggttttaacaaaaatacacatttaggattgaggttatgttaatgggctttagtgagctgggttttcagctgtttgagtcttgtcaagtgatcagtgctattaataaaagtagttaagtaggttttgagcccttaactaactaagggaaacattagtaagtgtgacataaatacattataactcaaaccttgacaggtttagggagcgttagatcatcagttaagattctgaatgaataaaattaataacttcatgctccttgaaaatacaggtagtaaatgttaaaagtatatcgtaaacacatacttttaaaaaatcttttcagttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacaggtcagtttaagtttagctttgtgttagcttatacatactaaaacctttaaaaagcttttcttctcaattgatttttttcttttagaagccatggtgtctcaaccttttggggacctaacttctaaacattctaatagtttgccttaatttttcttctgctttcttactaaaaatgaagacattcaatactaatcttgctggaagaagccttaaccaagcaaacttctcatttctctggtgaaaactgctgccaaaaccacttgttaaaaattgtacagagcctgtagaaaatatagaagattcattggatgttggcctagttctgtgtggaagactagtgattttgttgtttttagataactaaatcgacaacaaatcacagtctgccatatggcacaggccatgcctctacaggacaaatgattggtgctgtaaaatgcagcatttcacaccttactagcattctttgtcttttctaccaaatattaacaactttcaattccgttttcttaattctgttctactaatgtccgatttactactcatcatttttcttgacacttaacattgctttaatttgtaattgctaatggtttttgaactcttctaattgtaatggacgtgtttatcattttaatttagcattgaaattgtcttgatgttgattaagatgttacgagcaaaaattctaattcgcacttttttttcttttcttttatagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtatttttttgtgtgaagtgtttttctagcatttataagtgaaagctggcaggggtggtagttgggctcataattaacgtggtaatttagcaaaatgagagcctagtcatccaattttttttttcttatagtcagccagagctttcctcattacctatgagaaattttgagtgagttacttggttcctttctctaaaatagctttagtttgatgtttgagaatatcggagataatgtaaaataactgcagagtatggttcccggctcatatttctgaagtactacttattaacctccagctgtccagaaagcttgaaaactgtttttgttttgttttgttttgttttttgagacagtgtcttgctgtttttcccaggctggagtgcagtggcataatcttggctcactgcaacctccatcttctgggcaca

SEQ ID NO: 133619 - DNA, 1940 bp, Homo sapiens
acggtcagggctgcctcgatggctttgtctcgggcagtggggggaggatgcgggggatgagacctcgggaccgcgtggtgggtgggggagggggtcggcgctcggctccgcctagtagcacgtagtcgccattacgcgggccgccatttcctgtcggatccgggtgaggagaggtgcggtgcttctgctgtcgactttcgctttttcccgtcctgttacccggctgtttttgatctcggtgccgggaggcggggaggggagggcgcgttggcgctcggccagtggagcacatacttagcggatttttgaggcctggggactagtgactgcaggacccgaagggtgaacggcaagcggcaacgttattcttacagataagccctgctgtttttgcttaaactttcttatccaactcttctcccaccacacctcagaaattgcgtgctgggccggaaggatgtcgtttcagttgtcgttaggagagcaataagtcgaccaacggtatgggagaatgggaggcataaatgtgcctcgcttgttggctctttgctgtctagccaaccttctagtagaggccgcttgtcaactcctagtcccgacaagagggaagcttaaaaaggctgtttgtagtcctatcgaccgttttggcacgtagacactttagttttcgtgttacaggcatgattgttgtgttgtactcccttaagcctaatttaaaataatccgctagtgactgttagttttcaagggctccatttgtttcgctgattaataatagactggtattgtggtagtttgggtctggtcctatattagatttttggatttatccctccggtagattgttctggttgttggatgtgttcgcaattgccgttgtatttgtaaactttagagatgtcacataagatcgcttcaagcatgagtcgaaagaaataggaaagcaattggaagttttaatataaaattagttttcccagtgaataagatgcattgtaacttttcataaatgtatgctttgtggatgacatttatcttttcagggttttgggaatgtgccgtataaaacaattcattgctgtggtgggacttaatccagtggctaaaagttattgttctaacttagcaaaaaatgaaaccaggctcccttgaattttgtattttttaggcagtcatttgaattgtgaaaccctaaaatgaagaatcaagttttagaaacagctggttttttgggttcaaatcagtattcactgtgatcggaaacaaatattcagtaataagaataaacaaaagcaaaactgatttgtgttggttcttataggctactgcagcactggggtgtcagttgttggtccgacccagaacgcttcagttctgctctgcaaggatatataataactggtacgttctagaagcaatgtcttttttttttttttttttttacagcttgctttccaataagccaaatgtactagctgctttatttttccacagattggtgtgcccgtttaataaaagaatatggaaactgaacagccagaagaaaccttccctaacactgaaaccaatggtgaatttggtgagaagaaattttagttttaacagtatttttttatcctgttaataaattgcctttttctgttaattattgccttaggagtgtgtggtgaatttttggtattactgtttatgtaattctgcgattatcagtagttacatcttagcttttatttatgaagtagaagtaactgatttgcatataaagaatttttcttgcattttgggatttcaaatcctttgaagtattttgtggcagtattttgtgtttggtgcattttactagatggaagcataacgttcaagtctgtagcaatgcctttggtcttttcaaaacatgcctaagattagcaacaagtctcttgaaacagaatggagttact

SEQ ID NO: 133620 - DNA, 1067 bp, Homo sapiens
ggaccattacaaacaacgggtttccgaagcgtgggcccggcccagcggacgcagacggcccgcacttaccgcgccgcagctcgtcccacagcccacagaccacagcccggggcggggtaaggggcttcgggcacgagtgtgggctgtgaaaacacgggcataagtctgggccgagcaccgacctgggcgtcccgcattttcctcgcgcaacatcggtccctgggcagcgcaactgtaaggacaggaaccgccgcggcgcgctcccagttccttttttacctcttcccgcccgatttgccgcgcgctcgcgcccctcctccaaccccaaaggactccttcggggctggaaaacgccccttccccgccccctccctgtgcgcgtgaactaggcagttgttagatctcgcgagaggttcgccccctagccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggtaattggagttattggagcttgggtattgctgattcgggtaagggttggggctccctgaaaggctgcgtttacttttcccaagcccgggttttctcgagcccttagtggcctcccagcccgaagggaggcgctggcgggaggcggggttgtcgcctcctccgtcgccttgattgacgtggcctcgggccaatcgcttcgccctcgcaccatcgctgaagccctggcagccaatagggcgcgacggcggggaggacgcgagaaggcgggggaggggagcctgcgctcgttttctgtctagctccgaccggctgaggcggcgcggcagcggagggacggcagtctcgcgcggtgaggagccgggttgggggagcggctcgtggaggtgagggtcggagcccagtttttccgcttgagggaggcgtcctgggagccgctttggtgtttggccgcttctccgagtgggaacgttgcccggtgtcccctcccccacctcc

SEQ ID NO: 133621 - DNA, 2096 bp, Homo sapiens
agtgttgacattttatagatgaaaaaactggttacagaagttgagaattttatattaggtcacatatcttgtaacttgacagagccagctttcaaacctaggtatagctgtctcaaaccttttgattttctcattttaccatctgattatgtgtagtgtttcaatttcgaccatgtaagatgctgaagagtgaaaaatctaaagggtgtgcctgtctgtgcattgtagagaattacagaagctgtattcaaatatactgaattatctaaatttttttgttttttgttttcaggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggaattcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgct

SEQ ID NO: 133622 - DNA, 1052 bp, Homo sapiens
tccctactttgaagttttgggtatacaaaaagttctttgctgactttgtccctttcttccttttaggttggatggatcatgctagttactacgggatcatctcctattgaatctgtagttgcttctggcaatatatttgttggacaagtaagttgtaatatcaacagaacaaaacatctgttgaaatggatcgtctctttccaaaaagccaaataagaaaataacacaatgttcttttagtgtagagaaaatggtgtcaaaataagaaacccccagtattggcaatgtccggattccagggggagaagagagagagacagagagagagagagagagagacagagagagagacagagagacagagagacacagagagaaattccttttaacagtctgggtatggtatgtagaattgggttcttgagaatgtttatgaagaggatggaaggttgtcattttattaaggcatagacatagagcttctcatatagattctcaataaatctgaatttagtgattgtgaggtttctggtcaactcttcagaggctggtagctcttccacttgaatggatttcactatctcgaaatctccaagctacaaacagcctcccattctaaactataatgcctgtggcaatggaggagaccaagaaagcctttccaccaacaaccatgcaactgcgtaaatacttgagcttattctcaacttgtctgaactggccaatattctgtctttgctgagcctgaagaaaaatgcttttaggtttttctcttctcatcaaaaataagcttttagacttcaattttcacctccctgttccatcacatggagaaacgctcttttgcctgaagcccatttaagcaaataaatatcatgccaaggagtgtccctcaaaatagcagcatggctaaggggtggatcagtaagaaattgtaataagcccctcatcactccagatatgcagcttcaggcagaatggagtcacacgccacgaaaaccaggtatgaacgcttgccagcaccactgcccaaggaaactgaatttgaagca

SEQ ID NO: 133623 - DNA, 1051 bp, Homo sapiens
ctttttttagaggatggaaaattaattttacagggaaaacttgtataaatttcttgttacataaaaaatgccttggagcagtgatttaatgatttaaaaccatttgctctgaagtttaaacttatgtattggataatatgccagtgttgtattttgtgtggtctcctatagatagacactatttaaaagtgtctaaatgggaatgctgtgaagaaggtttagtggtgtcttagttgtgctggagagtaggtcaggtggattttctttatctgtatggtctgttagaattatgggtaatgttgctaatattgctatttacttgaaagggaatgtttcagtagcaataagttgcccagcatacactgacatctgggatagagcagatctatttctgatgtttcctcttttccctttgttggtgcctgtgaacatttctaagccagaaatgaacagggaggagtggtggtaaattggggcttaaaataactcaaaaaacctcgtcctggttcctgcttggccagctgatccttgatgtttcttcaggggaggaaagatctttcattctccaattataaataaagcttgggagagggaccaccccacagtgattttaattcatcctgtggggtggttctcaaacttgactgtgtgccaaaaactcctataggacttgagaaaacacagattcctgggctacccctagagtttctgctttagcaggcctagtgttcacctgacagctggcatttctaacagtttctggagaatactgatcctgcttgccctggttgttgtgttctctacacaacagtgtagggaatcactgttctctacaataaacatgggctgccaggcccccttcagaatgtgacaagatgttggtagagacatcgcaaaccaaactcacccacagctttgcacacattttgggatccccatatctcaactgcacccaggcccaggctaggcggctgctctgtgtgtgccgcaccctaccatggcatttggcggttctcatgtttatcaggtgctttccttccttagaggcact

SEQ ID NO: 133624 - DNA, 1020 bp, Homo sapiens
gccactgcactccagcctgggcaacaagagtgaaactctgtctcaataataataataataataataattacaaaaagactaaagggctaagtttaaaaaatacatagagtaaaaaactagtgaaataaatatttagaaatatgtttaccaccttagagcaggaaagatcttcctaagcaagacacaacttaaatggaaaagatggacagatttgcttttataaaaaggtaaatctctttggttaccaaaagacactatcaaaaagtcaaaagactagaagaaaatatgagccacaaatatcatgaataaataaatatatatatataattggcaaagtatatctataactcaacaataaaaataaacattactcttatttttcacatgataaagatatttacattcattattaatcaatgtatcatttaaactcaaatagccaaaagattgataatattcagtatagatcagagtaagaaatgaaagggtatccttacatactgttagtgggagactaaattggaaaggcatttatgcaaggtaatctattcacatttaaacatatatatctttcctcctagcaatacatttccaagtatctatctttatacagaagatattatttgaaaattacttgaaataattttctgaaaacttggtaaaaacataaatgtccattaaaagaagaaaagtcaaataaatcataatttgtcaataatattaacaacattacatatttatagagcaattactaagtgtcagaaacattcccaagtggtttatatatataagctcagtttgtcttcataacaaccctatgggttaggtattagtattgtcccattacagacggaaataccgaggcaagagaggatgagatatttgctcaaagtcacatagctcgtaagaggcagagccaggtttcagatccaagtagcctgatatcagacaactgggaaatactattaaatggaatgtagtagatagctaggtactgataaagaaaaatccgcaaggcaa

SEQ ID NO: 133625 - DNA, 1032 bp, Homo sapiens
tataaaggaaacaggtttaacggacccacagttgcacagggctgaggtctcacaattgtggtggaagatgaaggaagagcaaagagacttcttacatgacagtgtgcaagagagagcttgtgtaggggaactgctctttataaaaaaaaaacctcagatcgtgtgagacttattcactatcacgagaacagcatgggacagacccacccccatgattcaattgcctcccatcaggtccctttcaagacacatgagaattatgggagatgcaattcaagatgatatttgggtggggacatagccaaaccatatcactctgacaagatgcatgctacctgcaaattaacagtaaacagattcactgggaatgccaactaaatagaaaataccttctattgataacttagaggcaatattttctggagatgaccgcacatttgaaggtatagtcagggatatttagtgttggctccagatgcagtatttcatatgtcaacagtaaagagactgtggctacacaatagagaaaaagattacatcattacacaccataataataaaggatctcaccagaagtgcagggcagacttttgtagtgagtgtgtgattgtatataatggttttgtaacaaggtggtagatattaaagctggaggggaggctcagatgattctctgtcctgtactattataatatttctggtctttatgcaattttcatttacaggcaatccaggaagcaagtgcaggaaaggctcagttgggtggttgactatactcaagtcttgccaggacttctaaagttgacaaccacaaccataaatagaaacaccacttcattctcaacattctccctccccacagcaccctcaccccttaagtcacctcccccttccttccttacactgtcgctgaagacagagatgactcttctgcttcaatccaggatattaatgtctacaaaagacttaaagaattgaaatagagatcaggtcactagctcactggctcattctctctctcattctctttgt

SEQ ID NO: 133626 - DNA, 1067 bp, Homo sapiens
caaagcaaacttaacattattgatttttgagagcccatgccaatgaatgggattatccaagactatagcccttattttccattcttaggtttccattatgcaagtctgtacacagcagatccatcttttcaaacatgctggttttctggtaatatctgagttagtgtctctgagtttgctaacccataagcattttaggtgatgggaaataaatcagactagaataaatatgtactattgagcaatttgtaaagagaaagagctatatgacagtaatgaagaattaagaagaatcgaattcccagatatttgggggaaaagaggtagaagacactgtttcacaacatgcaggaccagaggagagagagacgtagtatggggaaatatgtgggaagaagataggagatcccaaaaggtgacagccaatcaactattttccaaaatatagagagattaagaaggggagatgaagcactgtgacactcagtcattcctaggctaaatgtgtgagacagaaaaccatattttaggagatttggataattagatctccactatcaccatcaccaatggtgattcaagaaagattaattcagacaaagacggcaaagtactattaataatttgtcaggaggacaataaacagaaaaatcaagtgctcttttctctctgcaaatacatggcctcaaaaatcttgagtcttaaaatcttagtttcatccttatcttttcagccaaaaggaatgctatgcaaaaagcatggatgggttctacttaatgtttaaccattgtgaggaggaaaaataaaattctcacaatgtctttgttcactctgaaaatgcatcagctgagttttcagtgtcatttttctcccaatagcaactaagatctcaagaagagaaaattttactcaaattatattagccttgcaattaatgatataatatcccaggccttagagtagattagactgtataaaaggaatcaggctgaagatgagaagaatttcaagaaaaagtcaagacataagtcaaagtctgggtcctatccctttctagtctcaagtgg

SEQ ID NO: 133627 - DNA, 1050 bp, Homo sapiens
aggtcttgcaaaaaagagtttctacaaacaaacctcttgcatgatcaaactacctttactgtcgaaaaattgctaattatgactgttttgcaatggcttgctagagacagctcgtacttctttgtctaattttcaggacttttttgagctggctgacttcatggtgggaatgtttacaccgcggaaatcagcaaacattacaaattaggaccccaaccccactgtatccttgagtactagttcctgaacatttctcagcatactattgtcatatgctgtgtaaaactattcgtttttccttctccaaactctcttgttctttgagagctgagaaacactctgagtcaaagaagaaatctgttctacaatatttctgaaagtttcaggctctttgtggacacccagagcaaagggaaattaactgttttgcatgataacccatttagggacaacaagactactgtattagaaaatgattattaaccccaatttatctctgcttttcttcctactactattttccaatcttgtaaacatccgttagagtttctccagagttctctgaacggtgtcacatctctcatcttgagaataagaggaggttctgtactaaaatgggacaaccaacactaggaagagctaccagtgactctactatttatgatgcacaaccccacttgtttcctttctataacttctcttttcctgtaaggggcttaactgaatgcccagactggaagtttcccctcaaagtttctgatagaaacaaccatgagtacaatctaggtattaggaaatatatcttccatggccaccagaaaatatttattggtcctaaaacccaatgataaagatgttctaatacctattaggaggagacagttctctctagcacttctgtatatctcacaaagaaaggtactgactgccctttgttttggattatcttttcaaagatgtttgtatagtgaacagccttccaaaataaagtgtctccaaaacaaagagcaggcataattactgtccattttaaaagattcagattcccta

SEQ ID NO: 133628 - DNA, 1096 bp, Homo sapiens
ttacagcctgctaatattagactgagttatttgaacttgatctaacccagtggcagtcccacctcccatcacaccccagtcttccaacctccatctcctcatgctgccaagtcttctttctatagcatacacttaattagggtactcctccatgcgaagtctttgggataaattctgtccatactgtcaactccctagcccccttcatgccctgcccccacaacccagcagtctcttctcccaattctctacccccgttctctgctcaagccaaaccagactcctagcaaatgtatgaatgccacacattttcttacactttcacatcttgggacataaaatttctacctggaatccatccctctctcttctccatgctctttccccaactctcacactctgcaaatcccaaagcctccttcaatgcccatctctgaggaccattttctaggcacctttcaaactctatttaaagtatccactgacttcacattttccctccaaagtgtcattccctgggaaataggaccatctaacccaatgcctgatacagacacatatctgaaagtgaataaaattaagttgaaatccctgacagtagatactaacccttcagggatgaatctgactcaggaaatgtctgagaattattcagagccaagtcaagtaaagaacgtgagtgatcaagctgggtaaccctgtttagagtccaaaaccatttcaacaaaatatacattgcaatacagacacaaaaatgtgatacagatacaaaaatacattgtgataaagagcactgtcaagaagggaaagtcaatccctagacacacaaaatgtcccttcacaggtcacccttcacagttcttctaaataaacatctgtgagaggcaatgtcattaagagcatttgttgcattatattttaggggtctctcatgctgggaggtgggacagcgagaggacattcacagtaggagaacagcctatttcttatcaaagaaacaagttctggaatatctactggaagcttcagtagtttctcttgatctctcatatgtgagaagtattgtatattacacttcttacatttggggaagtca

SEQ ID NO: 133629 - DNA, 1151 bp, Homo sapiens
ttttgccttataaccacacttctttctccacatgtacatatagcaggctcacctcaaacatgtaatgtgaatagtaaatacattcatcagatttagaatatagatcctctgtcttccaactatcatgggtgatcaaaatagccagactggtacagcctatttcagcaaatagttggtttttacctatgacgcaagttttggttttgaatttaccattcctgttgtttaagggcctgtgtgatggagggtgggaggaggagtgaggaacaatcctttaaaggacttctgtgatatgatttgcatttttaaatcactgctaacatcatctgttcagaggtctcaggggaagtacaataagaggataaagaaggtgctttctctagtgaaatgcatgaacttgaattaaatagaatttatgactctctggtttctctctgtagttcccaacctcctagagaaaatgaattctactgtataaatgggttcaccaaaaacactttataaatgttcagttctcaaggaaactaaattgcgagaagaaaaaaacactcactaaggatataaataaaccccctaaggacttatttttccctattgatctaaattaaaatgttaataactcagatggatggttttctagtattttgacttgtactggctattagacacttttgtcatcatatgtgggcatgaattagttgaccaacattaatttattaaacatcttctgccctcaccccctcaggagatgtcactaaagggaacagagtccttagctggcaccttgcatgtgtgtaccactaaataagtatttgttgagtgtgcagcatgtgaatgaagagttttaaataagcacagagaaaatcgatgtctgaatggaggtcctctgtctctcctttcttcatacacgtacccaaatgtacacaggcacactcatgtgtcctcaaagagtgactatcaaactctacccctgtaacatgcataatctaatttcacttccaccacagcaccatgaagaaagagtaccattcccattgtccagaagatggaaagccagcaaagaaaggtgaggactggaactagagttaacaataacatacagtttcaaatagctgggaggaagatattgaacattcccactatgaagaaat

SEQ ID NO: 133630 - DNA, 1050 bp, Homo sapiens
actccatctcacaaaaaaaaagaagaaagagatggatatgatgccatctctgccctcgaggaagccttccacgtgatagtggggatcaggcaaatgcaccaggctgtggtgattgttgtctttcttggtatcatcatctatgttccagggtctgtttctggtgctttatgtgaaataactcatttaatttctataacagccatgtgaagcaagtttcattaccatcctcattttagggataaggtaaccaaggctaacagagatgttaagaactcttcccaagatgaaatacccggatggtggtatggacagtgttatgggctcagttgtgtccttcctcctctctctgtatccatatgccgaagtcctaatcccaggaccttggaaaatgactctatttggatattgaatctttaaagaggtaattaaattaaaatgaggtcattaacatgggccccaatccaatgactggtctccttataacaagaggaaattaggacacagataggtacagagagaagaacatgtgaagacacagaaagaggatgaccttctacaagccaagcagggaggcctcagaaaaaaaccaaccctgctgacaccttgatattggccttctagactccagaattatgagtggccggacgtggtggctcacacctgtaattgcagaactttgggaggctgaggctcatggatcacctgaggtcaggagatcgagaccagcctggtcaggagttcacgagttagtgaaacctcgtctctactaaaaatacaaaaattagccgggcatggcgatgaacacctgtagtcccagctactgaggcgggggtgcgggggctgaagcaggagaatcgcttgaaccctggaggcggaggttgcagtgagccgagatcacaccattgaactccagcctgggcgacaagagggaaactccgtctaaaaaataaaaataaaaacaaggaaataagtttctgttgttgaagccacccatctgtgttatgtcagcctcagcaaactcacacagacaggattcagacacagactggc

SEQ ID NO: 133631 - DNA, 1038 bp, Homo sapiens
ggccttccatgtcattgtaagactttggcttttacttggaggaaaatggggagctattgcaggcttttgaggggaggaggcatatgatctgacttatgctttaacaggatcagtctggttcccacgttgagactcaagaaaggacagaagagttcacaggaagactaggtaggagcccataacaggaatccaggtgagagatgatggtggctcagacctaggtgggagccatgtgttgtgagaaggggtgagattttggatatatatcgaaggtagagaatgctgttctttgatgaattagatgagaaaaatgagttaggaataactccaaggtttttggcccgagtcactggaaagatggagtttgcatcatttgagatggaaaggttgcagttggaatgggttttgtggggaagagccaaagttcaggtttggacatgctcagtttgaggagcccaccaggtaaccaagcaacgttgttgaataggctgttgaatatatcagtctaaagttccaaagaaagaatgaagctggaaataaaaatttggaaattgttggcatagagagcatgtcctatgtgccagatatcatgctaggtgctaggaatacacggtgaataagattaacgcgaggtcttgtgcaaagttttccaaactatgctttccaaccatggttctgcataggttaatgagtattctgaggggggaaaaaagctctatagtcaaataaattgcagaaatgttatgtgtcactctttggattcataatgcatatgaacattttaaaggctttgagaagttctgcactaaagaaatctgtttaaatgcgtttaacccagatttccccaaatttatttttcattgcgtttttaattcccttttgtaggcatgtgtattaccctctgaagataacaaatttggaaatcctgaactggcacaattgataatgcaaataactaattatgttgtgatgtgacaagggtctcaagtgagatgttcactaagttttattgaagacaaatgtaatatatttctactt

SEQ ID NO: 133632 - DNA, 1176 bp, Homo sapiens
tcattcctgcttacaacttgggtcaagaatttcagggcttcttcgttcagtcgtagaactgctcatgggtaaatgctgggattaggacttgaatttattttagagataaaggctcagaactaaaaacagtactctctctgtggttaagtggctttgtggtataattcaaaggaaattatgcatttggaacatgcctgggatggtaattttagaacgcggatatgtccgtcagtccctttcttgttccatagaatgcagtagctttaaagactggctgatatctggaaaacagaaaagatccttccaggcttctgaagatagctgtgtggcattgcttctagccttgtttattgtcttttggtcctaatgctgaaggcttagtgagttttgctgagagccctttgctgcgtgtgtagttaaagcattcttaattgattcaacagatgaccgcggtccattctcagtgcctcccctttctctttcttgaagctttgctcatatctgatttgctctgtggtttgagtttcagacaaatattttggaaatatgtcatgagaagaactacatgttctaatatttaaaatttagattgtagtttctttcaaaatattaatattttctcagttgagtaaatcattacaaatttgcttctatgtatttattttggttcttagtcagaaatttcaaactcagtttagcaggttttgtttgactccaaatagcaaggggataaggaaaaattactgtaacaggcatgcccttcccaggttagggtgcaaatggcttcaagcccagtccttcccacctccgtacatcacctgggtacccacatctagaaggaaatacagagacactggtccccttcaggttcctaatgcaatcttgtttggttggagatctgtgaatgtctggaggggagatgcctggtcttctttggtcctacatggctatgctaactacaaagtgaggccacagctgctcggatgacagaggcctcagtgagctgggcccaagtgtggagtccttgccttccagaacagtcccagtgctcaggtggctgctccctcatggtagctcatcttcattgatcagctcctctgccccgcctccctcctgtggaaggatttttggctgaatttccagaaatatttagcttacagatcttccaaatcttta

SEQ ID NO: 133633 - DNA, 1022 bp, Homo sapiens
tactcgggaggctgaggcaggagaataacttgaaccagggaatcagaggttgcagtgagctgagatcacgccactgcactccagcctggcgacagagtgagactccatctcaaaaaaaaaaaaaaaagactgtattttgaaccccaatcttccttactctatagcttaatttctctcaaccagattattctgcctttaatagagccagtgattgatgcctctgcaacatgtaacattaactgtacagcataaatttcccatttagaaatatatagcactctagtttttgaaaagtcacaaatatgattcatttaatatatatgcataagtgttctattaagcaattctaactcagatcttttcatggtttaatatggcagatgaaattatttgaaacatgtattttcgaaaaactttttgtgctattttttatagtcacaacattaaatttacaaatttaccccagtgataaattcggttattaataatattgcctatagcttttagtctactttagaacatcataaaaaccagtactgataccatcagtaatacatattcatctgcgctggctaatagatttgaaaaattagctacagatggtttcgtgtttatgaatatccatgcacattttctagtagttaatgaggatcaattttggatgcttgaatatgtgcctgacaggtatatgggatgcagaacaggtatggaaatctatgtctcagtttccatgttctcccttgttccagttccattattaatcacttaataagtagtatcactcagtaactctgggcctagcgctgtgaagagctttacttgaaggtcaagcacagacacagttcctaccctcaagggctttacagtagagttggacagataaggtgaagtcctagaataagtacctcacatggatcatatagagaagatgatgtgttgtaggaatttgaagtttgaagagatcaccaagggctaagaaggtcaggaaaggtcttatggacacagagggtgagcaggatttg

SEQ ID NO: 133634 - DNA, 1027 bp, Homo sapiens
gggattacgggcacccgtcaccacgcccagcttatttttgtatttttagtagagacagggtttcaccacgttggccaggatggtctcgatctcttgacctcgtgatccacccgccttggcctcccaaagtgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgt

SEQ ID NO: 133635 - DNA, 1031 bp, Homo sapiens
aatcatcaatcatttcttcaatgcttcctgattccttttggtggaaaacggtatttatatgtaagcctcggtgctagtagttatttattgcttttgtgatgttactgctcccaagttctcttggtagacagagctatagaatatatttaagtatttacatacatgaatttatatatatgtacacacatgcatatacatgcatgctcaaataaagacagacataacctaaaaattctgagttcacagtgatatgttccattctgattctacacctaagggttaagtctagtttttaaattaaatgtctaattcccttccttaacagtgagaaacctggctgtcattatcttgaatatttttttcttacttgatcaacctgcctgtgtgtaactaatcttctgtctcactgctctctctcggatgccttcctcaccctgcttaggctccaacaatccaaagggagggagctttttaaaaattatttttgtaatctcagtgtctttcatgtagtagctattcattgaccaattatgttctattaatgagtcattgtgtttaggtatttattgcaacctatcatgggcagagtgttgagctagaatctctgcaaaagtagaagaaatgggaaatgagagctcacgtcctgaggggagtcgatagtatgatggaaaaagcacagtttatgtttgtgaagtggcatgatagtgttataaaagagtacaaaaataacagttaaaaattacatagacatttgaagaaaaagagtgactgagtgaaggctggatttatctgagagagtttttcccaaatcattaggttttagggtagggcttgaaagataatagtagatgaggtttggtaaagaaatagcagctgaacgtgaaggaaacaaagttagcaatggaaaatacagtagcctccttatccttggcttcactttctgtggtttcagttaaccgtggtcaaatgcagtccaaaaacattaaatggaaaattccagaaataaacaattcataaattttaaattgcat

SEQ ID NO: 133636 - DNA, 1059 bp, Homo sapiens
acatctcttaaacttgttagctgataagtgtgtgagtctcataatattttagtctttttcaccctcaacaatatttttatcttactgagttttaggctgtcagtattctttatttttattgtctatgaactaattcagaaacatgtataacctttctaaaacttacaaattaaaaggtcaaatgaaggttctaatgaagtcaggtcatatttcctagaatatttgggagttggccaaactatttaaaccaaaaagttgaaaaatttaaaaataactgtaaagtcatgtgcttcatgtagagtaagtaacagttgttaaagttcattttcttcagttaccgtgtgccataggaactcacttagtctggtcactgaaaagcagttttaaaatactttctcttgaattgatatcagctgtaatctacacctacaacttatataggtgcaagaattttgccttttttagggatttatttgtatctgaaaaataaatgataaagaaggagtatattaatttgtaggccatttttatggttttatgtgataacatttaacttttggtaaaccttatattacttactgagaaactattttttaaaaaagatagggaggttaagataaaatactctttttgctttagtagacaaaatttgaaatgagcattctgaattgacatggatcataggaatttatttgaccactacttcattggcttagatttgattctttttttgacagttacctttatttgctttttactgatcaatttctcttatcatacagtagaagtatctataaagtaatgttcaaatgtacatattggagccttgattttaatactataatatttcaacattagcatacgaagtagtggattacaagaaatactaacaagctcttgttaaaatacagtttgtcacatgaattctacaagtaacgtcacaaagtgttactgtattttttccccctagtgtgatggtgaaaatagtttgcatcatagtgaaagagaatagacattttagaaattgtcttttaggacagtttcctttgtgacttaaaa

SEQ ID NO: 133637 - DNA, 1138 bp, Homo sapiens
tgtcattttccatataatactgtaggtatacagtagaggaagtaagagtttatttatatggggaagaagaatttctttgacaacatctaccaaagtgaaaaagagaaagtagtcctggcttttaatagaatttctatagtattttcttatcagtttattacttttttgagaaaaaaaacgaagattctttatttatatgtaaaattcttatttgaaacaagtgttttaagagaattttcaaggaattatattagtttcattatccttgatataaatttattaatggtatatgtcatagggtacactattatgattttatttttaaaatatgtagttattaaaacaagttgacacaacatatcaaaatggattatttagaaacctcctttaaaatgttgaaaagtctaagactaagtctaggacttatgagtaagaaagctaagtaaaagcagtggtccaatacccttttcccattccatttgaaattaccgacagacttttacaggagaaaatctgtaccaaatctgaaaactgggtaagaggggcatggaacaaatacagaacattcaagagatgtggtggagctgtgagtaaatgcaggagcagcatcaagcctccactccctcttctaggaatgcattatcttctgctaaagttgaggtgccattagcaccagtttggagggacaatcaggaagcagttggaatccctttctttcctacatcaacataggattatgggggttaaatggtggttctcactggtggaaagctggtgagtcttccctgtgctgcggccagtagtaacaccaggaaggaggtgggataggccccagcaagttctttatttagtgtctggattgacggatagagaaagccgacctctagtgcagtaaattcaccaaacacgggaacaaacaagaaattatatttttcttttagttcctttgatgcctgcttctcagaccaatgagtcactggactagaaatgcatatttacattgactgacaagccttcctgattcagatgggagaggagggttctaatagcaagtgtatagatactaggaaaatactctcattctgttttccattattccttcctcctcctcctccttcctccccccatgtttcccagg

SEQ ID NO: 133638 - DNA, 1036 bp, Homo sapiens
attgaaagtagatgtcacttcattagtacctggggacttaagctttttttccttcacatctcctaaatctaagccacagactactttttgaattattgttgcttgtagtattctttgtggaaatatgaagactggaaaaatatatgaggaagtataaattatttatactgagaaattttaattaattaactacaaactatgcatttcaataaatctaacattttaaaattcttttgtaacattaatttactctggcttataagtgttatagaatttcagaaatttctttgtggtaaagttctaaaaataactcttaaataacatttggtaaaaatttacaaatgactttgcaccaaacttgactatatcttttaatctactggaaataataagaaacatacacaatgggtgttgccatctgaaagaactgggttcatatcccagctttccagtgttgaaaaataaacatcaacagaaaaaaatgttctattttaggattagaaactgtcagaagtacttttatttggtttaaacagttgtaaacaactaccagtagggagaaagagtttctgaaagtactctaagatttttacaattttgaataaagaattagctgtagaaaggaaggtcttatgagttcattgtaagtgattgcatgtaagttattatattagttttctagggctgtcataacaaagtccaatactgagtggctcaaaacaacagaaatttattgttttatagttccagaggctggaagtccaaaatcaacttgtcagcagggccatgctccctctgaaacctggaagggagcatccttccttgcttcttcctagcttctggtggtttgctggcaatctttggtgttcctaggcttgcagccatagcatttcggtttttgcctccatcatcacatggcactctccccttttgtgtttgtcttcacattgtcttctctctccttataacagcaccagtctgttgtattaagggcccacctactccagtatgaccttgccttaactagttacatctg

SEQ ID NO: 133639 - DNA, 1102 bp, Homo sapiens
ctcctgtctcagcctcctgagtagctgggattacaggcacctgccaccacacccagctaatttttgtatttttagtagagatggggtttcaccatgttggccaggctggtgtcaaactcctgtcctcaggtgatccacctgccttggccccccaaagtgctgggataacaggcatgagccaccatgcccagccatgattaactttttgaattcacagtagttattctactttttggtgatgccaaaaaattctgctacagtaagcattggtatttaaaagatatttagagtattttagggttaatagttgcaaaataaacttgaagatttataaaaattgtgtgaatcgagatttaaggttgtttaaacatatataatgtctaaaaatgaaaactattgtttgagggaagatgtgcatagaagcttttactaatttgaaaatgttcttatatggaaataacacatattgactagtatttgactactgtgtgaatggtgtacagtaagtgcactaatcacaggatgctgtgattggtttatgtattttaaggaggagtattagaacagaaagcataatttgaactgtctcaaaagatcttaacattaggttgcaaatgacattatgttaggtttctgcgtttttgtagctccggattttgataagtttcctggctgattataggtatttttatagtcatacattgcattctgaagcgacccagtagaagcacatagaactcaaatgttctctttttgtttccggtgttatcttgtgttgcccataatgaaaactttccattgtatggcttctgtgatatctaatatatagaaaaaagagttataagtttttaatatcattaacatttttcttttagattatctgcaattatgaaatgaagtaactcaagatgagcaagttaaaagtgataccagaaaaaaggtactgtaattctgaatatcagtatgcataagttacagaaataatgtatgacagaattacttgaaactcaatacttgacaaagtattatttgtgtttaagtataatatgttatatttatgtaattaaaaatgtttattaatgtttaacttttcagttaaaat

SEQ ID NO: 133640 - DNA, 1019 bp, Homo sapiens
ctcccggcgaggttctgcctgggtccgggccggctctggcccgggagaggtcccagcgagctctggccagatgaagggctaccttgattgacttcggtagctgccgcatggggtcctgggctgcgagaggggaccctgaatagtgccttggtcttttgtggctattattgaaagttggaagctctggagttgttcttttcgggccagaggtgagatggtttgtgatttttcttcttaaacagtaggaaggcaaaatgtttatgggccctggtaggtggtgggctaatagtaagcagcaggagtgttaattgacgtgcgatttgattgcattaaggttattctttgcagtactgtccttagactcagaagagttctgctttaaagagtttagttaagacttcatcctatgctgaaacaaacacccatttctgcaaatactcttgccctgaaagctacatcctctctcttacatcagtattaattttacaggcataatggttatgaaagcttctgtagatgatgacgattcaggatgggagctcagtatgccagaaaaaatggagaaaagcaatacaaactgggtggacattacccaagattttgaagaagcttgtcgaggtgagtctgatttttggattagaagttcagcatctggaaggggtagaatgacgattgtgctttctaaacttacctcattagatgaaatcaacaggtaaatgtggtttgttgagtttgttagccacacttattctgtatcctctaattttaactttaaagcaaatgtatatttgatacagcattaaatacagatgttgaggcagtattttaaaattgaatttttcttgctttaacaggttagagagagcagtaatttctaactgtggaaaacactttgttaatctaaaagataatagtatttttgtatgtttgaggtttcagtatgatcagatcacatcattccttgtttaagattgtccagtggcttcctgttgcaggtagaataaaatccaccctccttc

SEQ ID NO: 133641 - DNA, 1170 bp, Homo sapiens
aaagcaggctaaggggatataaaatggtggatggtgctgtcttagaatgcatggggaaaatctctatttgaggaattgacattagaacagaggctggaatataagggatgaaaccttgtaaatattttgaagaaaatcattttggtgtgggagccgtgagaggagaacgtgtttggtatgtttgaatgacaagaaagacctgtcagactgcagtgcagtgaatgtgaagtggtaggaaataaagttggcgagggagaccgggccatgtgatgtagggccatagaggccatggtggacttagggattttgctatgaggtagaaaactattgaaaggttttgaataggaaatgacatgatgtgacttattttcagacaatccttctgccttctggtggtatataaattatagcagggactagtgtggtaggtgggggagttgtctggaggtggttacaagagtgagcaatagtggtgacttaaactagagagagctgtgaaagggtgaaaagtagttagactagaatctgaagatagagcctacagtgttttctggtagatttgatacaggatgtagaaaaacgagaggagtagaggccaggttttcagcctgagcaactctagataggtagtagtgccatttagtggtatggtaaacactaggaagtaggcgtcaagctcctttttggagatgtaaaatttgagaatcctgtttgatgtccaagtagagacagactataaaagagaataagcttatatagctctgtaatatgatgagtgttttttttttttaaggatttgatcatgtaagtcataaaatacacctgagttctttgagaccaaggacattgggtttattttcttactgtttgtggggtatagtacctcacttgaatttgatgctcactgtttttttttttaagaatccagaaattgtgctgtagctccatccccttttgaaactattgttctgttattttaggattctatctacattttttttttgaggcagagtctcactctgtcgcccaggctggattgcagtggctcgatctctgctcactgcagcctccacctcctgcgttcaagtgattctcctgccccagcctcccaaatagctgggattacagatacatgccaccatgcctggctaatttttttgtatttttagt

SEQ ID NO: 133642 - DNA, 1032 bp, Homo sapiens
tatttactgttcacctgtgaatgtgagactactttgtgagaattattactgtgcgatattttcttaagcattacccttatatggcaagtgaacgtattaaattgcctaaggacaagcaattgaaagtaaggacagagacaacatttgaatatggtgttttaagtgtatgccttcaagaaaagcttgtgtgtatcctagcaatatttagacaagcaggatgacctcccatttctctttgtttattaaatagtgattttgtaagagaaatataaagaaaagttttatattttgccgctatttaaggttttttgctattcatgagcctgattatttcctttttgtataggaagattttcagtcaatgacttatggatttaaaatggctaacagtgtgacagatcttcgagttacaggtaaaattatttttaaagttaattcacaagttttacattttcatatgtttccttttaaaacttattgtttctttttctaggcatgctaaaagatgtggaggatgacatgcaaagaagagtaaaggtatatatgttttctgtttggtgtggggttttggtacacttctaaatgtcagtttaactttacctaattaaaaatgtgtagaaccacctttctcctgtatgtgctttgtattttttttttgtaatgaatttgaacactgctagaggagtttctgataaattaatgtcattttcaaattttagtatatgtgctgccgaagcgagcacaaattaatgtcattttcaagtacagccatccctcagtattctcagggcactggttccaggacccctgtgaataccaaaactcaaggatgctcaagtctcttatatacaatggtgtgatatttgcatataacctgttcatgtccttctgtatactttaaatcatcactagattacttataatatttaatatgtaaatgctatgtaaatagttgtactgtacttttaaaatttgaattttttaatgttattttaaaatttttttctgaatactttcaatcagcggttggtt

SEQ ID NO: 133643 - DNA, 1050 bp, Homo sapiens
gatcttcctgtagtaccaccctggtatttggtcaaataaaattgtccactataacatttgtattaagaaattgtgtattttagtgtaaaatggatcggtattgaccattgaactttattttttcataatgtgatttttgtgaaggttacagtttttttctaacagggttagttttgagagcatcaggaatttcaattaatatctccttttaaaggaaaatatactatgtgccatatacttctgcttatgttatttcattgttttgcttttgctgtttgaatacttaattcttttccatgatctttataatttatgtcaaaatgacctttctgtgtataggattaataggaggaatgtaaatactagacacggctttttttccccaactattttccccaaaaacagattcttgtgtatacttaaaaaatcagtgtttttccttatgtatttgtaatgtaatattttttcaggtttgtgtttaattcaccttttttaaaattttagagtactcgaagtcgacaaggagaagaaagagatccagaagttgaactagaagtaattgaacttattttctggtagataatatcagagaagtctacctgttaatgttgtagttttatgaactgcgttataatttatggaagccctttttaaggtatttctttaaaaattggacattgcaagggattttatttcccttgtatttattttgatagaatgataatacagctctttcaaatagatgatttcaaaactcttcagtattcctgtgaggtaggaagaaaaatacgatctttcacagatgatgcaccagagcgccacagtatcaaaagttgctgaacctttgtcgagattctaaattttctgactctgcttaaagcacattttaatcagtcctttttaaaatgcagataacatcagttttttgaggtaatagtgtaaattttgacttaggacaagatcagtgctgttgatatagaaacttcacattccgatttcaaaagaataggctttgttttgttttctgcagctcatttttcaggcttttaa

SEQ ID NO: 133644 - DNA, 1402 bp, Homo sapiens
tcctttcacgggctttgcatcttttaacttttagtcctttcttgtttttttagcaccaacaatgtttagcagtattcagcagagtgaaatttactcgtgtgttactgacagtgcttatagcctttactaagaaagaggtaagggcattcaatataatatgtctatttgttttagtgattttggctggaattcctgagtgaagcagttctgaaacttctcccttgaagtgctcctgatcccagatatacagaactcagcatttggtatatttataccagtgtaacactgatgactttctcaagaaatcacatgaattttgttttattttttacttatttgtaaataatacattagaagctgaaattacttgtaggttgttatattttgtgaattgaaaaggagaaagtaaaattttaggtaggcctagtcttaccttcagttacataattaactgttgggtttgtatagaaccaaaagcaagccctagatggtgaatattttttcctttttgtatttttgcactaattcaagtcaattacagattaatttgtgaataatttataagtggtgaatagggatccaatttttaccactaatttaatttctgtaattctatttcttcccattttttttttcctaccttgatgaatgacatggtagaattgttgaaaattttttcattttctagttgattgcttctttggtttttattgtgaaaaaaaaaaccaaaaatattttctattattttaattgatcctacaagttatagatgtgagtaaaaaaaccattttctatcctaacaggatctggacatcctgtattaagtgcatagtttatgaaaaccaatgtcattacagcaagcatttaatttcattattgtttataggattttcctatttaatgtatatctttcagtgaaagaatatgtaagaatgtttttggtgatttatttgctagaccagtgctgttgcagaagctcaaaaattgatggttcaagcagcagatcttctttctgccattcataattcattgcatcatggcatccaggcccagaatgatactacaaaaggaggtaattgttcaatttgctcctactctttcttttcttcgtttctatccaaaatatttagtgcttagcttgtactaaagttttttcaagtcagtcttgtaccttgggatgttttaatccagagacttacagtgtttaggctcttctctgtaaatatatactagactaaaaaacaatactgtagaacttggccgtttcctgtatattactatttagacttggaatatgtatcctgtcttatgtccatgctgtgatgttacagtctggcagcttcttcttgctgcccagaaaagccagcgcaatgagaacagcagagaaagagtttaattatca

SEQ ID NO: 133645 - DNA, 1366 bp, Homo sapiens
attacatctctgttccaaatgcattttgggctcattgagggttgagggcagtgctgctctgctctgctattcaggattattatatagctaagtttgaatggattctactgtttagtaattgaggggaagagaagcttatattatttgtgttcccattttacctttcttcacaatctcatggttaatgtatcatttcctctgttttgaaagaatatactgaccctattttatcctcagagttttttctttgagttcattttgacatagaaactcccctccatcaccactatcaccaccatgtaggtaggaggtacagttttaggttattaaatctacttgtttagtttttaaaaaatgtatatgtatagatatattctaaattataaaatctatttagaggattttgtggttagaatttgtttggaaaagctttttaaactggcatttttatatttaataacatttgcagtttaaaattcagagaaaagttgaaaaattttactttcatttttttctttttagatcatccaattatgatgggttttgaaccccttgtgaaccagaggctacttccacctaccttccctcgatatgcaaaaataattaaaagggaagaaatggtgaactattttgcaagattaatagatagaataaaaactgtctgtgaggttgtgaatttaacaaatttacattgtatcctggtaagtacaaatctctgttccagaatgtaacttccatttaaaaaaaattgatacataataattgtacatatttatgtggtaactttggtttaacaacagaataattgattgctttatagacattgaccaagggtaaatactactctttgtctattttctgtgatagctagaggattaagtggttcataaatactatacatacatactgtttaatcctcaaaagcttttacactattttagagattaagaagccgatgttgaagggttagataattcatccaagatttgttttgagacaggatctcactctgttgtctaggcaggagtacagtggtgtgatcttggctcaaagtgaacttaaactcttttttttttttaattttttttgtggagatgggggccttgatctgtcacctacattggagtgcagtggcatgatctcagctcactgcagcctggaccttctcggctcaagcaatccttctgcctctcagcctcccaagaagctgggaccacaggcgtgtgccaccatgcccaacaatgttttagtttaatcattatttttgtagagatggggtctcactatgttacccaggctggtgttgaactcctgggttcaagcagtcctcctacttctgcctcccaaaatgctgggattgcaggtg

SEQ ID NO: 133646 - DNA, 1021 bp, Homo sapiens
agtcatttggaggacatatgacactctggccatttgagttaccatagttcttgcctaggttctttctcatctctgtgtgtggatgttcctttaactgcagtgtagattgagtacagtcaatagacttcttttctggatgttttcactgggccgaggctttctgtagggtctttatttgaagctgacttcttgtctctggtttcaaagtggggtatgttagtgaggtacttttggtgttgaagctttggtgacacttaggcttattgatcacttggtagactcttgctcaaaaacctgtatcttttggtctttccctatagtcagcaacaatcagtaatgtgcatccagttgacttgattacttggaatttatttctgtgaaataggaactaaagttctgccatgacttagtaaattattattggtattatttttatggtatacaaatttaatattggtatccacacaattctatgattggtcagtttttttaaggaaagtttttagagtctagaattatccattgtcccttttatataattaaataatttctatagaaatgacctttatttgtcatattttaactctggtactatgtcatttccagaaggtctagtaaaaattacagtctgatgaagtgtttttagcttttatttaatctattaatgacattgctttttctttatatatctgttaggattttttctgtgaatttagtgaacagtcaccatgtgttctttcaagatctctgttacaagtaagttccacttagtatcaaaatacttatttaaacattatatgtgtattgacattgttttattgattgattgaacaaaaggtagatgcttttaaaggattttccagttagtgttgtgtattttttttttaattgaagtattaactttaagcattagacatccatcaagatcatatcctaggtcataaaacaaacctcagtgatttaaaaacaatcaaaatcctacaaagtatctttcttatcattttagaattaaactagtaac

SEQ ID NO: 133647 - DNA, 1033 bp, Homo sapiens
ggtataggtgatttataaccaatggtgaggagtggggatacagaaaaaattaggatcctgtatagtattttctttgtgattattattaggagcacagtccatgaggaaatcaattgtagggaaatatgtgacactgaagtagggtcatgaaaaagtagagctttagacttttccttttctctttgctaatttgatcttactggatccaactctgattgttcaaatatagacctataggaattggaaatatcacagatttattgtgtgaattacataataattgtaaaatatttcttaatctaatactgaaattctttaacttaggtatcggttccattttctcttttattcaccttctctgtcatttggtagcatctgcagtaattgctgctgcttttgtttgggctgaatagattttaatgatgtgactgttatcttgcaggtgctacctatataataatcaccaggctaaggactgtatcgactcctttgttactcactgtgttcgggtaagagctacaatttggattgtcataatgggtactttaaaaatcatgggctgtggccgggcacggtggctcactttgggaggctgaggcaggtggatcacctgaggtcaggagtttgagaccagcctggccaacatagtgaaaccccatctctactaaaaatacaaaaatcagcgtatggtggcgcacgcctgtagtgccagctactcaggagcctgaggtgggaaaatcgcttgaacccaggaggtttcagtgaaccaagatcgtgccactgcactgcagcctgggggacagagtgagactttgtctcaataaccataataataataataataataataaattgctggactgcaattccttcagtgtctgtgctttttttcatctaatatttcttgtttactttcagtgaataaataaaaactgtctcctcctaacacttgagtggatggttttatatcctaaggtcttctgataggttattagctacagaggcagccttggatgacctcccactgcagcct

SEQ ID NO: 133648 - DNA, 1046 bp, Homo sapiens
tccatatgaaattataggccttattatgttatgaaatgcatatatatttttatatatatatatatctcgtagatttgaagacttttctggcttagcagtgttaaagttctgaaaaattagtgtctggtagagaatgttctgttttatatttcatttattaaataaactcaagtaaattgtaaatgtgaatgttcttaatttttaagaatgattttatataatgccgataattttttatctttttctgattttatttgctttgtgattaaaagaaaatatttatagactgaactgaactgtgttctgatataataaaaacttaatgggcattcatttgatttgcatatgtacatgtataattatcaagaaatcttctggaaagttgtaaaatgtagaaagggaaaattaatccttatgttcatttcttgtaagatctaatctattatctaatgaatgatctgtttttaaagacctaaagcattatttgaaatatctatcgttaatatatgtgttgataaagctgtctcatttagacatctaccattaactaacattttgtatcctttaaggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaaggtgctgtggattatttttaaacttaagaacagagtgtactttaatttctacagataaatagatggagagctactcgtgagttggtcattatattttagttcttgttcctcttttcagaaactataaggtagagactgagtcccagtatcaatgacataagctttttggttcctttctttgctttcatttctttgctgttctgtgtatcagagaatctttgatcaagaagtagccacgtggagtgtgcaagcaagatatcggtgagggaacaagacagcaggaggccagtgacctattgacagagccagatagctcaggagggcagtagttctggagctgt

SEQ ID NO: 133649 - DNA, 1055 bp, Homo sapiens
gaggtgatataaatatctgctttgtataaatttagaagtcaatgcaaagacaaattacaactcaaaatcataaagaaggataagcataagatccagactgatctgattcatagctcaaaatgtaagcattgaaacatttctgttttaatcagtagtttgttaaaggggccaggcgtggtggctcacacctgtaatctcagcactttgggaggccgaggtgggtggatcaccttaggtcaggagtttgagaccagcctggccaacatggtgaaatcccatttgtactaacaatacaaaaaattagccaggcgtggtgcatgcctgtctgtaatcccagctactggggaggctgaggcaggagaatcatttgaacccgggaggcggaggttgcagggagccgagattgtgccattgcactccagcctgggtgacgagcgaaactccatctcaaaaaagaattattaaaatgtaactaagtcttacataagtatgaaaaatgaccgggtcagttatcaccggaacaaccttattccacttgaccatttaaaataaaggctactgcttttgaaaactctgagatatcaaaataaacttggaaaaaaattgtttcaggcttttggtattttaataatttaccatatccctaattttattgaaatacatttattttctaaaagttactgtaacgtgtacatactgttttgggaagtatatcttgggaccgcttccatagaggcgtagcttagcagtgtttgtcaaaaatcattaatgcttagagtcagcaattctgctttttgggatttatatagagacatgaacacatataggaagtgagagtgacgaatataagagtattcattgcagcaggatttctaatagcaaaaagtaggaagaaacagtagtatccatcaacaggggactaataaattatgatacattcatacagtggaatactgtgcagccttaagaaggatgaggaagatctttatgtactgtgatggaatgctccttatgatttaagaaatctaaaaagaaaggtgcagtttaatatgcat

SEQ ID NO: 133650 - DNA, 1139 bp, Homo sapiens
atcattctaaaaattttagttcagcagcaaaaaattagagcttgccattttgtcttgagatgtgtattttgttgagttaaaatttctaaagtctgcctatacgttttccatctccttgctgtgtaaattactgaataacttggggtaaaaaaagaaaatttatgtaaagaaattttatgggagaagtatgaggtatttaaaagtcatctgcctttgggaaagtgaatgctttaataatgaaagacttctttgtaatggctcagaagaggaagagtctaagcttttcttggtaatgttatatcatccatgctacgtcatcatttcagagcagagattctgcgctgtggagaggccagccgcggaggcaccgtgggggcatttgcctgtgtgtgttgtgcaccttttcttccattgtttcctgtgatctgccttcctcctctcctgccctggtttcctactgactgactctcatctcattgcttagttctatcagttacctggagctaaaaagtgtgctgacccctgatctaactgaatgcctttcctataatttttgactatttatcttttaactgttctttgaagatagaaaacagctggtcagcctgttttcttatgatcttcataaaactcaaaaacaaattaatcgtttttcttccaggttagttcctaccttttttgtcattaacctagtttttaaaatctattttgtgctgccttgtttctaagaacacaagaaactctaaaataaaaatagtctttgttttgtgtaccatctgaatatttgtagatacattaattgagtttcgtttttctttaacaggttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacaga

SEQ ID NO: 133651 - DNA, 1377 bp, Homo sapiens
tttgccaaatgtccatgctcattctgttttcctctttgctttttcttttgattctttgtttcttgtcttgcctatttcctaccattcctttgcctttttttgtttaaagcattcagtaattaccagccagaaacagttttcattctcaacaaagtaactacatcagtaacaggtatactctttgtctctccataattgaagtttctattgtacaggctacttaaaaaataattttttttaagatttttcggttctgaaatttcaggacacctaatggctgttcttgaataacacaagtattaccgctcttggaaaggagagccaagagggctcattagctgcaaagaggggcaacaggaacacccttagcaagttcagtcaggttagctgctttaaagtactgccagaaaagtttcactatactatcatgtttttatgaaaggtaccaaatcagagttaagatatttgaagctgagaacccttttaaccacagaccaaatataaaactgtcactagtcttaggctaagccaccaaagccaatttacaccacagagtaactcattttgctaagagtattgcctgctacagaggacaaaaaggaaggcccaagaggcctagaaagctgccaccgcaaacatcagagcagacacaggacaagcaggaaaggaaggggagggcctctggcagcaggcacttgcaagcacagggggatgtagtcagtttttcaaagccagaggatactgaacagacacccatttgaaaatgtttcatgggttaaactgaatatgaagtaaacaaaaagtacaccacatttaaacctagtcctaaattttaatctatatacatttctatctgcctcctttttgcatgtcaccagcaaacaatgtataatcttttaaaagtgctaaaaggattttttttacacatctgtattcttacagatatataatttgtgatgtcatgacacataaaaatcacaattttcatgtaatttagaggccctcccaaaaatcccttctaaatgtattttaccaaaatctcatacaagtgtttaattaatcccttgatttgaaacttcttttggataacgtttttggaactactcaaatgttaaagagcatacaccttcttcagttcttaacatggacaaagacctactgtttttcatctccagcagtgcattttttttttgtcaagaaatttattaacctttataaacactattttcactcaatcattcataaaaaatgatttgtgattaaatctgtaataaaaccatataacgttcatcaatgcattcaataagaccagtttcttccatggaacataataaaccactttaaaacagcagttttcattcatgtcatataaggctg

SEQ ID NO: 133652 - DNA, 1635 bp, Homo sapiens
gtcttggaaaatgcaacatttgggcaagaagacaggagtccttgttctcattaggtccatgggcacaagcctgagggtggagcccttgccagtgaccctgcccttctctacccagcacttccctgtccccctcccatatcaccgttgccatcttgtccttgatgaggaatacaactcccaattacagtgttgctgtgggagatgcagtcctctttatgacagtttctagaagttgataagaaaatgggacctgcctagggctagtatctcatttaatactctatagaatattatgtgtttttcctttttagtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggc

SEQ ID NO: 133653 - DNA, 1383 bp, Homo sapiens
gcctctcaccatgctctgctccaggtcagcccccttttggcctgtttgttttgtcaaaaacctaatctgcttcttgcttttcttggtaatatatatttagggaagatgttgctttgcccacacacgaagcaaagtaaataaagaccacaaatgttcaaattctaagccacttaatagcgttttgtacattaaaaatgacaagggttattatacaagtagccttttaaaaaattctcacacagaacagctttgtatttagacttaaagctgttgctactttgctagtgacgtttgtgttaacagtcagtgctctaggccattgattgattgattgtcagaatcagaagtgactacacaagagcattagccagacttttcagtgagaacaggtaacaggctggcaccagcacttggtacagcacgtggacaggacgacggaacccagagttctctgtctctccttcacagcagatggactcttctataggtggctgttaatttacacaaagttatattccagaatcaggaagccccgctgtcgccaacacttgaaggagaactatgttccagttttggtgttgaacttctcacgaaatacctactaccaaaaattgtgacaccttattagacacttccaaagtaccccccaaaagctgtttaaaagaccattccattttttcctacacaaagtgcatactaaaatttcacaataatcatcttcagatgtacattttatttagtacatttcacagttttcagtattcagtccctcatgaacattttatagtcatctcttcggccctgttgtgaaatatgtgattccagttcaattcagagtgtatgattccgcttttcacgctgatcaagtaaatttatggtgtctcttttctgatcttcaacattaaaaactaaaaaggaaaaacacataatattctatagagtattaaatgagatactagccctaggcaggtcccattttcttatcaacttctagaaactgtcataaagaggactgcatctcccacagcaacactgtaattgggagttgtattcctcatcaaggacaagatggcaacggtgatatgggagggggacagggaagtgctgggtagagaagggcagggtcactggcaagggctccaccctcaggcttgtgcccatggacctaatgagaacaaggactcctgtcttcttgcccaaatgttgcattttccaagaccactctggcctgccatgccacccattctgtgcctataaaaaccctgagaccccagcgggcacacacacaagcggctggacgtcaagaggaacacactggcagaagaacacatcgaaagacgctggcaggccattgatggtggaacgattcggacgccaagggaa

SEQ ID NO: 133654 - DNA, 1031 bp, Homo sapiens
ttgtctgagtgttttatgtaggcatgattgattacaccatcggccacagggttgaactcaatctccactcctcccttccctggaggaggtggagctgaaagttccaactttccagtcatgtggctagttcctctggcagtcagcctctgtcctgaaactatctgacgcccatccttccccacctccaagacccccttattagtataaactcaagtatggtccagaggggcttgtgaatcgccagatatccactcaggaacttccaaggcttttaagagctctgtgccagtagccagggacaaagaccaatacatattttttttattattctacagattgtatgttaaaaaaaaattttctgcctaatcagtaaagttcactgttttagaacaatgggatgatgatttttagtgtgtttcttttggtcatttaattgttgaacacacacccgtgttgccctgtcttaagtgccctcttcagatgaagtgcctgaagcaggaagagggtctgtgtctcttatggaagtggatgtcaccgtccagcagagacacagtcatagacgtcaggcccttcctttgctttctttcaccaaaggagccagtgcatcaatcagatgaaggaggtgaaggaacagtgtgaggagcgaatagaagaggtcaccaaaaaggggaatgaagctgtagcttccagagacctgagtgaaaacaacgaccagagacagcaggtaactggggaatttttgccaagagtttctagaaggtacccctatcttcaggcattttgtttcttttatgtgccgcctggctttctctggattctgccctcctttgcgggcttggctccctgagatataacagagcagaacctggtactgggatgactggaccctaaccaagggttctgacctccagccccgcttcacaagctcagggctttacgggaattatcgtatttaaagctcgcagccagcctgggagagagttgctgttttcctgacttgaggaccccagccccatgggaggggttaagtt

SEQ ID NO: 133655 - DNA, 1047 bp, Homo sapiens
taggaaagcttgggccgaggcgatgggtggacacctctgagctgggctggagacacatgtaggatgcactccttttgctcctggcaggttgatacctagattgaaagctctttctggctgactgtgcctatttcactacttgtgcccaaggccgtgtaccagatatgcagtgcttcccagggataatgttcgtggagtgttggaagcaaaaaaaagctagttattcttcactttctttggattataggcccttttagagaatctgataaaaagtacgaacactttgttagcaaacttataaatggacacctgcctaaagtgtgcaatttgtgcaaattatatgggcctctgaaacatatctgcacgccctcccttaaaacatcctgtctggtctaatccttctatagaaggcagtgccgagaacacaaaagctgatggagaggccaggtttcctgatgtacaaggtagtgttctttccgtttgaatcagtcagcacacatcccactttttactctcctacacctgtggcaggcatcactaagcaatcactgcactccatccgaaaatagccttgcgttctttctccctgaagcacctggagtcagcacatgagatgaaccgctcgccatctcatctccctgctatgaggagacagtttccaatgttgacactggcatataaagtaatacagtgatggtcggtgccctgggtgatgggatcacctgccctgatagatccttgtacttgaacacattccatcagtggtactctggccatcaattgcaccagttagaataatcactagtggccaagtcctgtattcctctccaatttagctccagttagtgctggaatatttgccacttacatgtaagaaaaagccaacctaagtcctcaggaagaaacactgtcacaatctgcatgacctttgtctcagaattgaggatggaggtagtttgttcctggctctcaagttggaacatggaaagccccagttgatctgcaaggctgtgagataaaggctcttcgtacttgattttagcaggg

SEQ ID NO: 133656 - DNA, 1096 bp, Homo sapiens
agagtgcagtggtacgatctcagctcactgcaacctctgcctccctggttcaagtgattctcctgcctcagcctcccgagtagctgggattatgggcacgtgccaccacacctggttaatttttgtatttttagtagagatggggtttcaccttgttggctaggctggtctcgcacacctgacctcaagtgatctgctcgtcttcgcctctcaaagtgctgggattacaggtgtgagctactgtgcccggccagcctcttattttttaatttttaaatttaaaaaattacattacttgcattatatttaaaacatccgtatagctcctaattgtcttaaaaattaccattttggattatttccttctaaaaggctcatctgtagtttagcttgttgctgggtgtgaattgtcaaattgcattctgaaaggatttgagccatctgtgtggtcaccagcaacctgggagaatcagttgcctcacgtgcattgcgttcttcggcatttccatgttcctccaaaacattgtccacctgccgtaatatcttcctactaactttataaccacatacaactgaaaacatgaagccccaagtacacgtctctgtagaggacatgagcagccagtcaatagaagggaaatgtgattgtcacttgtgtgtggaatcttattcagctatgccagtggttctcacgtgggggcagtcttgtccccagtaggcctttggcaatgtttggagacatttttgtctgtcatggcttacaaggaggctgctactggcatctagtgggtagaggtcagggacactgctaaacatcctataatccacaagacagcttcccacagtcacgttttatctggcctaaaacatatacagtgctaaggttgagaaaccttgagttaggctcataattaaagaattgcatttagacagaaatgaagtacctcagtcttattattcatccttaaagaaaccttaatgcaaatatttccctcatatagattgaaacacaaaaagccataaatggcctcacttgataaatgttggccgagaaggttttgacctagctggcaatcagtcaggatccagtgacagg

SEQ ID NO: 133657 - DNA, 1047 bp, Homo sapiens
atgtcctccagtttcagaagaaccagaccaacctggagaggaagttctcctacgacctgtgagtacacctcagagcgcgtgccacagtgcagggtgcacggcacctgggaggcggggattaagctgagatgtaacctccgatagagcatgcaccttctgctccgtgcgggactctgagaaaggcacgggcccctctaggattcatgtcctacacaaatgcacaaggaggccagctctcagcaggaaatgaatttctcagcatgccttaaaatgtaacttaaaactctgtaaggcacaggtgtactggttaagtcaacaacataaagctttaaaaatgtgtttcataggtgctcatgcgtgagctaaatcaaattcgttgactaaaagacattttggcaaaatattgatatagtaatagtttattgcctggcgatcacattgtggacattgttttcttcagacttttcagtgattttcccaatttttacagtgagaatggaatactttgataatcaaaaccaagcaatattaaactattaaaaagtgagctaagccccgcaggaagatagtaaaagccagtttgcaagccagaggataaagttgtgtttattttttcctcataaaaacaatatagctaacgtgtgggaagtttgggattcagagagaaccaaccacccatggcccagccctcatgactgtccttttccctttgacttacctctctccagtccatgcccaagttcacatgaatgtttacttaattgcagtcatcatcaaaaaaatttaatcatttttttacttgcgttatgtacgtgtgtgtgtgtgtgtgtgtatatactttttttttttttttcttgagcggagtctcgctgtcccccatgctggagtgcagtggcacaatctcagctcactgcaacctccatctcccaagttcaagcagttctcatgcctcagcctcctgagtagctgggactacaggtgcccaccaccacacccagctaatgtttgtatttttttagtcgagatggagtttcaccatgtcagcca

SEQ ID NO: 133658 - DNA, 1149 bp, Homo sapiens
tttaattcattcttttatgttgttaacacaggctgattaataatttgggtctgggccaggcatggtggctgatacctgtaatcccagcactttgggaggccaaggccggtggatcacttgaggtcaggagttcagtcagcatggcgaaatgccgtctctactaaaaatacaaaaattagctgggtgtggtggtgcatgcctgtaatcccagctacttgggaggctaaggcaggagaatgacttgaacctgggaggcagaggttgcagtgagctgagaccatgccaagcactctagcctgggtgacagcgagactccatctaaataataataataatagtaataataataatttgggtctgaagacttccaaagatcctgggtcccctcttggctaactgctgttcagtggccagtagtggccacaaaggcttgggggtggcatcacctgccctctgaaatgcttggggaagagtctgggagaccctgaattacttactagcacttcgtgaagggaaaggcacatcttcctgctattgtgttcatttttgcttgccaaaagttcagtcacaaatagcttcattttcagcatttgcacttgtaacattctcgctcggctggtttctcgcagctgcacatccactttgacatttatactttttacttatttgttaaaatatgtgcattaatattgcagaggtgcaaaggtaatgttttagcaacagttcctttgtcatgaaaatagagttcttgtatctttcctgaaggggagcaactgagttaaaacaaaaagattgctgagtggaagaacagaggtgttggtgacttgcttatcgttttgtgtccagaagaagaaaagcttaaagaggcagtgggaaagtgcagggggcgctcagcctcactgttgtcatgcttgcctgtgtgacctgtacccatgtccaggtggtttcagggagctgcccggtttctcctcttgcacagtaacttggggtacgaggaggctctgaggtgtttacagtgcttttctcttgtaaagagctggttcatggagtgcgttcttgagtgtcttctgagcctgggatggggtcacttccctcaaatacaacagcatttgtttatgagtgacttttgctgaaagattttgcctcttc

SEQ ID NO: 133659 - DNA, 1049 bp, Homo sapiens
tcagcttccacgggagttcctgttctctgggcagatgaggtctgcttgtctggagttggagaactgaatctgttttcagaaattgtatctgctaaagagttgttaagtgctttgttagcagcgaagaagaactaaatatttgagcatcatcttatgccaggtaaagcatgaggcattctgtgcacttagcacatttaagcctcacaaaaacccagtgggaagtgtggtgtgagtgcacagagccttccttcacttacactgacagagaccattttttccagaagaaaccgctccagcttctgtccagttgacttaaaacacagccttgggcacttgtgtgtataagactggtgctggccctgggccccaaggtggtctttgtggagggcgctcaggtggtccaggctcctcaggtaacttggcatcagccctaatgccacggtctccttgtagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcaaggcctgctttgtttcctctcagttcttttctaagggatggtgtctacattgtctgtttcttcttggcgggaggatgagcaagcggctgggtttagatttatgtaattatgtggaaagagcctattgatcaagctttgggcattctctccctttcccctccaagtccctggctgggcttgcggtgaagccttttgcagtggtaataaacaggagaaatgcagaagaacaatttcagattcatcctcctattggcttttttttttctcctattgggttttttcttcccactttccacaaacatgtattaaatacctactctgtgccaggcctatgccaggtgcttatatctcagagaaaaataatatttgtgccctccaagtatctaatggaggagaggagaggcagactctac

SEQ ID NO: 133660 - DNA, 1026 bp, Homo sapiens
cattgctgcttacagaaatgattaattctcaaactatgccgggaaggtgagtatggtaatgattttacaagggaggaatctgaagtgtaagaggaatcatgtcttgccccaggtctcgagctaatctgtggcaggtttcggggcggtgcctgctcctccgagcctgtcctgggaactggccacactgccctgggttcacagcaccatgggctctgtgcgtgccgttcacatactcttctcccttgacagctttgcacgtcaaggagaagctaccagcccacgcttcttggcaagactcctttcctcttggttgtaaggatgatacggtctgcttcggagatgataaaactagtattgatgtttatttatttgcttttacttggcagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccaggtgttttgttttctttattgttatgtttattttatgtttatgttttgtttattttgttatgatggggtcccaggggtttgttgtttattgccagccagggcgttttgtgcagggcacacgcttgtaaggtgagtttagggctctgcacacccccacagccctgggccagaccccaagcagctttgggtgggagaggtcccctctgtggttgtgtaggattgcggttgtggtatccctccctgcctttcctgtgagttaacagcattcatttgagctactggggtggttctgggaagacagcttgcttacatacactggccatagtccgttgtttgcggtcctccggcgcccaagatatcgaagagtagtattggaagtgtgcttggatgatgggtgtaagaaatatgtttttaaaggtaccaatctttatcttcattacttaatgataataataattttaacttcctcatttaccggtgcagtcatgggt

SEQ ID NO: 133661 - DNA, 1161 bp, Homo sapiens
cagcacctacttttgtgtagaagcttcatttatatccatgtgactaaaagggctcaccaatgtgattcctccttgaactgatggaaattttcccttcaaaataaattccagcttttatcactgtttgcaaatgttagtactctagaatttccagccatcagatacatagatatccactgtatgtacatctatgattattgaaggcagtagggaaaatccaacaagggagaaagctgaacaagcgtggaaaatgagaccaggagaagaagtgaacagctttgtatttggatggagaagaaaacagcaaatgctgacattcgtcaaaataagacagagactagggttgcaacgaagttgcagtgagatgaaggtggccgcaccggttgtagatggttgagatggtccctggaagtggcaaggcttgagcaaggctgggagatagcagcagaacctcgatgtgcagcctcagtccggggcaaacgggcttccccaacaccccggctggttggatctctggctttgcatcctttctgatgtggttttcttctttgcataccttttgccatcactgatttactgacatctacattaagaagttggccctggagtgaattctgaaaatgactacatacttcttgaataaagaagataggactgtcagtagaagaatttcaaagctctaagggaccatccttttattttacactgtgatatggtttggctgtgtccccatccaaaatctcattttgaattgtaataatccccatgtgtcaagggtggaaccaggtggaggtaattgttctcgtgacagtgaatgagttcccatgagatctgatggttttataaggggcttcccccttcgcttgtctctcattcttctccttcctgctgccatgtgaagaaggacatatttgcttccactttcaacatgattgtaagtttcctgaggcctccccagccctgtggaattgtgagtcaattaaacctcttttctttataaattacccattctcaggcagttctttatagcagcgtgagaatagactaatatatattgttattaatttggagaactctatgaaatgggtaggatttcacccactcatagctaagttgttaaaactagaccctttggttcatgtttaaaaacgtttccaacag

SEQ ID NO: 133662 - DNA, 1035 bp, Homo sapiens
tcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaattttatctacattattttctagtgaaagattcctaaatttcctggggaaaaaaaaaaaaga

SEQ ID NO: 133663 - DNA, 1778 bp, Homo sapiens
ttcaaaaataatcagctgcttcttcctctctcaaaattatgctgctctctcttgtttcttcagatatattgctcctttgtccacacaatatactgagtggagcttctgtcacaccaacagacagtctctctgtgaaagtttgaaaacagggctactgctttcaatttaaagtaggaacaaaaagtgctaatttcttttttaggaatgtctaaatcagattgtatgtttggatcgccctcacctgtcccattgaaaccaactggtttatttgttcaggtaaacctagctcaaacggagaaggaggcgtgtctgtcatctgttcactcaggagctgctccctgagtgctctcagctctgcaccatgtccttgcgctgtgctggcagtgcgggccctccttcctctggctgacctgcagcactcctgtctgtcctgcgcgggtgtggtgcgtggtgaggcttactgggcaccggatggcggggccttgtttcagaactcctgcccatggtcttgcttttcagttaacttgcaaaattctgccacccacatgccttatttcagctctccttggatatggtttcggttttaaggctgtttcagatgctcttcctttcgattttgtaaaccagtctatttcattttttaggcagtgcttttacatgaagacaaaaagaaacaaaaaacaacaatatttttgagtccccagtcaggtatgtgggttttaaaaaaaacaaatgtgtgttattttatttactgcatactttaccacatgccttttgagactttttctccaaatatgtgcttttaacagggattggacatcagaatcacttgggggaactttaaaacatatagttgcccatcctctacctttatttcctaaagctaattcttcagtggttaagcatgggcctgtgtgttttgtaaattccaagtgatgtttataccacccatgagtggcaaccagagtcttcaattatttgttccagtcccgtgctttttgttgctgctgtcttgccagcagtgttttctcctcctggagagtatttgccacacacaaagtaaggaaaaaaactaatctctagcctgaactccactgttacctctcagctacttcatttattcattctttcaacaaatagctatccagcctctcccctccctttccaagttcaggacaccagcctcaacactgaagatacagcagtgaacaagcaaagccccttctctcatttactctgcatccttttcagaagaggtagacaataaagagatacagaaataatatgtcatgtggtggcaaatgctaggaagaaataacaaaacaagaaaagggaaagagaatggttggctaaggaggcagcatctctggtaaagtaacatttaagcaaagaatcaaatgaaacaaaggggccagtcgggggaaattggtgttagactggtaaactcagagatggaaacaggtgttgtcctgcagcatcactgaggcagtgtggcaggagtggaacaggattggaaactcgagagacagaagaaatttgaaaaaaaaaaaaaagtggagcaggcagaagggtgagtgagtggtagaggtgaagtcagagggtggatagatctgggttatgaagcgccttcagcagtggtaggtaccgtttttgttggtttttttctccctcaaagtgaaatgagagactattgtagggttttgagccaaggagtgatattatctgaattctgttttaaaaggttcattatggctcctgtgtggaggcagggtagctac

SEQ ID NO: 133664 - DNA, 1185 bp, Homo sapiens
ggccatcagaatagagagaaatagtaagaagttggatttaaggttgttaaattcttgttttcctctttgatgccttttttttttctggttatctgtgctagccttcataggtgcattgctgttctgccagcattcggcttgatgccagccttggccaagcccagtttgtacatatctagaatctagattttccaatctgcttgcaaaaagtagtaaatcttttgctgggactagggggttaacagtgcttcctgtagcagacagctatctcttctcatgtaacttgatactcgagtttttcaggaaccacatttattgaaaacaaagcaaaattatgtcaaaaaaataatttcagtgagagaaaaatggctagggactagatgatcttgctaagaataatattatgttcttctgcattaatttccttatactttttattcttatttttaattgacatacagtttatggagcacaacgtgatgatttgatacatgtatatggaatgatgaaatcaagttaattaacatatatatatcacctcaccattttttgtggggagacatttgagatttactcttagttatcttgaaatatacactattattgactatagtcaccctgctgcgcaatagatctcaaaacttattcctcctgtctatctgaaactttgtaccctttgaccagcaaccccctattccctctgtactcccagtgaagacttttaaaatttaacgtaagtgtattgctttataggcacattcagtgtttgattacatctgtacatctgatttatggtagatattgatgtggcttctacaccagtgcttctgaaacttgttcgaacaaatcacctgaggattttgttaaagtgcagattctgattcagcaggtctaggatcaggctcaagactgcttttccagcaagctccctggggatgctcatgttgctggcctccaccttaattttagtacaaagaggctacaggctagaccattatctttcctttgttctgttatttttccttcagcagccacaactaagcaaagtagaaacacatagttttttttcttttcttcaatataatctgtatgatgcaaatcatgtttctcaattcattatgttttagccttttcatttgatgaggagacaaagcctgtgtacctggcctcaactccctcccacat

SEQ ID NO: 133665 - DNA, 1044 bp, Homo sapiens
tgagagaagtggtgtctcctcctggtgcctccctctcgcccctgaaattcagtccagccaattcagtgatggggcttcccagggcagaagagtggaggtaagctcgataaaccacagggcctggctgagtggggaggcagagcactcagcagcagcagagcctggtgggaagatcttccttcccaagggcctgagagccacgctgataacatcttttctacctccacagtcacagagcacaatagggagaaggggtactggttctgaacagaatgggttcccttcatagagccgatgtttcagaaaatactgctttttgttcttaaactctgttttcttactccccacccccagtttttttttaagtctataaaatgcaagataaattttaccattgtttgttgtctgtttttatctgcagcaggctaatttttaaaacatgaaatatagtaacatatgaagagatggatttttctttctttcttttttttattacagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacac

SEQ ID NO: 133666 - DNA, 1048 bp, Homo sapiens
ggcatattcaaggagctaaaagaaaggttgtgtaagtatggtgaagggaccaagaaaaagaagagcaggagattaggatggctaggtaggctgggcttgactggccgaattgtgtagaccatggtaaataaagaatttggttttgacctaagggcagtaagaagtcattgagagttgtaaggatacagtttatgattttaaatggccctggctccattgcgaaacaaggattttaaaaagaagtgcaagactgactccgggaccagtaagctatctgttgcaatggtattagagtgaaaggtaatattgttagcagtttgacaaacttccagctaccactttgagacttgctgagaggcaggttaacctcaataattagttaaatcagaagttagttgtatagtaggtctcttgcccacatttgtcttcatttggtgttgatctgtctgtctttgactgacatatgcaaacaacatagtgagtaatttctttactttgatagcaatgtgcatttctcatttagaaaggaatttggggaacttcggatgactcttatatcagtgaagcaaaatcacttaggaataatttcatgtattcattgatttatttcctagatgtctcagccagatgtcctcttacttgttcaagaatgtttaaagaacagtggtaaggccaaattccacatttaaaaaatttttatgttgtctataatttggatctatcttatttctcaaactttgaaaatagcaaggcatgcttttaaaattatttatgtgggtaatatccaaagcaaatgcccatgaattattaactagagtcctgttagtagttctactatgcagaataaccatttcataagtaaagcttttagcttgatgacatcatcactatttataaagattaaatgagtcctagatgtgactaagaaatgcaaaatatgtaaaatgtactcttgagggtaaaactgaaggataatctgcttttatcaatggttaaaatcagtattttaccaacagtgaataggtgtaacccaaccctaattaatgaa

SEQ ID NO: 133667 - DNA, 1038 bp, Homo sapiens
ataagggaaaataatctcattttattatacatgtatttcctgaaaagtcagttgtaattctgatgatttttactgtaaaatttcatgtaaaaatgaatgtactttgttgtggaaaactgctaaaacccaaagaaatcacttgaattttagcaaaccttaaacaaacaagaaaaccaacccctgatgagaaaggatactattttggcatcatagtaaaacactgaaaataaatgctatactatagatagtactcatatacacacacatcttcctctgaagagtgaagtgtctgctacctatgtcagtgatattgtaattatttttcaaaagtttattgggattttgttacagcaaacgctttttgttcataatataatgagaaattcatattaaatatgtcaaaagattatttttattattgttttactaaaacctccttatagtaaattacaccaatgggtgcattctaaaaggtgaaaagaaacgtttgcattagctcttgaatatactatcaggtttataaatttaaacaaagacattctttttcaactggcacatttaaaaaaatattttaaatagtattttcttcataaaatgtgatatttagataatagtattttattcataaaatacatgataacgtagcaatttgacgttttacaactgacatgaagcgtggctgttaagctaaatcatagttgatgcagccttccctattaaattaagtgaagagcaaagagccacctatttctgtcctttgtttatgctagtcttgaatacaagtttgcttttgtgtgtaattttaattgatggttctgcttctgaaatagcagtgttttgttataacttttgagaaattctactgtatttattacttttatttatttatttattttttagattgttccctaagattatatgggtcatcctgtagcagattgggtttcaaaaattcggatgtaaacattgacatccagtttccagccattgtaagtacaaaatgaaatgctggcactttcagagtggtatggaaattct

SEQ ID NO: 133668 - DNA, 1037 bp, Homo sapiens
aaaatacataatactggtcagatgtattttactggttaatcttgtgaatttccttaagggcagcatcaggttatatgaagtcattgataggacccaggtatatgtccttatactagtattaaagcaaacaatgtttgtaagtgctgtttttaatattctttccttacactttctccttatgcccacctatcctctgttaccactgatccacattatgtgcataaggaagtatgtatatgtttgataggatgaaaactaacacagctaaaatgagaagggagggctaagaaaaagaaaactctatagggtgttgtcttcatgagtggtagaaggtcaaaactatgtgtaagtcatttttaatctcaacatttgatcttaaaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaagctcttgtgttttctatttttttgttttttgttttccctggctttccctaaggtaacaaggactttcatatgcattgtcattataaacctgtttccattataaattttaccctgtgtgtgaactttaagttgaatgccctgcattattggggcactgtgggactcttgtgtatgtatgtttccctttccgctcatctaaattgacaccatattttgagttaaaatcaagagaagtatcctgaagttattttcaggttattcatgtcaaaaaaaaaaaaaaagattttatttaactgtacttaagagaattgcagcatctaaaatgaactttgaaaactagttttaagaaatttgtattggattttgtgca

SEQ ID NO: 133669 - DNA, 1004 bp, Homo sapiens
agaattatagatatacttgccttcagagtataatttttctgttgctttgctatgctcagcagtataccaggaagagataataaaaatcaaattgtatgattgaagtagaattcttttaaattttccaaaaagatgatttctatggcttaatgtctacaggtgatgtgctcactgaatacagtattaaagcattttgtccataggacagctacctttccttctgctctgcatgcagatgtgatttattctctcacatgatttaatacatatgtaaggtctgctttttactcaggagtggcattatttaatattgccaataatatttttcccccaccttaagaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaagggtaacatccttatatatatatttgttggttagaatcctggttttagcctcaattttgttgttaattgagtatgcatgctctgatcaattagatatcctactttggttatcagtatttaagcactacaagttaaaagtgatgtccagtgtgatttaataggattaggagtcattgctattatacttaaaatgactgttagggtagtgataaagggaacaataacagtagcaattttaaaagtgaagaagaagccaggcacagtggcatgcctgtagccccagttacttgtgaggttgaggcaggaggattgcttgaactcaggagtttggggctgtagtatgctataatggtatctgtgaatagccagttcactccagccagggcaacatagtgagactcctgtctctttagagaaaagaaattgaaggggaaatcatttcctggctgattttgtttatctgaatgtttggttttacttatgt

SEQ ID NO: 133670 - DNA, 1025 bp, Homo sapiens
gttttttaatagagatagggtttctccctgttggccaggctggtcttgaactcctgacctcaagtgatcgacctgcctctgcttcccaaagtgctgggattacaggcgtgaactaccgcgcctggccctcagatatttttaaatttgaaaattaagagtatatattaatatcaagtagcagaaacagaatgaagtgttataaaggcgttaagtagtagggagacataaaacttaaatctttaagctagaaatagcttgaggaattatctgatgcagtactctgttgtaatatatcaaaaatggaatcacagttttacaaatcaggcagctgcagctcagagaggttaaatttccacagacctgtttatgcagcgcggtaaatgaggaagtagaactaaaattggggactctgctactctggccattaactcagcctcgctggacctgaaatcctgacggcggagccgaatatttcttgataatttctgggcttttgatttgtgtttttctttattaaaaattgtgtatatttaagtgtttctgtattactgtccaggtgggatgtgggtatttaattttgttacctatagtcttgtagaagttgatcttgaaaaccatttcattttattattattattctcttttttgagatggagtctcgctctgtagcccaggctggagtgcagtggtgcgatcttggttcactgcaacctccatctcccaggttcaagcaattctcttgcctcagcctcctgagtggctgggactacaggcacgtgccaccacacctagctaatttttgtatttttagtagagttggggttttagcatgttggccaggggtagtctcgataccctgacctcatgatctgcctgccttgacgtcccaaagtgttgggattacaggtgtgagccactgcacccggctgaaaagcattttaaaaagaaagtttatagatcaaaaatttgcaactagacattaaaaggaactgttggctgaccacaaaaacttttatatgttttct

SEQ ID NO: 133671 - DNA, 1050 bp, Homo sapiens
atacttgatatgagtaatattctactatgctacagttctggaacctatagagcttctcttattcacacatttaatcttcatgctaaatagtaagtattaattttcatgaagaatattagaggaccaagcctcccaacctctagggtaaagcactgattattaagaatgtgatagaatttttattttaaaaaaatagggagtttctttcttacaggctttggggcatctgtacgataaattgttattttgtatacttgtatgatatcttgttatatagtttgatatttccccaaaataccttctttcaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctggtaatgttttccaacttgtcagatcacaaccccagagtcagcaatgttttattctttttcatccaaatgagttttgttattttcagcaatttagtttcagtttttcacagtttctgttttaagaaatggtcacttagtgtgattattttaaggatagtaatcatgatatttgagcagctaaaacacatttc

SEQ ID NO: 133672 - DNA, 3088 bp, Homo sapiens
cccggaaagagctccccggagctctgcggaggccggggttgccgcgggcggagggggaggggacgcggggcggccgggccgcgggaaggcgggcagcgcgcggacgccgggccaggaagcggcgcgatgcgagagaccgcggcggcggtggcggcggcgaggcactgagcccaggaggaaggagccgccgcggccgcagcgcgagcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaatatggtgtagttactttccagagttacattgtggttaacccaataatgggtgaggag

SEQ ID NO: 133673 - DNA, 1049 bp, Homo sapiens
ttttgggctcaataccaactatcaaccaatctaaatgcaactttgtcatcaccaagcagaatgttagtggagctctataatgggaatattggagaggttgcctcatcacctccctaagaacttgaccatgcagtgggttaatgggggtgggcatgtgctttatttattcatttcataaataccactgactcctatttttttaatcacactgtggtgtcaaccaatctcttctgtccttcttctctgaaatgattcaaagcacgttgctgcaagtgagttattgtaaattgtctcttatttattaaaacaggattgaatacaattctgtaattacacagcagttttgttttttttttttttgaagggagacatgactttattagaaaaataaaaaacaactgaggcgaggggttggtcttcagcggatgccttggtggatgaagctgcttttggctgcactggccttctcccgctcccgccgccacacagggtccaactcaaaacagtgccatagcctcggggtctcatctgctgctgcagatgccactgtggccccatctgggctcatggtcagagtcaggacccgggatgtgtgacctttgagttcagccaccttggccatggttgggtacttccaaataaccagctggttctgtgcaaagccatggcctgagatgagctccttgtagtggggagaccagagggtggagcacacctgggaaagggcatccacggcactcagacaggccccagagcacacgttccagatgcaaatgtgtcgatcactggtgccccctcctgttgccgggacattggacttccagggacaccatgctacggccttgacagccccttgaagggtgaatgtctgcagaggaacccagccaccctctccaagagcactaggccacactttgaccaagttatcattgccaccactggccaaatgtcgtccatctgggacccagcgcagcccacacacttcctggctgtggccactcagtgtggccacgtggtgttctgctacccgaacatcatggtggtggatg

SEQ ID NO: 133674 - DNA, 1038 bp, Homo sapiens
gccaatcacagacagccaactgtacaaactgtgtttaaataaggccaagctgtaaccagtcctgctgttcctgtgcctcacttcctttttctgtccataaattctctgaccactgggcagtgccatagtctttctgaacctattctggctaggaggctgcccaattcaagaatcgttctttgctcagctaaactctgttcaaaataatttgtttaaagtttttcttttaacaccctaagctacctctgctcacatagaaatttgcatattcccctaagagaatatgatcttaaccactggaaatttagggctttggggaaggaatgttgacttatttgtcttcatatcccagggtcagtgtgatacttgtcacaaaataggtcctaacacttgggatatctgcacagtctcagtgcagatactacttagcccaggggcctgatggccaggctgattctctcctttccgttcggagtcctctgccgcaaacacgctccgccggatcatcagtcaggccaagaagcatccgagcttgatcaccctctttgtatttattggagctttgtatttattggagatactggagcagcactgtatgtcttgcgtctggcattgttcaatccaaatgttagttgggacagaaagaataacccagagccctggaacaagctgggtcccaatgattaatacaagttctactcagtgaatgtggattacagcaaactgaagaaagaaggtccatatttctaaatgaaatgtttcactatgaagctgctttagaatgaaggtcttccagaagccatcctcacaattttccacttaaccaggaaatatttatcctctgaattcatgaaatcatgttgatgtaatctattggagattacactgattaataaataactgaaacttggcaaggtgtggtggcttacaccaataatcctagcactttgggaggccggggcaggtgaatcacctgaggtcaggagtttgagacgagcctgacgcacatggtgaaaccctgcctctactaaaaataca

SEQ ID NO: 133675 - DNA, 2569 bp, Homo sapiens
agtctaatatggctatctggattcagagcatacctccattgctgtagcagctgtgattctcagtgtaaaatctttcagtttctaggtaaacaaagaatagtttctttcggggcatctaagggctgattgctgtttcctttgactgtgtattagacagagtgttttgggctctggtcaactttagtagaaaacctagttttcatacatacatttaaaactgaatttatggaatttgactgtggtgtatttacattgtgagtggagtaggcaaaaggatctttaaacaaacaaaatatgtatttacttatatgtgcattgaaatatgtattttcccatatacatctgatgtcctgatacaaagcttcctttttctccatgaaaaggaaattaaaaaacacccacatcctggattgcctaatgagaattatggaaactaagcttaactaaatttttttaaaaattcaaatgatagtgtagaatttttttaaaagttactgtaacagagtatttctctaaatatttagtatcgactgaaaacatagatgggggcctgtgcttaggaagagctctctgtatattgatgatctggtgagtaaataaggaaagctcttcaaacatcacatttcatggatatgtttaagattaaagtttaagagtgtgtgggtgaaatatttggtttaactggaattaaataactttactgtggttttcagcaagatgagtggtatttggagttttcctttgggactggaagaaaaaagcaaaaaaataaattttaatttgatttgcatagtgtggcctgatcgtttaagtgttgttagaaagagagatgactaaaattagttgagattattatattatggattaagtatattgaccttattttcattatgattttttggtaccattatgtgttatgagaaagaaatagaaaaagaggcctccctgtggttggcgaagggagtttttgatctttatttcgtgggcgtgatgatgaggggagggaggtggcttacttatttgtcactagcactttgatttgctcagtgtacatttttgtgtataacgttctccccactgtgcaaggcaaattgacaaattgtttattaaataatttgtgtgacctaggaattttaaagaaatgctctgaaaaactggaagtctgaagtttttaaaaatgaaatgtacagactcatctatcttgtataactgctattgtttttgccaaaaaatgagtgaatgattgttttttggaaaatttttcaagtcctgattttatgtctgccttggatgtagccacttcctgaaaacaagtcctaatgtaaaatggacatgtaggaagatgctgcttatatgacatcacgtgtcactgagggaagattgggagtggaggcaggagtttggtggcaggaaaatggaaatgggcagatatgtggcacaaatgcaaggtcattctaagcagtgaattactagtagaccagtatctaagatttaagactttacttggccaggcgaggtggctcacacctgtaatcccagcacttttgggaggctgaggtaggcaaatcacgaggtcaggagttcaagaccagcctggctaacatagtgaaaccctgtctctactaaaaatacaaaaaaaattatctaagatttaagactttaattggccaggcgcagtggcgcgcgcctgtagtcccagctatttgggaggctgaggcatgagaatcgcctgaacctgggaggcggaggttgcagtgaatggagatcgcgccactgccctccagcctgggtgatacagcgagactctgtctcaaaaaaaaaagaaagaaaaaaaagactttacttatatatctttagcagtcatctaaataataacgattcacttaccttataaatgtagtgagacaaagtacatagccaggaggaaagatgggtttttgaagaagtagagtacaagtattattgttaatgttattttacttttaggaaaattgaaaatgttcgtatttgtgtgtactgcctaagacttctgtaaaagctctctgtcaacggtcaggaactttatagagtattgcaactattgcagcagtccatctgcagcagtaatagagcagatgggccactggacagataccctggtccaaaacctggctctgcaacttgccagttttcttgaacaggccatttacccactctgacactcaggattttcctctatgagaggtttagtgcttttttcattgctgttgtaaaaataatctaacttgtaaaagtagttgatcagcagtagagagttaaacaaatatagatattatctgtagactggctgagacatctgggtgccccaggcaagctaataacttggccggcaagtcaatattctttaagtttctgtttaccagctttgggaggggatgccttataggaaaagggtcatggggagaagggttgctgacagcattcagcctccactatgattctgaataatgcagccctggccttgagctggcacaccctccaagcagaagcaagtccctgcagcagatgcacttgttatctttagaagggt

SEQ ID NO: 133676 - DNA, 1049 bp, Homo sapiens
gctaggctggtcttgaactcctgacctcaagtgatccgcccgtctcggcctcccaaagtgctgggattataagcgtcagcctctcgctgtgcctggccgggactttgacctggaagaaggctgagtgaccagcattgcctcccttcacattttatccacctgtgtttagacaggtcaagtggctttctccaggcagctgattaaaaggtggcaagacatggacccagaacccagggccaggcctatttcattatctgtgctatttaggatttggcagttttccatctttgaaagccagatgaagttgatatttaagagaggtgaagtaggcagccatttggcgccaatttatttcagcatctgcatggagaaaatggttagggataaatagtagacccttcatggaaggttttcatttgaagcccagccaaaggcaacagggtctgccctttgagctcagaactttcgcaggccttaacgacacactgggaccttctttccttttccaaatggcttcagccttgcagtttggaatgatgtcaacatgtggcgtagttttattcaagtcccaagttaatggtttacctttttagaaaactccaaaaacactttcattgttatttaacttttgagttatgtaatgtctaagagtcttgtctctgacccgtgcacctacctgccactgaccaacagtttctcatttccttacgcaacaactagtctggctagcttagagttggtgtgtgattgtttgagactttatgtggaagataatatttaattgttttgttctggtttgttggggtaaattatacaaatggaatgcatcctttctcggccttgaaagaggttatatgacagtacaattataataaattcagtgtatgactttgggtacattctattataaacgaatttttttaaaggtgcagttagaagaaggtggaagaaaaaagaagttgacactccgattttccacatcatctaactaaaatggatttaaactaactttctctaactattaaatctttcttaggtaagtacagttg

SEQ ID NO: 133677 - DNA, 1209 bp, Homo sapiens
gggagtgtccttctgcctttttctctgccctatgtctgggacacagggatggcagccaggcccaggagcacccagcatcctccaagcaatgaggtagcactgcttctgacttttcctcaggatctggtctttttccatgacaatgaggtggggcccaaccttctcgaaagtggcattgtttctgcacagttgtaactgctctcaggggtgtcagtgaagtaggggtgggagggaagccatgggatgctgagagaatagggccgagaggacatacctgctctccagcttggcctttgatccagacactagggacgaggctgtcactgtgggtgcctttgttagtgtttgtgtgtttgagtagtctgaaatgctgtgacttttttttgttgttgttaataaagataaggaaacaaacagaaaaaaggaaattggagcttccaaaaggaagaaggaagtcttaatatagaattgacttcttcccaggtaagttttaattgcttctcatgcttgtagaaaggtgtatcatgtgttctaataggttaggatttaattatggcttaaaattagttctataggaagagcttggagttgcacctagggagaagaagcagagggttccagaattgtgtaaacggattgatggaaaaataggcttctggtgctgagggttcaggagccttgccagcatcacaacaaggtgtgaattagcctcctcgcactctgggaggaagtggaggaactgctggggtgtgaggctgtgaaaggaccttggagagccaagtcctccctgttcagacagggacaggcacagctggagacagcagttttcagctctgtggaactcttgttctctgggttgcacttcttcctgtgataataaagaggttgaagacaggaagacaggtgcttgaaagccggaagacaaggggaaagttgtttgaagcaggtgtttaaaaatccgccactttggggggatgaattaggatatcggtaacaattttatagcctatatggtttctttttgaccctcgaagataggtgggaagtggttttctatacttcttttaaaaactgggaaaccagagcttaaagaagttaagcttgaggcagcagagttcaatgcactggtgaattgaaatgtttgtgtgtgtatacatacatacctgtgtgcgtacatacataggtatatatacatactcagtataaata

SEQ ID NO: 133678 - DNA, 1482 bp, Homo sapiens
tgctctctgcatctaggtctatcaggaaggtgagctggcaaaagatccctaaagcctttaaacatcacttaaataggtgtgtgtgcaaaattgtcttccattaacaaatatgtcaaaacacaagcctaatgttttctttggacagtttccaaacactgagcttctttctgaactgttactggccggattattgggactattcccaggtgtttatttcacatcctcctctttttgcaagtgacatttaaaatacttcttcgaagcacacacattaagccaggagaaaaatcctaggatgggaagcaatcttatggctgagaccttgtctgcgaacaattgtttgctgaccaaaatgccgaagtcattaatcctcctttctactgactttgaaatggaaaattaaatttcagaaaccttttgattgcacacatgcatcccacaatgtttcatacaccaatacatatataggtagtttgaattctgtgcaccaagccacttgcactgacactgatactaatgtactgtgagagagcagcatactttaaacacttgccgatgtgaatcagacttgagagaacttgagcgtgcgtaagcaccttgatgtcttatccatttggaagcttattgttacagtgcgttttcttttctttctttctttttttttttttttgagacaaaatttctctcttgttgcccaggctggagtgcaatggtgatgtctcagctcactgcaacctccacctcctgggttcaagcgattctcctgcctcagccttccgagtagctgggattacaggtgtgcatcaccactcccagctaattgttgtatttttagtagagatggggtttcgccacgttggccaggctggtctcgagctcctgacctcaggtgatccacccgcctcggcctcccaaagtgctgggattacaggcgtgagccaccacgcccggcctaccatgcaccttttctaatccctcttcctggaatgctcttgctccagagagccacaaagctaactttcatctcctgcagcgtttgttcagatgtcactttctcagtgaagccaaactgaccttcctataaaaatcacctccgactcctgagctcaggcctgggcaacatggtggaaccccatgtctactaaaaatacaaaaaaactagccgggtgtggcggtgtgcacctgtactcccagctactcgggaggctgaggcaggagaatttcttgaacccaggaggcggaggttgcagtgaaccgagatcgcgccactgcactccagcctgggtgacagagcaagactccatctcaaaaaaaaaaaaaaaaaaaatcacctccaacctcacaccataccccattttctgccgcactatataccctggtatatgaccttccagggacattcaactggtaagggaagaatgcttcaagggagccatgtgtatgactccagtaaacacactgtgtgtgctcacctcccaggtg

SEQ ID NO: 133679 - DNA, 1016 bp, Homo sapiens
gaggttttcatgtgttttggaggccctctgtagtgcatcagtatcccccatcacatagtgtgtacgcagtcagccagctctgcttgatgggctgggtgtatggggagatgtttctgggtatggtgtggggttttgtgtgtggtgtgttgtgaatgtggtatgtgtatgtatacttgtgtattttgtatgtgtagtttggatgagatgtgcatgtgtgtagtatgtgacatacatggtgtatgtgtgtgtatgtggaatatggtgtgcatgtctggagtatctggcatgtgtgtagatgtgtagtgtgtgcggcatacatggtaagtagatatatgtatgtggcatatatgatatgatctgtgtgtgcgcgttagtgtgtctgcaggagcattcgagaatgccagcgaggatgcatttcctatcatctgttcttaatggagaaggatttctggaagcagcagatggtgtgaagtgtgcagctgtgaagttagaagaaaatcttggtaaggaccagattggttctgggcaggaaggagtatcctcataaaatcaagcccctaaagctataaacatcagatagcagggcccgaggcaagcgggggtttgagaggagtcacaatgtgctctcatttacaaaagtagtggctgccagctttttatccaaaatcccttaggaattacagttgttttacgggcccaaaatgctttgtaactcagcagatggcttgaagacttcagtatcttcccatttttactttaaggtcaaaaggattctaattaaagttaaagctacaatctcaatgtcattgtttaaatgaattcaccaagacaatagttgtggaatcttttcagaggaaatttaagatgttaatttcccactgaagtatagtctaataattgagctaaataatggcactaaagaatgacttgggggtttgccctcttggagtccatttattcttaaagaaagatttttccctttaattatcaaactaataatggccattggaggtggg

SEQ ID NO: 133680 - DNA, 2413 bp, Homo sapiens
gtcaatctgtagctgattattgtctcgaatatgtactcaaatgagctgtgtagtaggccatctgctgtctcctcgactcagctgataggccctggaaaagggaaatcctgccaaaatgcaaatatcctacttaactgataatatagggagaggagatacaggctgtgggggaatgggggtagggaagggaatggggcgtggggaagaaataagtgactgtcttcacccttcctcgatgtctttccatcctcctgtgtttcttcctgttagagaaagaccaggtgtggatcagtagaccccgctcacaattggagttgcggggtcagactggaagtagccagggaattaggctcggttgtgaggatgctttttgtagcctcttcatttgaattcaagaacctatagcctcttggtttccactggcacgcttgccatggtaggagcccttgttaggattaagcttttctcagtgctggagatggagttgttgcactcatagggctaccacctggattcctcagattgcctccgaatgagtctgtgagccccaccccaccggacctccctccatggcgtccctcccaagcatgactcaagggttctgagttgctgtgttgaatggattggctagcgatcgtttccatgggcatactgctccatcatttccaaatgctttcgtgttcactttcagtttcttttaatatttatagacaccccaaaaaggctgccactattcagttgaaatggtaatgctaaggaaactaaggctccaagaagacggtccaaggtctcatggctaaatgagtagaagaccaaaactgtgattacaaagctgtcaccagctctgcccctttagggtgagttactgatgaaagaagagttggctctgcagacagcagtgaggaggagtgaagccacccaggcataaggcaccggggagctgcgggcctgtgtccagctggagcgcacggggccatctgaaggggcagtcgctatgcattgggcgctgactgcctgcaggccgtgggccaacgctgccagctcttccaagtcttcatgcattgctgggaatcagagttttaaaatattgacagtggattcagttcttttcaaaacactgtgcccattgctctggatcaaacagacaccatcccacacaacactccagttgtgatcagtggattaaagcaacactccttggtgaataggcttcttttgatggtacttgcatttgaaaagagttttgttgaagcaatttagcttctaattaatgcattctgtgggggagatgttttttcatggagtcatcttcttgtgcctgctctgggtcccccagcttcaaggaatgttggctaaagagagtgggaaggtgggatgcagtgtgggtggcgtcaccttgcagcctgaccgtgcctcctccgtcctctctgcacaaggtgacaacccactaggatatggaaggggaaggctgtcacatgtaccttgtgtgatgcacccaagttattacaaatcattttctaaaaatccttgcagagtgggtaatgggtctctgagccatatagtgttggggctgttgcaaaactggtccacttccaaattgcaggccttgatcatttactccctgggtgggaaaggggagctctccacagtaaagaactcatttcttgtcctcagatgtgtggtggtctgatgtgatgagcagactttatactgagaaaggaattttagaggaatacagaatccagctaacttagtaggagtgattaaaaaatactggaggtgtggggcgaggcagattctcttgatagaggaaattctccaggtcacgtgtgtttttttaataagtagcatccctttgcattaacctcagtggttctcagccttggctggttggggaatccctctgaactttaaacactgcctgtacttgggctcagcctcagagattaggacttaattggtgtggagtctggtgagggcatctggactttcaacagctcccctcccccactgacgatggttgagaattactactccagtctgtgagttttagagttcactgtgcatcagaagcacccaggagctctttaaaatgcaggttgctgggctttgccccatggactgaatccagagttcacgggggagcccaggaacctgtatttttcaaagctctacctccagcgagactcaggtgatcattgacttatgtgcttcatcgcaggtgcccatatagaaatacgcagataggttatttcaatttgcaattaatacatataaatactttagtgtcctacttttgacaagcagttggatggaaaatcgatcttttgaaatggatgtcagtttaggctcaaaacgtgtgattacctaagttctcactgctggagaattcaagctgataggccatgttttt

SEQ ID NO: 133681 - DNA, 1049 bp, Homo sapiens
taaaggtaaaaggcaagatgcatacattcatagccgttatctcgtgctggcctcagcttgctggggatgtgcacgtgtgtttggagcccagcaaagagcttcacaataacaatcacagcaggagtagaaaaatgggcctcgcctcagcaccagaaggagtgcatgggtctgtgtcagcattgggtgctttatggggtgttgtgagggcaagaaaccttaaggagcgtgtggtttctgagatcccgatttcgaaaaaacaaagccctgagctggaagtcccaggcatgtcactgtacctccatggaggttacaaaggagtaatttgaggagtggcatcaatattatttaaatgttgagaatcaaatagattttgagagctagtgcagggctgagtggaaattgtccaaatttctgtacagatgaagactcataagtgggctgaacgttatctctccctcccgacttttttttgacctaacagcaaacacaaagtattccctttagaaaagagtgtacgaagagtggtggaaaaataggaataatttccttcaacctaatcatcccaaactcaaacaaaacaaccctcgcattctcaggcactaaggtgctccctggcaagggaagtcaagggtggaacagaaggtacagatagaatttatacctcatggggcccacgacagacccagctatgcctgggaggaaggctgtgaatgcagcgaagtcctgaaacccaagaaaatgccttccgtggttcaatgttttgctttttctctaacaagctcaggttagcggtagtcagatgtctcagtgtgagcatctctttaatgttagcattcagcattccaaacttgggtggactttgatgagttcattcttcatacacgtacacacacgtgcacacacgcatgcacacacatgcgtacacacgtacacacacacgggtcagagttaatgaaaatgtgtttgagtttgtgctaaaggcaagctgagcagatgttttcctgtagtgagtgtgttacttcattatctgtgctaataattataagaat

SEQ ID NO: 133682 - DNA, 1047 bp, Homo sapiens
cactgcacccggccaatttttgtatttttagtagagacggggtttcaccatgttggccaggctggtaccaaattcctgacctcaagtgctctctgcccacctcggcctcccaaagtgctgagattacaggcgtgagccaccgcgcctggccctggatctcggttttaattgtcctacaatagaaatggcagtgccctccttatagcactgctgtgagcacgaggtgagctccagggtatggaaacacaggatccagcccagtgcccagcaacctgcagctgccccataaatgggcatttcctttctctgccttgattgtccttttgccttctttggatcaaaactttgctgctcagtgtttggggaagagataatattctggtttgtccctcaaatatatacgggaatctggtatggaactcaagatcaacgaggcaaacctaagaagctgtgtgtgtacaactgtggttctcaaagtgtggtttctggacctgcatcattttcatcatcgcctggaaactggttagaaatgcagattctcaggttccaccccagacataacggaattggaaactcggggtggggcccagcggtctgtgttttaactagacttcaggtgatttgaatgagtgctaacatctgagagctactagtctctacatctaagttatcagacctccttgaatcttagacttccctgaggaacattttaaaatacgaaagccagggtcccccccaagagatactgatttaatgagtctggggcagagcccaggcacgaggatgttttaaaagattccatcagtgagccaggcacagtggctcacgcttgtaatcccagcactttgggaggccaaggatggtggatcacttgaggtcaggagttccagaccgtcctggccaacatggtgaaaccccgtctctactaaaaatacaaaagttaactgggcgtggtgatgcagggctgtagtcccagcttctcaggaggctgaggcaggagaattgcttgaacccgggaggcggaggttgcagtgagctgagattgtg

SEQ ID NO: 133683 - DNA, 1032 bp, Homo sapiens
ttcagtctccttaaccactttcaaaatcatcatgtaaaagtctgttgcacactctttccctagctgttcagactaagctccaaaagtccatagcttcggaagacgcatggacacctctgttccttggacacacactgctttcctcaaactgcatagttgtgcctttgttttcattttcccttctgaggggaggaacaaggactagcaatgaatggcacctggctaggcgttacccttgaacatcctgatattaagtaaataggcaaataaagtctctttgtaggcaaataaactctggtttgcctgagtacaagccatgatgatggaatcaagctgtaattaaaaaaaaaaaaacttagttaattttacttacaacaatatcctgaaatcaaaatggatttaaaattgcatacttatcatgaccaataattagagaatatggctccacagcctgtggttttggaggctttgcagcccatttcagctgtttgtgtgtagttgtagctcgtttgggttgtaaattggaatctgattcttcccccctaactaccctagttcccttctggcctgtggaagataagctgttctgggtcaaaagcaatgtggtcacatgaccagcctacaaaacagagtcagccttaaaacttccaggactggactgatttggaaacttggagaaactttgctacacaggaagatgtctgccaccggggaacaaaccagcaattcatctcatgcctttcatctggagtagatcatgtgccctgaggtcatatgtatttttaaacatttattcccactcattttctttaatttgagacactcgggcttaatgtagtaagacattttaactgaaatttaatttgaataggtcctcacatacagagtttggtgctctacaaaaaataaccaaggtttaaaaagaaaacaaatccaggaggccttcaaatataccacttaaaatgatcaactttatgttttttaacaaagattgattttgtactctgctggaatgtggccccgtaccaggtg

SEQ ID NO: 133684 - DNA, 1050 bp, Homo sapiens
ccatgttgaccccagctctgcagggtccaaggccacccatgctgggaggggtacagagctccttagcccccagcccactgcagatgatgaggaggaaacccagcaagaggaagggcttcccacccaaccacagcatgggctgtaggagaggtcattcctccttctcgcccactagtggacttcccatttcacccccttccctgccaggggattatgtttccatccacagagcttctaaagccccccagtgatgatcacttcatatcccatagaagtcatattccacacttttttggaagcagtgctccatggaaaggtcattgggtttacaatccctgcttcaggagataccaactccaaaccgcattcgcacaaattgtattttattttgtttagtgtttgacctgagacttaattagtgacacattctcttcaaaagtggcacttccgagagttaacgccatcagtctctttactgtcctggccgtggtggatacagtcttgccctggctctcacgataagctgcatgcttgctcggatcgggccgcgggggtgaggtcagcctcgtggctgacttccagggagttctgcttccactgagagaatactcaggcttcccgggagctccggtttctttttaacttatcatctttcagttttatctgagtggctgtcacttcaggtaactccagcagtgccattccctgccagcctcttcttgcctgccctgaagtgaccctgcggtcccctccccattttctcctccccctagacttcctccacgaggtgagtccccacttggttcagagccaaggtgacagatctgtagacatcatgggaaatggcttggcctagagcactgtaaaaaggattcttctttgctgggctgacagccagacagccactcactgcctccctgagacctgggcctgtgactcttgcaaccccagacacggaagaccccaaagaagcttggctaccctcagttgtattcagtctccagagcaggacagacctgtgaatggtgtctcccaagcatgttggccacc

SEQ ID NO: 133685 - DNA, 1122 bp, Homo sapiens
ggctgaatccatcatagatttgcctgtggcctctaggcagccctttcaccagtagccagaaggaggcagaaggagcaccaggcctgaggaggtgggtggcctcctctcccaggcctgagtcagttggtccacacccttctaatgggtcaatcccaggaaggtctgaatccacctgggcacctcccacctccacctctgtgcttggttcttccagaccatgaaggagcaggcactgtgattggcatcctgccttagggaataatctgaaagtgttgaaaatgcaaaggaaacagtgaatatagagtccacttccaggaagctgcccgtttaactgggagagaggaccaaagcacaccttcccaagaaaactggacttcagaatgcttcaaaaccaaaaatatgtaaggaaggaaaaaggttttgtggttaacagcaaccccaaaccatgtgaaatgccgaatgctattgcccctcgtggaaagggccagttagctgagtcctgcatagagcaccctgttgtgactctgtttacctacttttgcttaaacttgcttggccatgactccctttctccaagcagcatctctttatatgagctccagagacccactttgggaaatattcttccagatggatcttggaccttcctcctgcaaagaggtatcataggaacaagggggagtgaatgaaggcacccactgctatctttctaatctcccctcagtttaatcctcagccgctctggtttgtaaatttcttaatgataaagaggtatcttgagctacctgactctcagcatatttggtttccttgtccccacgtgcaataccaaaccagtgcgtggagcccgacccacgctggccttgggtcctcggttatgccaccttcttctcctttgcagtcttccaggagaccttgtccttgggaggatgctttcgccaagggaccgacctctcctctgctctccttggcccattgcgctgttcgcccttctctttctgcatctctttcctacctctgtgtgttgttctggttcccagggtgacggactgctgtttatcccctcagtaaactctgcttctccctgttggtgccgtggcaacctgagctgcttgctctaca

SEQ ID NO: 133686 - DNA, 1071 bp, Homo sapiens
cggcttccccaaaaccacaaagatccctgggtagaaataccttgagacgggaggagaggggagataatgctggagaagtgaccaacaaatatttggtacatatgacttatcagtcgcttaattataaacaaaataatagacctttttctgttctgtgtatttaaattggttaatattggtgctagaaatatgttgttgaaggcaggacttcatatatatttttttttaccgattccctggtctcaatccctcgtttttcaggctcagagactagacgtgcaggaaaagagtttgctggaagtgaggtcagatcacagagctccttgctgctgtcccaggacctgaagtgggagggaaggaggagaggacagaaatggagacatgatcactctttcaataaaatatactttaaaagtttatattccttgcagcattatttataaagaaacaggcttagtgtaaatgaatgatgataagaaacatccctacctaatttgttactttccacaattggaactttcctattcacagttctcttgtccccctctgcaccatgccacatcctcactcaaatcctgttttttttatgaacgataaagaatcctccatcttctcttttcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactgtgagtgccgcctgggccaggctggggagagggtgtggtgggcgtcagctggcatcttcgttccagctggaccacgccacagcgagcccgagagagggatcaggaattggttctgctgtatgaggtgtgtgagaacaatgccgtgctgcctgacctgaaacccagctgcagggatctagaacaaactctaaagagcaactcccatcactgtggttccacccagtttg

SEQ ID NO: 133687 - DNA, 1011 bp, Homo sapiens
tggctttccttggaggaaaagggaaactgcccttcactttacctttctgagtcagccacagtgggcgcctccctgaaatgatctcatttaatccttgcgtgcaactctaggagagtggtgttaccaccctgcaggtaaggaacgctgtgccccctctgtccacatataggtcacaggagccggtagagagatgctcattctcagacagtagcctcttggagagagaattcttttgtttgagttttctaagccctaggattctgctaagccactgtaggattttgcctgcaaggccccattgtctgtgggctggttggccagctttgctcttccttcttgagagtgactttcacattccagtggttctggagacacatttgctcctcctccatttgaaagcagtgatttagaagcttttgaaagccaacctggcctcccagggcccctcacctttctgcttccttctctagcgtggctgcattgttcttgcccctcatttcttagcatttccatgaagttgggggtgggcagaagatgttctagttttccagtgggattgctgaagcctaggagtgggatggcttcatgggggctctggtgtgatagtggcatgtgcctatatgccccttgcatatgtttctttgagggcaagactacgtcctactctggcacccacagcactgaagactgtgcttggcccaatacatggatgtcaagtccagatagagcaggaagaacagcaggatctgaaaaagagtcacgtgtggctcaagaaccagttagttgaccagggagaaggacagttttggggggaaacgttgatttacttgcatgagcttcagaaaactcttgactgagtttcctaaagagcaaagtaccccatcctcttgagtatcagggtttgggtcagtttgggtcctaccaggaaacagacggcccacacaaacagggaaatttgagacttaacaaacatgtgtgcaaggtttggagaacatgataagtgatggggaa

SEQ ID NO: 133688 - DNA, 1061 bp, Homo sapiens
catggacacagggcttctcttgggggtgataatgttctaaaattagattgtggggatggttgcataaccctgaaaatactaaaacccagtgagtggtacactttaaaagagtgaattgtatggtgcgtgaattatatatcaagaaagatttaatcttggatgactccctcctgcccgctgaatgaggtccatgattggtagagtggtgcagagcctttgaacctgtgtccaggcccctccccatattcatccatgtctcttccaccccactttgcctctgccctgatgctccacccacagagaatgtcttgccattgccagatcacacctgttcccctgtagaactcctactcatccatcaaaacccagctcacatgtcaccctctctggatttcctacccactccagttaggtttaattgtttttgtacttgtgttttcctcactttttaggcgtgtgtcgattatagcacatactgtactgtattttaaacatttatgtgtctctcctgcagtggactgtgagcttcctgaggatgtgccagtattttactgatttatttttctgtgccaaccttgtaggagaggatgtacatgctagcacactgtcagtgcccagtgaaagtggttgaagttgaattctgtcagggagactggctgggaaacaacagtaaggactctgaggaaccgcaatgaggagctttttcatggcaaggacagtggggtgaagagaggaaacagagccacaggcactgcttcccgaaggctctgccttgcacgtgacctgccatactctaagtagtcctctctcatgagaacggggcagtttgtcagcagggctgatttccaccctgggcctgagaggattgagacgcaggaccatgtgttcaagctggatgcatgggatgggaacgagctcaatagaaggacagtcgatgggactccacgggacaggcattgagaacctattatatggccggcattgttatgctagaggccaatgacagtcagaggtgggcggttgaaagtaatgctgctgattgtcgttgtcatctggtagag

SEQ ID NO: 133689 - DNA, 1032 bp, Homo sapiens
ttactttcctctgaatgcccctgttaacaagtgagcacaggtttcttttatgttggtaagaaaagcatggctagcaatgtaactctgtttccatcttggctgtctctctcaaggatgaggaagactcctttgtgatgaaagccatcatccatgccatcaacgatgacaatgtcccaggcctgcagcaccttctgggctcattatccaactatgatgttaaccaacccaacaaggtctggttctgttctgccgcatactggaggggtgggtcacagcgaccttgcccttccatatccaaggaaagaccccatctgcttctccattctcccttccaattggaagctccatactgtggggaaaatcacttctgtttagaaagtgatttgagttacaaataaggtctttgtgcattgagggccttccttcattcacgtattgtatctctacccatgaaattttagatcttctcatcctgctaatgaaaatgtccctgatgatgagaatccaaaaggggaaggaaaggttttatacccttccacctgtcttctcttcctgccacgcagtggtagctctatgtctgttgagacaggggaaggtgtgtggtaacagcaatcatcgtttgggcttttcctttcctaccaaacctgaaaattagtaatttttttcttgcctattctagcacgggacacctccattactcattgctgctggctgtgggaatattcaaatactacagttgctcattaaaagaggctcgagaatcgatgtccaggataaggtcataattgttttattgaaatgaattgaattttaaagtattttcaagtgtctcttaatcataggggtaacagaggaaaaaaatttatgtcctaacttgtttctcagtttcctgtaaaggaagatgagctgcttttaaacagcttggtacagcctgacacatgggttaaagaggcaaacatttatcatttatcctccccttggcgctgctgcttgacatcagcatttctttgtacactacccagattttacttc

SEQ ID NO: 133690 - DNA, 1027 bp, Homo sapiens
aggttgctggaagaattcatgctcagggaagtggttacctactgttagtagtttcagataaagtcagcgaggcacttattagaaagatgctgcaatgcacctgcacgaaggctctattgttcagacaagcagggccgatggtttcaacgggctcccgaaagtcaattgtcagtcatatgcttgagaaagccaaattcatcaaacacacaagtgttgaggaaggaaaactaatgaaagagagacatcagatctacctcttaatgctggtggctcacactcatgttgttattttattccagattaatatttcactccaatacctatgagctctttccctctgctgccttggttgcgtttctgccaaatttgacagggactctcaccttgctttatactttgtttctcattattgtgttctcctcctctctgtactcgtctccttggccaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcat

SEQ ID NO: 133691 - DNA, 1065 bp, Homo sapiens
ccgatgccagacctagcacctccctgctgaggaaaccctttgattcacatttcatgaaatacccaagaaggaaaatgcatcagctaatgaggtatggttgcaattttatggctgcagtgaaataatatcattcgagtgtttgctggcctgagagtaggctgactgtccagtctttgtgggacagtcctggactcacagatgagagctttactgacagagggtgattctctgaggagaccaagagggcctcatttcctggagatcatccagaggttagcaaaccatggcccacgggccatatcccgctgctggtctttgtaaatgaagtcttattgggacacagccatgcccaaggtttgtattggccctggcggcttccacgccaggtgtcagagctgagcagctgtgacagagaccatatgggccacagagccgaaacacctacttgcctggcccttgacggaaaatgtttgctgaccgctggggctaggatgtcgcctccccgaatgcactcatgttactgggatgtcattccctccccagaagtaataggtctgatctgtgcagtggggggcccagctctgtgctttctctgcaggcccagttattaccagtactccgcatggggtgaggcccctttctagggcacctggtcacccaccgcaaacgcacacaccatacccacatcaccctgctgtgcctgacttgctagatcttgttggccattgtcaagccctgcccagccatgcttgggcacaggttccagttactccctaatagagcatttatatgcattttcaagacgaagaaatatttttgtcctatgtgtggcctcatgaaagacccagccaggccattattgaagatgccagcagctgacgctgctgattcccgcagtgcgggttggggctgctgaaatgtgcggccccctctgtagggtccctccgtgagccgcgggcccctctgcccttgcccacgacatctgtatcagtggtccccgcctggctcctcctcaggtccctccgtgcacctccttgctctcccgcttgccaccgcaggaaaagc

SEQ ID NO: 133692 - DNA, 1334 bp, Homo sapiens
gtggcaggggaacagtgacagcttctgcctctcaggggtgacttcaaggactgaggcttgcagagagcactgagagctgggtcgagcacatattatgaggtggtgttcaataaatacttgctgtcatcgtgtatgttcatggtgtagatacagaaacaaatttattcagtgtgaaactgcagcctatgaaaaatctctaaataaaaagcaagcataaaagtgctgtggactcttatttccttgttttctgttcaccaaaagatctttcaatcaaaattgcctgtcaaactaagtatttcctttgaaatgcacagtaattaccaggagctggtatcatgcaagggctgggtttgtccctgtaaggattataacacagtagcttgcactaactagaatttggcacctgatgagaatctttactgtctgcctgattggagattggagagaggggttcaggacagggaggaaccagccagctgaggaggctgttgagttgtgattaaacctgtggacctgaaaggtgtcgctattggacaggaagacaccaacatgtgctttgttcctgcgtcttaccttcctgtcctggacaatcaagtgaaataaggattgcacagccagagaaacacaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggtgagaagttctgttataggtctgaagttctctacctgtgtttatgtgaaaaagtctcagtctttttccttatttgagaatgagcaaaatgaggctctagacagccaggttttaggaacagtggtccctgtcctgtggtttacatgtcagtcggtataaatgcatcagctccctatctgttttcttctctatttggacttggaaatcatttagcatgtttgcagttgccgtgcctggttttccttctcccactctctctataataaaccactcccacaaagtagcgggggatgaggacgctgactctgcctctttccttcttatgtttgagctccaagatggctgttaagctcctatttatcaaacattgttgctctgaggcttaaagaaacatgacaaaaataagtaaaggcaggtgcaccctttccagcctacaacatgacagttgtgtcaggagacttcacaatagccataccctttaatctagg

SEQ ID NO: 133693 - DNA, 1016 bp, Homo sapiens
gatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcc

SEQ ID NO: 133694 - DNA, 1051 bp, Homo sapiens
cagccatgtggcactagggctcttcagaggaaagagcattttctccatctgaagtgcaatgtcgtctcctgtgcactccacagatggtctgggagctgggggtggaatcctctgcccactctcaaccctgcctgccctgcccttccctagagggatgacgagatttcccatcgccttcaagcaactgagctctgggcatcccctttgggactagggactggggcccaggcttgtatcacacagctggggcctcctcctcacaaagggctcctgggggtgggggaggggcagtgggaggaggaggctgaagcacagccccgccctcagctcccagcccccagtccctccaccctcctgggtcccccaaatcgctccttcccactccagctgctcaccctgtcagagacagtcctcagtccattttctattctcttcccctggaacacaggtgtcacctggctctccttgtaccttggagatctaggcctgagcccacccatttcatagcctttgaaactgtgaaattctcctaggaatttaggtggtttcttaaggattatttcagaatctcctctgtttttgtaattttcccacaccttacattttctactttcatcaacccagaatagaactcttaaatttacaaaactaaaaagtataaaaattacaaataattaaacctccaaatgacatttttatattaggaacataattttgagttaccgaattatggagcttgctgtaaaaaaacctcaaacactttgacaaattattttcaaaacaataattaagcctttacttattttctttagatctttcatatgttgtcctgatccattttttctttctctgccccaaatacagtcctcactttcctaagttttggaacatgtgtgctccaccatgagccaggagtggtttggggtgatctgaggtccagctcctttgggtggagagcgggactgggcattccgtgccaggctcaagtccagtgttcagcagactcttctgagatcactcgtgtcctccgtacatattctttttttttttt

SEQ ID NO: 133695 - DNA, 1129 bp, Homo sapiens
tgtacaaggcaggtttccagatctctgtttctcaggtgagaggaggaggttatgtcaccagctcttgggccctccgttagtcagtagagggtttggcccaggtttgattgagagtccattcttcccttgggacctcccataggctctaccctgtgttgggcactggtgacacagagaaaccagctccagcccagctcctgaggacttaagtgtgctaacaagagacagaggcaacagggcccacctagtgtggttcgtgctgtgatagggtaccgggaggggctgctggaacacgaagaggggcatctttcacccctagtgtcattactcttttggtgctctctctcacccatgtcgaaatagggaatgtatttgactccctggagagttaacagggttgggtctctgtgatctggagatatgcatgatatattggatgacaaaagcatgttataaaattttgtgtcatctgggttttgtttggaaatattatatatgtgaatgtgtatttgtgtgtgccatatctgttgtaaagtctggtagaatacactctaagattgactgtaggatttttcttttgttctttttctgttggattttatgtcttacctgaatgtgtgcatgtgttttgatctgttaaatggttgtgtactacctgaaaaatccgaaaacagcaatcaggccattttgattttttgaggaagataaaagggcttccagacagccatgtgtgggataggtggagagatccataaggaagctggtgatatggtccctacatccagttggtcagcaattctgaaggttctaactttaaaacatactctagatttgctccttgcccaagtcatcatcaccactcatcagaatgacagtggcagcctccccactgctctccatagccacagtccggagggctttgtcaaaagtgtaagttaagtcatcggctcccctgcgtaaaaagccctggtggcttctcttcacacttagagcactatcaccatgtgcccacctccagctggcctctcccttttctctcattcaacacaacttcttaggcatctctccagtgaccagcacctatctagggtccaggagcacagaacaaggcagacacatccttccctta

SEQ ID NO: 133696 - DNA, 1273 bp, Homo sapiens
agtcatcaaatactgtagaagaaagcagaactgagagacagagagatagaaaaaaaaaagcactgtagatggtcctcatcgaggagttcttcagatagtagaatatacaggtgaaagaaagaaggaaggaaatcaagatcaaagtcaaaatcttggtccagagatcttcagccttattcgcattcttatgatagaagatgcaggcatcaaccaaggagtagctctcatggctctagaaggaaactaactcgaagtcgttcaagggatggagagaaatcctatggagttaagaggtctaggtcaaaaagcagaataagaagatctaggtcaaggccttgtctgtgttctcacagtcggagcagtgaaaggtccagccacagaagaatgcatagttggtctcgggataaagaacaacgtaaagtcagagataaagagaaaaggggaaggattaagggaaggacaaggattacataacatcaaatctggaatctggaaacatcaaagctggattaaaccatctgccaccagctgaagaggccaaagccagaatacagctggttcttgaagctgctgcaaaagctgatgaagcattgaaatccaaagaaagaaatgaggaagaagcaaagagaagaaaggaggaagaccacgccaccctggtagaacaagtgaaaaaagtgaaagaaatggaagctgttgaaagtgattcctttgttcagcagacattcagatcaattaagaagtcaaaaagttagtggaatctggtgaagcgaaacgtgcaacttcaacatcaggaccaacattagcaggtgttgatccacccagtactgaaaacgaaatacaactgagcagcatccctacttctatcaaataccaagatgacaattccctggcccatccaaatttatttatagagaaagctggtgctgagcaaaaatgattcagaggctaattgctctctgacaggaaagactaatgggcagtcctgtggcctaagtaatatacatatggttggattggatggccagcagaaacattggaaatgtaggtttttaaataccaatattaactttttgcccttaaaaagaattcagctgattatataaaaaggtaatctcatttcattcttctttcatgtaggcttgaatatttgttgatttgaattaacatgcttgttattaaactgtatattttaaactgtaatattgtgaaaattaaaacaaaatttaagaattcatgaaaatgttacactgttaataaagctaattacagattt

SEQ ID NO: 133697 - DNA, 1024 bp, Homo sapiens
ggggcgctatgcgggcgccgcccgctggacaatgctccgccgggccccgcgcgggccgcgctcacctgcgcccccgggcagaccgccgcaccgctggcccgcccgcagcccgcactccctcacgacccacgcccgccctgcgcgggcctcacctgctgaccgccgaggctgcagtccacaggcccacgggttccgccgtcgctcgttcgcgctcccgccggccccagcctgagccagacggcgcctccccgcccccgctccctcgccgcggacgccgcccgccccccaacagtcagggcgcacgcgcactgcgcccgccgaactgcgacggccgcgccgccccggcgcctggcgccgacggccgactgcgcaggcgcagtggggcggggcggggccggcgagggcggggcctggcccctctcacctggctggcggcagggcggggctcgagcccgggactgccaggtgcgcgccgggaatgggcggcggcaggcgcgcggggcacaggttcctgagggggcgcagcttttcctggaaggcaggcagcctgagaagggcttcgtttttgcgcagtaggacgttgaagaaaggacaagccccctttgtcctggacgtaagccgcaagtcgtcctgagtggtgcacaccgcgaagactgaggaaactggatcacagggctgggccgtgagccttgaacctcggagaacgtcgcattactgctccagcgcgccggttcagggccgcgggacgcgagccctttaaaaggatggatttgcttcctgtgactccctggaagagacgtcttcaccaccgcactgcgtagaggccggcgtcgtcgccggctcaccccgcttgctgcctccccgcacaaagcccagcccaggtagctcaggttagctggagccccggagcctcacctacaagtacctggcctgtcctaggttgtgtggggacgggatgtggcttctgcaagcccagaaacctgtttccactcccccaccacaaatggaactcacccagctctac

SEQ ID NO: 133698 - DNA, 1072 bp, Homo sapiens
acatctggatggaggggaaagcaggaacagaggcatgagaggagttaaagaggccatcggggatttcaatcccagccaaaagttagccccttgttacctgtctcctctcctctcctctcttctccttccttccctccttccttccttctttccttccttccttccttcctccctctttttctacctatctacctagctactattttctatctatcctcctttgtgagtgtgtttatgtatagcaggggacgagaacacctacctcatcaggggtgagcttaaatgaagtaaaatgtttcataggctcctggtgtacagtaaatgcccagttgatattgatgatgatgtcaccactgcctacaccacctgtagtttctttcctatggctgatctgtctagggatgaatttgggggccaccttttaaattctgcatgtaacattaaggtggttggtgttgaatttgtaggcagagggaaaccattgaaagcaggggcaggattggacctgtgttttagaacagtatgaaaggtgagttggaggaacctgcccatgtaggatctttaatctccagagtctagcctgttagagaagctggtgaagtcatttaaggcatggggtattggtctgaactcagaatatttaatgttatgttaaatgtgcttttttttttttttttcctgaagggaggggaggaggaagaatttactcaatgtaaatattattttatccaaatggtgagagaatacatgaaaagactagtaaggcatctttttaccatttgagatgttatagtagcgtgttaacaaaataggcaattttttttttaaaactaggttatatttctttgtagttgtttatgcttgggcctgtctgcaaatgatttaacaaatcatatcatatatttgaattactgttgcttaacctgacacaggcaataaggagagaaaagaatgtcctttttcttgcttttgggttttttttttttttttttttttttttttgagacggagtctccctctgtcaccaggctggagtgcagtggcgcagtctcagctgactgcaccctccacc

SEQ ID NO: 133699 - DNA, 1033 bp, Homo sapiens
gtggtgtgaccttggcttactacaacctccgcctcccgggttcaagctattctcctggctcagcctcccaagcagctgggattacaggcgtgcaccaccatgcctggcaaattttttgtatttttagtagagatggggttttaccttgttggtccagctggtctcaaactcccaagctcaagtgatcctctcacctcagcctcccaaagtgctgggattacaggtgtgagccaccatgtgtggctttatccagtgttttaatcaaatactcactgtttttccttagcttttcacaacttggacatgttgaggtcctttcaacctggttctctttcctttgacatgacacgtaatctctgaagcttttcttgctttctgacacaagatgtctaaggttcactttgtgcttttcctgccaaatacctatcaaccgagtctttcagcttgctttattgaggattagaatttagatacagaaatctgggtgttatatgttcttactgttagaatgcccatgcttttattggacagccatgggaagcatacagattttgatttttatattggtatttccagttcgaatttaacatcacagagtttttactatgagcttatccttttttctctaacgttgaaaatttacattcttagcaacattaatataattgcattatcttacagtataaatgtagtttgaaaataacactaataagcaactgtagctttatgtttggttatggttttttccttaaaatatatccacataagcatgtacagttgacattctaatttggaaggccatttgaaaagattttctctgattatgttatatgtttgataattaatttgggttgtttgcctgaaattcttcctttaagaattgctttagttttttatttaatgtatttttttttttttttttttgagacagagtctcgctctgtcgcccaggctggagtccagtggtgcgatctcggctcactgcaagctccgcctcccgggttcacgccattctcctgcctcagcctcctga

SEQ ID NO: 133700 - DNA, 1056 bp, Homo sapiens
ttaataggttttcacaagactgccctcactttggataccagctgcaaacttcgggggctcccatgttacttttatttctgaccaagtacaaatgtggaggtttccatcacactcaagtttgataattcagttaggatgactcacaaaactcaagaaagtccagtacttatagtttattatagcaaaaaaaaaaaaatacaaattaggaccaaccataagaagtgacatatagggcagtgtctgggaaggtctcagatatgaagtgttcatgccctcctgtggagacagggtattaaccgggaaagctcatgtgagcctctgtgtccagagtttttattggtgcttaactacatcagcatgatccattgaatcattggccttgagcttgaactcaatttcttgctcccctctctgaactttgggctgttatcctggggctcagagccccaaccttctaatgccatggttggtctttctggtttggccagccccccacctccacatcctgagatcttgttaacataaactaggtgctcaccatgaatcacagagatgccctgtccctctcaggacatttcagggatttaaagggcaccaactggagctgggacaaaggccatccagtctctctgttataccacagtcagcaattctgttttcagtttgatgcctaaggaccaggcctagtgatatcacgtggctgacctgagctgtgcctgagcgcctgcatgagaagactatgtgctctatcctggtggcaaatctagtcaagtgtcagctgatgagtttaagtggtattttgagctacaacaaatgcaatgggatggaaatatatgtgatttctattgttgagaagttggaagtactactactaatactgtggtttgttgcacgcattcatgatagaaggaagtgctgtacttcaggtagaggttaggaaagatgaagataaaattttttctcctgtccaaatccatggtccttataaattttgaccacgtattacacttgtattaaaacttggtgttttgatatttagtggtttagggtgtttaa

SEQ ID NO: 133701 - DNA, 1054 bp, Homo sapiens
ctccgcctcctgagttcaagtgattctcctgcctcagcctcccgagtatctgggattacaggcatgtgccaccacgcctagctaattttgtatttttaatagagatggggtttttccatgttggtcaggctagtctcgaactcccaacttcaggtgatctgcccacctcagcctcccaaagtgctgggattacaggcgtgagccatcgcgcccagccttgaatgaaattttctacacatagaagagttgaaactatagcagaatgacctaacctgtctacctgatatcaagattttaatttgcttacattttgctctactgttttttattattgaaccatttgaaagttgcattaaattgcagacatcatgacacttgttaaagtaaggttgttattctttgtaactacatgccatatttaagaaagctaattagcccttcatatctaatatctatgctctgtatttagattttagctatatgtttttttcgtataaatgtctgtgataatttatgtaatccccactaagttagaaaggagaaacaaattcttattctctatgctcatactcagcacaacacttctgtgatcaaatgtgtgtgggttttccctacattatctgtgtctcattttctctgatgactccagttggttgtcctacagtttaacttctcagagtatccacctggaaatagcatcacatcccacaagactgcccccatttctcatgccagttgcaagtccaggttatttattttatttatttacttatttattttttgtgagatggagttctcactctgccacccaggctggaatgcagtggtgtgatctcggcccactgcaacctctgcctctcgggttcaagcaattttcctttctcagcctcccctgtagctgggactacaggcacgtgccaccatgcccagctaatttttgtatttttagtagagatgaggtttcaccatgttggccaggctaggcttgaactcctgacctcaagtgatccgctggctttggcctgcaaagtgctgggattacaggcatgagcca

SEQ ID NO: 133702 - DNA, 1155 bp, Homo sapiens
aagaccctggcctgctgatcttcagccttgctgttactctgtcttgaacatgatttcctgtgctgcccccgtgctgtccttccactctgcctccccagtaacctcacacccctgtctcccacccccatactctgtttctttgtgtcccattagacagatgggccatgctgtctaaatcttctgtgaaatcccagcatccacccttttctgatttctagcagcaggatgctttaggataataatggggatgtcagacagcagctgtattgtgttccagttgatcttggaagagcttcacttttgggtcttgcacatgtcccaggcttctttttttaaagagtctatcacctctttttctcctttctactttgtcatgtcctaagaacccaggtcttaggaaataaagttaattgctttgggacaaaatgcactttagctaatacttttgcttaaaattttatgtttaatggctcactaggcataattttgctctcttgatgctctagtaatgaactgtttcactattttacagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggtaggcattgcggttctacacatatttaaatatatactttaatataattcatttcaaacaagtgtaaaattgggtactttcacataatagctagtgaaaaactttgtcatttctagtatgttatacacatatgcatatattaagaagcagatttaagtttcttgaaagggaagtagtcacatgaaatttctgtataatcctttagcaggttataaatgtctagtaaatttagcaagtgaattgtaaatatctgttaataggattatagtaaaaggagttttttccggaagagttaaagtgaggtgacatgagttggatttagtgagatttagtgtactgagagcaacttttaggaagaaagataaacttggaatttcttgtgtttacttgaaagaagtttactggtgtggaaa

SEQ ID NO: 133703 - DNA, 2598 bp, Homo sapiens
gctcctgcctgtcagaacatctgtcacattgttagtctttttcctcctcaagatactttcgtatgttgtccaaccatgatgcttccagacccatgtaaatgagaggattccaagaatgctttcctagcttaagacctctctgggtagccacctctgtcatactttctgagacctgccgccctcatttctgcctgaatcctgctttcctcaccctgtggtcctgtcctggtcagtaaggattgtgtactcagaagggctttgtctttctggaaggaaggtttgctgggtttttgcacagtcccaaggggcttaggcagacctgggttttctggccttacagtcttgcacttaaccctgtgaatctcctcccagtctccttggttaggttcagacccccttgcttagtttttcacccccaggagagaagcttcccttctgcggcgagtactccttattgtctcttatggcctgttcccgtctgacttagctaaatatatgttaccagtctagagtaaattatttctatttagaaaatatataattttagttttagctgttacaacctacaataaattgtttctttaaaacttatttgtgttatatgtcagatattaatcacttttattcatggtgtacgaaatgagagctttatacccataaaactgtgggaagggaattcctttcaggtctttttgttcttggcgtatatcagcatctgttatcttggttttgaccttcagcttgcatccaagaagccagggttttaaggtgaaatgaagattttttcctgatatcaagagccaggtgtattatttataaacattctgtgtggatttttcaattgctaataataagccagaaaaaaagtagtttgatgtttcaataatttttaatattacattgttataaacttcagttttaagattatatgttttctagacaagtaatgtttctatagtgcattgatataagctagtctggacttcagtttaagagaaaattgtctagtttatttttattagttaagcttgtacaggcagaattatttgggcacgggaatgggtgaaattgaatagttacacatttctttttaacttgaagtagatattatataaaactatatacctgtgtgattattgataacatgtatttcacggatcagtccttctttaattaacttggaaaattttgagttgattgaattaaaataaactcagaaagctgataacctgatgcttaatagtagggcttaagttgctattgactagtagttttttctgcctatacacagttgaggtgcacaacaagctcctattactaacataccatgttacacactcaccaccactggtacaggggtagaggacaaccactttgagtcacctgaagcaggaatgtggcaaacatgagtttgtacatattttgggaccatctgtaatgagatcatgctagccagcggttatgttagatctaggcatgcatacttttgagataataccttatgtgtgtatatgtgtgaatacagaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttggtaagttctttttataatttgtgcattatatactttaaaaatgatattgaactggatgctttttttattttacattattaatacttcacttttattggaacacaagcacccttcttgataaacattatattaaatcaccgaaaaccacaaaaatggatcctaagcagttcaaggaactgtgtgagggatatagagatgtgtattttccccccaagaagtttgccacgtaataatttataatacggttatttctaacatttttgctcactgttctctggactctgatgggtaaggttatcagtagctgaaatatcctatatgttaatctcatctcatcagatacaaaagataagagaatgctgtgcctttagaatctttctgtgaaagtgtatctttgtgtacaacgtaaatgataattgtactttgagccaaaatttaaacaaccaaaacgtggtctttattatacacagagcttgattgaacaatgtttgtggaaatgaatggctctttttaaatgtcatacagtgccagttttgccctgcaagtgttccttaaggcataaggtctaaggtaaataataattactgattttattagtagggtgggatacacccaaactaatattacttttttttgaagtatttattttgaaatattttcttattacagtgatgctgctcttgtttaaaatattggtttatacttttagaattgtctttataagtctataccattaaataataaagtttcagcagatctagacttgggaggtaggaattttgggatcaaattgtcacaggaagaaattagttcagtctc

SEQ ID NO: 133704 - DNA, 1920 bp, Homo sapiens
agagtgtgtcctaatgggagaggaagaagagcagagtagagaacgcatgaacaacaaggaggaagatgggaaacctgagggcagaggcgtgaaggcttttagggcttgggggctatggtgagcagtttggttgtttttcaaattataaagggaaggcatgggaacattttagatcacacaatgtggtatcagtgacacaacgattactttggttgcagtgaagaataagattgtaggagcaagagagtaaaaacctatgccttaataaaaaaatggaaataagactgaaggaaaacaaacaccaatttctttaaaaaaaaaaaacaaaaaaaaaaccctctgtgccttgaatagcttttctaagttttaaataaacgttctgtggttatgtaagatgctaatacaggagaagcaaagtgaaccgtatacaggaactctactatttttccagttcttctgtaagtctgaaattatctcaaaatttaactgttaagtaaacaataacaaacagtattttataccttgaatgaacaattaaaacttttgatttgggtacagaaccaagagcagatgagtccagaaaaataaaaaatcatatttttttcaattaactgacttgggacaaaatacttctattctgttgaatccatctctgagctggggcccagtagtttgtctttggtttttgtactttttaaagctttcccagattctgatgcttgctaatacgttgcatggacaaaatttcaggtgtagccttctttagtaaattcagtcttcatagtcggtaatcagcgaaacactttgtcaactttttttttttttttttaatccccagcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccagtaagtatatattggcaacttttatatgtgataattagaagggatttggacttcagtacaagatatttgattggctcttttgcagatacatttttatttttggatatatgattcttttagtcatgcacaaacacagcctttgaaatttttcatccagttgttataaatgttagataagaaaatatttgatagtcagttctgcttggcttctgtaataagatacaagttgttttataattattaacactactacatattacttcttgcttttatttaaaaacatgatggaatagggatcagtaaaatacgtccccgtgtaccctgctcagctttaacagttatctcatcgcctgtctagttttatctgttagtccccccagtgcaattattttgaatctaatcccaagacattgattatttcatctgtaaatacttgaacttcagagcagcgatcttcagcctttttgtcaccggggaccagtttcatggaagacagttttctgtggattgggggttgggtgtggatatggtggttttggaggcattagattcccataaggaacacacaacttagattcttcacatgcgtagttcacaataaggtttgtgctcctgtgagaatctgatgcctctgctgatctgacaggaggcagagctcagacggcagtgctctctttgccgctgctcacctcctgctgtgcggcgtggccccaggtgtctgggactcctgatttagagaacatcaatttcagaaaacgattgactgctaacttttcagtagcaagtggagtacagagtcagtgtttagacaggtgatttagctatttccacaactagtctgttcacac

SEQ ID NO: 133705 - DNA, 1059 bp, Homo sapiens
tgtttgttttgttttatattttagagatggggtttcaccatgttggccaaggtggtctcaaacacttgagctcaggtagtccaccagccttggcctcccacaagtgttaggattacaggtgtgagccattacgaccatgttagtccatatagttagtccatttaaaatgtgcatttctgtactttttaatatacgcacagatatgtacagtcctcaccacagtcgattttagaacattgtcatcacctcaaaagaaaactttgtatctgttagctgtcagtcctttattcttcgaaccccctggccttaagcaaccagtaatacttgctgtgtaaatttccctgttgtggacattcatatgaatggactatatggtgtgaggtcctttgtgctagcttctttcccttagcatattttgagatttcattcacgctgtagcatatatcagtacttcattccttttaatggccaaatacgattccattgtatggatatactacattttgattagccattcatccagtaaagcacatctgagttgtttccccacctcttggttattatgaataatgctgctgtaaacatttttgtacaagtttctgtgtggacatgttttatttcctttgggtatatacctaggagtggagttgctgggtcataatggtaactctatgtttaatcgtttgggggaactgccaggctaattttaaaaacggaaataccactttacatttccaacagcagtgtatgagacttctgatttctccacattctcaccaactgttactgttactttgattctggccatcctagtggatgtgaagtggtatctcattgtggctttgatttgcatttccctgatgagtaatgatgttaagcatctttcatatgcttattggccccccccctttttttttttgagacagagtcttgctctgtcgcccaggctggagtgcattggcgtgatctcagcttactgcagcctccgcctactgggttcaagccattctcctgcctcagcctccccagtagctgggactataggcgcgtgccaccatg

SEQ ID NO: 133706 - DNA, 1084 bp, Homo sapiens
taaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgc

SEQ ID NO: 133707 - DNA, 2451 bp, Homo sapiens
tagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaactcctgactgtaaagtttgtgctgatgagcaacatgtgatgtgttaaacttgattctgaaaagttttttgggccaagtaaccttttcaccacatgtaaatgtcagatatgcatagaaagaaatagaatttttatttgataacattcaataatacctgaaagaagaggaggcagtcatcaatatcacacatatattaaatattgaagtttgcaatttgacattgagaaagtttaacttacaagatcttaaacttaaaaaaattcttttaaatataattaaataatgggtattttatacttttcacaagtattcttgctttgaatatttcttataatgcttttactcataaataataaacaatgggattctatagtgaaaaatcactatttctcaatgctaggatacaaaaaaatgaaagtaatataggctggtgcaaagtaatagcagttttgc

SEQ ID NO: 133708 - DNA, 1031 bp, Homo sapiens
tccatggaggttactgaggtggactgaaggcagggtctactccggcttaggtggaagaaggctgcagttcaaggaggaaatgagccattgggaagcacaggtgcctctcttgagtctgggttttctgaccttccttgctgaaggtagattattcgttgtctgtgttatctgtcatgggtacagctctgtaaatattgccccaaaagtataacaatgcaagtttagtctgaagtttgaaacttgataactagtatttgtaaactaatgaatcaactctcctatttaaagcagtcatcactctgttggagaatttttgttttttctcttggtacaattaaactctgtgatgacaaaagcatttggtactaataaagcattcataaatgcttaataagtaccttgccaagcactttccacactattttgtttagttcttaatggtcttttgaggaagaggcagagattgagtatctcacgcaggattataggggaatgaagactcggatctctattttgtgcccagactctgagctgctttatgaacacctcaattaaattacttcattggagtgatttgagtaatctatctatagtgtaatattttctatgaataattttctgtaaccttatttcataagttaatatctaaaaagtgtttatttccaaattgccaaataaaaggttttatattagtcattagaatgtaggcatctgtgtctctgtatgctaagaattataacccaaaattatttttgtgcttaaaaaataaatgatgtctccacgatggcacgcatatacttatgtaacaaacctgcacattctgcacatgtatcccggaacttaaaaaaattttttttccataactaaaaaaataaaaataatgatgtcttttttggagagaaagtatgctgaagaaattttaataacttttcatcacaagaatatagatactttattttaacttttaaatctattcatttgcttatttattttgagactgggttatgagactggctaatttttgtattttt

SEQ ID NO: 133709 - DNA, 1007 bp, Homo sapiens
gtgggccatgctgatggttatgctatacgctttaggacctcactgcacccggggtcaggacttaaacatcagctgtttgtctggtggaatgaacaaaacttttccatttcaggtggtagcacatagacagaaattcttgtgatttaatgtttttcatcctgccagggaaaaccattttccctttagagacgcttgtcctgacaacctatttgttttctcaaagcagtgatatttccagaatttgtaagtgcctgtgttgggggaggagggctgattggaaaggagaatggggacgcgcagaaagaggaatgagcttcccacaatgatttctgatatgaagagaaggtaaaaaggtaatacagtttagagttttctcttttaccttcaaaaagagcattacattatcttgggtcttttatgtaatcctctctcaggttgctaattagggggtgatttcatcgctgagctgctctccagaagccctgttgcttgggcttggagactgctttgaaagctgaagtttgtaaatgtggcttagctggagaagtgcccccacagaggccgtggctctgagctgagctcagcgcttcacagagaggaagtagctttccgattccacccactgagccagtgcacttgcagcaactgcagggcttagagcatccttcaaacccaaacccaaaggcatatgaatgtgggtttctctctttaaaaaatgggactattttacaacagctataatttggggatgaaagtgtcaaatagccaggtgcggtggctcacacctgtaatcccagcactttgggaggccaaagcaggtgaatcacgaggtcaggagatggagaccatcctggccaacgtcgtgaaagcccgtctctactaagaatacaaaaaatttagccgagcgtggtggcacgtgcctgtaattctagctactcgggaggctgaggcaggagaatcgcttgaaccagggagtcagaggttgcagtgagctgaaattgcgccac

SEQ ID NO: 133710 - DNA, 1039 bp, Homo sapiens
gcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttg

SEQ ID NO: 133711 - DNA, 2180 bp, Homo sapiens
tcacgaggagcgccatcaccgtgcaaggtcgacagcttccgctcaaagccctgtggcccacgcttccggcctcgaccgactacgtcatcaccaaaccccgtgatacctcactccaccttcaggtcctccgtcccaacggttccgtgtcctggaactttccacgttcctgcgcacgcgctctgcggcccttaacgtcccgacttcgccctcctctggccacgcccctgcccgttaagggccctgccacccccgtgacgtacctatcttccctcgggcaacctcgcaacagatctctgattggctgacccaggaagcggactttgcgaggcggcggcgacgataggctggcagccggccgacttccgcagaaggtgattggtcggcgctgctgtccaatcggcggcgggctgtcggattcaaatccggatcgttgggactgcggtcgttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggtgggcgcctttcttagaccccgagccggctccctcagccggggcccccgcgggcggggcgacccaggcatagtagggtcgggggtgggggccggggcctggggggcggagcccggggccggagggcgagggccggggtttggggtcgcggccacctggcgccccgcgcagtcggacatggttgggtgcctggccgcgccgggccggttgggcctttgttcggtgtgcgcggagggtgagggaagagtgcccaccgggccgcatttagtacctgggtaggaaccggcgcaacttgggggtcatggggtcctcggcgacgcggagtgaccatcccgtcacttttttctcggccgtggccgaagtaattaggccgttcagtagctggtctcagttccagttctttgaaccagtccaggaaaacccacctggtgccgtcctttttcctttagcaaccgtgacacactttccctgtcgctgacggggtgatgcagcttttactagtttgtggtttagaatggtcaaatggtcattttcatctgttaacacagaggaacacttttctttttcttgtttttgaagtgagtggtataagaataagctttggaggcgaccccccgaaaaatgagcttgatggggattcgaaaatgtttactgggtatggtgatttgggccattataggttagccgcagtcatacaattgagggtattattaaaggagtttcattttaaggccgattaagaacttgagtggactttgggcatcattttctgctagtatacactggccaaattttgggctttgagaaacttttgcgtttgagtcctgaagcaccgtactagaacatggtggctgtaatcgatcagtaaaattagacaaattttaaatgtccctgtccccttccccccaattaaagtagattgggggaaagcgagtagggacatttaaaatttgttgtccttactgtatgcgggacacttcatttagggcgtggcttcagaaaacagtcaacccctttttcttaactaggtagcgactagaacgctgcgttctgggatactaccaagatttaggggagataaagcccatgccatcgttggccaaattgtgaccttgttttctgtctgctgcctttgtaggttagatttctccgaatgctatttaaggaagaaagaacaaaacagtgggtggtttctctttttctccccctccctagtagcatggaagtctgttttcacatgaggactactgaatatttctatgggtagtagtaattgcacccttttgtattcctagctagaaaaatagcatgtttttctggctgtaggtaaatttcaagtagattgtgttaaccttatagtaataataaactatactcgtgtaatatgctggcagtgttcaattatgcgatgttaatcaagagccctattgaggatatccaataatgaacacaatgtaaaccgtaataatcttactaaaacctagaaaattattctgaaacacatctggtgccaagtgtttaggataaggatttaagggtcggtacaagtttcttttagggtataatattgaaaataaat

SEQ ID NO: 133712 - DNA, 1035 bp, Homo sapiens
agtcctttttatggtaattgagtaaaaattcttactcaatttggggaaagagatttgttaggcaaatctttgatagaatgctttgggatactgttaatgatacagatttgtttttgagaatctcgtaaggctacaattatacatattgatggtttaactttgaaggttattccatgcttgcctaagaaactgaacaatgtaagttttggatataggtcagtaaattaactggaaaacggtgaggttgcacacaatgtgtatgtacagttagtggttttctgtttttaattttgaacaaagtacttgaagtataaagcaacttctggagcatacaaggactagtagctactacaaagctagtgttgagtaagaggaaacccaaattaactgtaacttagattttttcgttacataaaagtctaataatctggggcagggataacagctttacagtcaaggactaggctgggtccttacctcttgttgctttaccgttctcaatttacagttgcttctatggtcctagattcctgctctggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggtaagcattctgtgataagagaaaaagattaatcctatggaaaatgctttctgcttttggattgtgcactcttagctccctaatttgaacataggccatcatatcagaattaaaggtagtagattgcagttctcaatattaaagcaacagagttccttaaggtacatgtataaagcgacagttgtagaaaaggcactggactaacacttggctgtatcttgtaacaggcatgttatgttacccagagaactttccaaacaagtacctaaaactcatctgatgtctgaagaggagtggaggagac

SEQ ID NO: 133713 - DNA, 1148 bp, Homo sapiens
ttttctagactaaaacagtgtgggttaaattttatatttggattatcagtaaatctaacagcatttataatgctttgaacaaaatttgaagacatactatagaagctgaagtaggtggaattaaaactatcttctactctgctgttaaagaaaagcattgcatcgaaaactctaaaaggactcatcactttcttgggattgagatacgtaatcctattagaattcagtccagataatacaaaagcaactgaagaacttaagtgtagatttctgtgccccacctattgaaacagaatctatggggatgagcattagtatgagatcctgtaggtgatttgaaggaggtgtttttccctataaagaggtaatctttttacttttaatctatttactgtagacagtaactgtgaaaaaaaaatcattttggatacctcaaaccaattaatagtggacttagtttattttattctggcttagttgagaatacttttgaatttctgttgagtatatgaaaatcatattaaaatgattcaaaacattttctttccacagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttatcactgtttcaagtttttgaggtatattttcttaatttgtgactattgaaatttgtgactattgaaattgatttcagtgttatagttttagctctgaggaagttaacttaccttaaagatgatgttaaatgagtttaaaatagtgcggtatgatctggataccatttaattcacttaatgaagaaattaattaccagggatatgtttaaactaaagccaaagtagattttacctcttgaattcctggagaattgtctagaacagg

SEQ ID NO: 133714 - DNA, 1029 bp, Homo sapiens
tgtagtctccctttcttattcagtgtagtctgttacttgcagcgcattagaaatatgatttctagtaagcggtgcttatgctcatatctcctgacagcgtagcagtttgaaggtcttaaagggtgtgtcatgactaggtttggattttttgcctttcagtgtactagtacattttggaatagctccggaaattaacagaaacatttgctggaaggaggaggttactatttgtattttaaatcagttgcttagcattttgtcattgtatcagctttcatgggaaaaaggttgaaacctgtagccttgtatcaaattggctaaaaaagaaaaattagtgttaaattatattttggtttagtctagcagcttgggataaattgaggcaatagcaaccttcaaagctggtgtccatctgttagtaaagtgtgtagttaacatccacggtgccgtgcggtgtctgctttgcgctctgaccctgttagtcagcaaagcgcaggatgtcatggtgggcttggagcagggaagggctggagaaaaccatttgcaggagccttggtggaggcattgcaggctgttgggtctccccgcagcagagagaatggtctttaggggcattttggccagggttgctgggagaggctttcccaaatacttggtagcaattgggtgaaaagctgctggagcatcttctggctctgttgatgtttcttacggacttccagctcattagtgaaaaaatagagtcaacatctttctttgcagggtgagaaagaaacacccagagattttatttggcttttaattagggattattccagtgctagagtgaatggtctcagaaatattaaatgttcagtttgaattagtttattacagaaaagcttcttggtttgcagtatgaaatctgcaactaaagtttacactttttacttaggcagaaaatatatactgaagacatggcctttggagcttcaacttttccacctcagtatttatcttctgagataactcttcatccatatgcctatt

SEQ ID NO: 133715 - DNA, 1032 bp, Homo sapiens
ccacaagaaatgaaagctctgtttaaggtgagtagtgatgttgttttgttgtgtcctttagttggttgctttaatgtttaaaatgtaaagaaatggtaaatttgtacatcatatttaagtatcatgtatttttttgtatttaaccttttaaaaaatgattgaattgtgaatacttaatattttgctgctttaaaccttttttatagtggtggttttatttcatgttgctttttaatctttcctgcagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcaggtaaaaataaccaacaatgtagtataatgcgagcctactccttgtgccccagaaacattcctgctatgtatacagctgtttctatgggcttgttcattgtgactactccaagaaatgagacctgggtctgacacagcttagggcgtcagacttcctgagcaattctagaggtatttcttcccagggatgggattattatttggtacctgttgcattgtgggatcttaagtgcctataatttgtattatttggtatatacatttttctcttttcattgacttcactcataaaccatctggtacaagggacgtttattaactgtagtaactgtggtcttataattaaatgagtggcttcatgtagctgcagcctaccttatccattgcatttcaggagaaagatggggaagaggttatgcgttttatgctacctgcttccctctagtttattccagcaaactgaaagatggaaagtttactagcacagaaaattcattagagtccctttaaatttgcaatacaataaaatgtctaaaaagaataattaaaatgcccagctgcacaatcaggttaaggtaactatttcatcagccttagaattatagtcatgcctcacttactgatggggacacattctgagaaat

SEQ ID NO: 133716 - DNA, 1071 bp, Homo sapiens
gggctgttgtatacgtaatccattgctgatcagaccatcatatgtggcgcgtgactatacatactcctaaatgtacagtgcattttggtttttctgcatgatggtccaaccagagtgattgatacttatggtcatttaaactttatacttttacaaaggaaggtgaacaacaccggtaagagttacggtgttttgacaacaacctgttgcatcaatagcaatagtctttgtactctgcaatttttgcttgcatactggtcatcaaacagtaactaaatttttactcttacttttaattttgtaattacagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaaggtgaggtgagggtttctctctttttctttttcctttgtacactttaaattgtctcatttcaaacattacacattaaatcttgctgtgggctttgatgtccatggagctggggaggatgtattgggggaagcctttcattgtgcacttatatgaccttctttgtttgaacagtttataatgaggctgtaacatctagtgcagctattgttttatttgtgcgttttgttttgttttgttttgtttttgaaacggagtctcgctctgtcaccaggctgcagtgcagtggcacgatctcagctcactgcaacctccgcctcccgggttcaagcaattctcctgcctcagcctctcgagtagctgggactacgggcgcacactgccacgctggctaattttttttttgtattttagtagagacgggatttcaccatgttgcccaggctggtcttgaattcctgagctaaggcaatccgcctgcctgggcctcccaaagtgctaggattacaggcgtgagccacccacgccactgtgccc

SEQ ID NO: 133717 - DNA, 1058 bp, Homo sapiens
cttgagattataaatacgtacagtcttacgtttgaattgtttaaaactttgttcgtattttttccatgtcattaagtattttttgaaagcaacttgcattggatctctcatactgataggtataatttatttaaccattcttgaacaggtaagctatttctaattttttattggccttggtgagcataaaagttatgtttactaaaagaacaggctgtgttttaatattattttttattcctggactcatgttatgaattgacaaatggataaatttgtgaagcatatgaattttaaaaattattttaaatccattatctacttaatggattcaactttgaatcttttaatttacttttacctctggtgttagtcacttggaggagccttttaatatactcgacccccccatacacatagcgtcattatatgtcttatgtttaatatgtgagacagccttctgtcttcataacacagggcatacattgcaggcttacatttgttgtctttgtagacattttgatggactgttgaactttggtgtgtgcctagtgaatgatggcttttgcatttacatgggatcattgcagctttaagaattgtgtggtgcatctgtgccaacttgtaaagcttgtcagtagtatgttaaagtttttttaaaagttgccacaatactatgtgtggtgtgattccattatgggaatccgtataaaaatatgatacacaaatgtttatatcataggcaaagaagtagaaggatactaatgaagctatagatgtgggtggtgttttcctctagggagtgagatttggttgaaggaagtaatttaacttttcactttatgtacttatatatttggaaattttaattagcatatattttgcagattttaagaatggcaagggaagctatattttaaaattaaatgattactttgaaatggaaagtaactgcttaggcttttttaaaaaaatagattttatgttcgagagcagttttaggttcacagcaaagttgagaggaaagtacagatttcccatatgccccttgcctgcac

SEQ ID NO: 133718 - DNA, 1082 bp, Homo sapiens
tcacctgcctcacggtcctgcctcatacagcatttggaagactcccaggtgttctcgtgagagagggagagtagggaaggcaactgatgtgtttgtactccagaacggttttaactccatagacacctgcaagggtcatgggagcctcctgccacactgtaaggactgctcatctgtcctgtcctggccaagaagtaatattttcagagagagttccatgtaccctgctttgatatttttacagtagcttgtcctaacagagacatttttacaaaatgattccaaatttattcatagggtgttttcttttgtgttctcatgttcgatatgtatgtggttgagtaatggtctgtacttcacaggctgctctgaggatgtgtagttctctagtgaggggaacagtctgttttacccttgggggtagccacaggctgctgacaggtgttcacctgcctgtgtcctgatagatgtctttgttttgtctgtatatagagtttcatgggcacctaaaggagtagtgttgctgtacttatgcctctgttctaaaagaaataaattaccagttattgtgatagctgaagtctagtgatctttgacttctgatgttaaaggtacacttcaaggttagtagggccaaaatttgatctttagttcgttaattctgtgtgcttgccacgtggacatttattgtggattgttgttttttaactaaaactactgtttgtctacccacctccaacccccaggttaaaaaaccagtttccaggaaaattaaccttacaagttaaaagggaaaaaaatgcagcatgcatgccccaagaagaaaaacaagtttagtgactactatagtttccaagaggatgttttaaatgatagcctacatttaatgatgctctgagcagttacctcatgtaatgcatgtttgagtaactaaggaatttctattttactgttgagattgttcaacaattttggttatctttgagcagagttatcttggacaccaatgggttatgttgttcgacagacattatctacagaactgtcagcagcccctaaaaatgttacttctatgataaact

SEQ ID NO: 133719 - DNA, 1691 bp, Homo sapiens
gggagagactctgggaaaagcctcagacaggagtgtccacacctatactgttcccacctgaaggctactcatcttaaggagtaagcactcttcggtttgttggaaccctttggtcactttccagagggctgatatgactgtgtttggcagttctgttgaacttcgtggttgtttttgtgggagggaatggttgatcttcctctgttgtaggaaggaccctcctcaggcccggtgtcagtgctttgtgaagagttgcctggcagtggggtgcaggaggtgtagagctagagggcttgtggcaggttttgcaggagcccaggtgagatgctgaacttggtggtgtcattggggaccgggtgagtgagcacctatgagccatacagggttttccacgaagagctgagaaaaacaattgagccagtcacatagtcacatgtatgtttcaaaccccatgtggaaacaaggctccaaagatggaagcagctgtgctcactaaggccagagcagcctgggaggcaggtacagttgtcttggttgacctgtgcaggttacgttctgcgttgaagcagtgaatcagacagtcagacaggcgagatttagtgggactgcctgattgacaaagcaccaattattttaaaaacatgttccaaaattaaaggagggcaggtaaaatacatttggagaaatattgatgattgttgaagctggacgatggacacagggggtttgtttaccattcttttttctttggcgtatgtttggaaattttccagatcaaaaagtgaggataaaactatatgagaattaactgattacttgaaataactattgagatgggaaatagaacagaaaaggagaataaaattgaaatgttcagtagtaatcacaataatttactgactatgtagaggaattaccaactgcccatgatgggattttggaaaacacgtctggaaaactcaagagaattaactagaaatattactagaatcttatagtggccttataaggtagctagatacaagatacacatgcggaaaccaatagggccagcttccacaaaggcagtgtcaactggaaacggtggtggagagggacgtgttcacagtagcagcagtgagtgcagaccacctagaactgtcctgagtcagaaaatgagatccatgctgtattagactgtactgagaaacatgggagatctgattacatggataggaaggtaggtgttcctaaattacttgatactttttgggaatctcatccaaaagatactaagtttcatttggaattactgccaatgaaaagaatgtgtaagagattgttctcaaagatgagaagggttgtggggacaagctgggggtgacttggcaaactccttcagataccctgaggcagcccctgggcgagctgcgatccaagagctgggtggggcatctgggaggtgaccgtgagggctttgtcccactgcgtttcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaaggtatgtggggtgtttcagccgaagtgaggcactagaaaacttagtctca

SEQ ID NO: 133720 - DNA, 1013 bp, Homo sapiens
atcacaaaggatcaagaatcagagtctctggatttcaagcaagaccttcaaaatatgcctcccatgaatccttttctcctaaaccactggaggatgcactccaacaaaacaagagtgcagcccaagaagaagtccataaacaacaccttattgagagcagggtgggagccaagggtatccctgggtggcaaatgcatgaggtgcagtgagctgggaatgaaggtttcttcagcagatgaaactgcagaatgcctggtgtaaccgtcttagaggagactgaggcagctggctgagggcatgaggtttcattaatgctaagtatatagacaattaagcaaccaccacaaaacaagaacaataacccaaactatacattaggggaagtaacagcaaagcccttttgctctattgggaagatgacaaatacttaaaactgaaaacatgtgaagcagttgctcacaagcctcttacatggagatatggaggaaatatcccacagtgtggctaacagctgacaggtggagttgctaggaaaggaagggagcccaagcctgcccctcccttaacaaaccctataggactacttgaccctttagctgtggacatgtacaacactgacaaaaacagccagggaagcatgtggcctgtcctctccaatgacctggaaaggcctctgggcacacaatcagatgagtgggtcactgagatcccttctgtcatattctggtcagcggtgatgctggacccgtaccaagttaggacagggacgagctgctggctgggggcctcggacatgtcacaaaacttccaggctttagatatgaaatggtaactgggaaacatcatctttgagggttcagccccaggatgtggatgcattatctcaaagtgggactccgtaaagctgaatttgacactgcaggagaaaggaatgaggccagggaggggcttgtgagtgttccctagcctagatggagatgaaggacaggtgtccatgagcaatgccactctgc

SEQ ID NO: 133721 - DNA, 1054 bp, Homo sapiens
aaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaattttgtttcagactctggtgattttaggcttctcagtggtctctgtcttacttgatgattcctatgtcttaatttacctcctttggacagtctgggccctgaaataaaagggggccgcgtagtgggggttctgctatccccagcactcctaggtctggaagtagtgattgtcaaagcctccagcactgcacagacctgccggagccagatcctggctcaatcccaacctgcacttgcgttttcaccacagccaatggcaggaaagaattttcactgctttttgta

SEQ ID NO: 133722 - DNA, 1045 bp, Homo sapiens
ccactcagctcatccaggctaccttcccttgctcaaaacccacctcgtggatgtgggaaggtcctcttcttcgagagagtaaaagttaaaaaaaaagaaaagtaaaacgaagtacagaaagaaaatctctccaaaaacaatgcttccctcaaggaataaagttaaaaaaaaaaaaagaaaaagaaaaaaggtgagtgggctccggggagtgtttatgtctacatttctaaaagcagaaagaatgcatttagcaaaaggaagtttatccctgagaatcttaagcaacgtaagccgtattttatgccaaatatataacaaaatctggaagatatacatcttcttctaaatattaacacaactgcttctgtaactaaaaaaaaatgacccatgacataaacacaatcaaagcaaaatcctaaaaaaataattaagtggaagaaaaggttcgtgccaatctggacaacaggcgataagttaccaatctgataaactaaaatgtcatttccaatctggaattaaataatcttttagtggctgctacggggaggggaagctgaagggatgctcttctcagccaacagaggtccagccacctttcccccactacagaaagggctcaggaactccgtgccgcccgtgggccttcttcaagtactccgactgacttcggaacacaagactgggatgcaatgcttgtcatttttccaaaaggacaaagagaaaccaagtcacaggctcaacccaagagaaaatagacaagaggactgaggttgtctgcacgatgcgggctaacctacgcagcactgcacgagactcggatactgaacaggagaaacacaaaactctccacgcctggacacgtcgcagccgaggcaccagcggggatgcacagccggcctcagtctccatctgcgtctgagtcagcgaacttcagctcacacttgacgtcaaagggcttgtccctggcagaaaggtcgtcgatcctctgtgagtcctccctatccgtggggactttgctggtgatggtgtcttgctcggtctcata

SEQ ID NO: 133723 - DNA, 2072 bp, Homo sapiens
tgagctgggggggttgaagctgcagtgagctgtgattgcaccactgcactccagcctgggcaacagagccagaccctgtttcaaaaaaaagaaaaaaaagaaaagtttaggcaggaggagagtgctgagatgcactgaaaggccagtcttccttgcagccattagcagaagcgtctcgtgtctgattcaaagagctgacactaggcacagaactggcctctgctcagcttccccagcctgacgcgttttcttctgggacacgggtgagaaatgggatttctgctgctcagagctgcctccaatttctttgtccccatgggctgtcatccagggctcatctttgctttttggtcacgcatgtctttatctccttagttgttctggaagattccatgttgctacagtgggtgaaactcttgcgtcatcttgtgggtattttaaagaagttgttaaatagcaaatggggattgttgacgctgtgcacgtttattttgatgttccagataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttcct

SEQ ID NO: 133724 - DNA, 1048 bp, Homo sapiens
ccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtctcatacacgcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggtatggggcgggatgcgctgcctggggatgtcccccatgtgtgtgggtgaataacacgtgccggttgttttgcaggggtttgattcaggagatgagcggcgatgcttctgtgtgcccgggtgagtgactcctcgacgtcccatttcctttgggagtggcgaggtcttgtagccatttcacggtgcttcagttctgtggcatttgtgtgtgttttgtttttctttctccactcggaacagaggtcaagtgttctgtagcagactcgtggtcttctctgtctttttttcttgccgaaagagtacttgaagccacttagagtgtatctgcttactgggaagcagtctccttccaaaaccatcctgttttctttctgcttagcttggggctcattaagcaaaacctaagcctgttataaatggggagaaaggagcccatgagtgattaatcctcaggcagtgtaagggctgg

SEQ ID NO: 133725 - DNA, 1047 bp, Homo sapiens
gccacggtggctggcagcgcattgtggcctgcccttggagcctcccagccaacctcacatgccccctgtcctcaccgcctgcctagggcacttaccagtgacaccccgagggctggtggagcatgggagccccctcatgtggcacttagcctcaagtgtaatgtcgactgttggtgaggattcttggggtcaaccatggaacagtttattttccttggaaaaaaactggaataacccataacacttgggtttccagttgtctgttttgccaaagccttttcctttttttgtttctaatgcgaaatcatcattgttttctaagtatctgtggagggaatgacttgagagtgaagagtgtgaagtttgccgctgtggtcactgtccttggtttctgtgtctgggttagtgtcactgacctgtagctttggccctgcagaccggggagctctgcacaaagccatcagcctcgagcacgctgttcacatcatcgaggagacccagctcttccaggactttgagccagtccagaccctgctgctgtcttcaaagaaggtaaagtgacgcaggcagctggaccgggggcttctccgctcggtggctttgattctaggtgacaggagagttggcaagctggagtcgggctcctgggcaggcccctctgtctgtctgccctgggtgagccaaccttcagagtttgacacagagccattccgtgagctgtgggatctgaattggggaaggcaggaaggcagacctggggagacgggactttctcttcgaagttgctggaatgtcattgagttgttggtgcagctttacaggctgtggagaggtgggcactgctccatgaagacacctttttatgccctgagcttggggggtgtgcagactgcatctgtgggatatgatagtgatacagctgactcgtcaccgtggaaaatccacaagagaagtggttcgtctcatctgtaaagctgtctccacctgtggctgagactctggtctggcctgcaatactcccaagcagcccttggcaggggtgggtgg

SEQ ID NO: 133726 - DNA, 1076 bp, Homo sapiens
tgcgatctcggcttactgcaaccttcgcctcccgggttcaagagattctcctgcctcagcctctcgagtagctgggattacaggcgcccgccaccactcccagataatttttgtatttttagtaaagatggagtttcaccatgttggccaggctggtctggaactcctgacctcaggtgatccgcctgcctcagcctcccaaagtgctgggatcacaggtgtgagccactgcgcccggcctgtagagtcactttgaatggatggaaaaaagcccactttgatgtttgaaaatacttatggtttaggtttttgaaaaataatttaattttctccactttcacgagtttgatttttgctgctgttttatggtgagtgatggaacttttggagctggtcttccagactccactggtttcaggataaggatcacagtgaggatgttcatgaaggccccaggctgctcccctgctctctgaacctcccttgcagtctgagaattgatcatctcaggagaaacctctaggctctaaactctatcatgtgcttttaaaattgtgcatttttatactagtatctctttaaaagaatatgcactgatatggactctatcccaacaggtgtattggaaggtctcagaagacaaaaaagcaaaatgtgcagaaaaggggaaatcaaaacaggtaaatttcttttgcaagctacaaagaatcccattcaagtatttcttggttgttttaatctactgaatgccagcatgcctgcagtgcaggccagccttttctccaggctctgttcattctgctgggcttggttttgttgtgatgcgtcttggagctcatccctctattcctgagtatcaggattgggtttctcaaagcaggtgccaaacatatttggcctttgagaaatacttttttaaagtttatatgaattgaatgtattcagatggcctgaaactttgactacagaacactggtgaatagtgaagcccactggtgaatagtgcagaaattcagggtttgttctgcctccttgcacccagaggccttaggcttggaggagttgctagtcatgca

SEQ ID NO: 133727 - DNA, 1051 bp, Homo sapiens
gtagactggtcctggcagctgccctgctgggtgagtccggcccaacacaggtccagggctaggcatgtccctgcagagctggagtgttggtctccagggatccattttaattctaggaaaactgaagttggaacaataaactgtttattatgcttgtgacctagacagctcctgaaacccattcctgattcctgatgggataaggccattttatcctcagtttgcaaggcagtgacatcagcatcctaactggaggtgggagaggggtttctgggggcagaggacatcccagggtggggatactaggtggccaggtactggcagggcatggttggtgagggctgtggtgtcttctgtttcccagcacctggctgcctgcttccagctgggagggaagatgtggtgagtgcgtgtcctccactgtcctggttgtagggcctggagagactctaagctttacctgccccatctgggcaaacccctgagataagaaataagccagaacacgctcccccaggcagtagtttgcatgcagtgaggtcaggggtccaggtaatgactgcctatgttagattggccagtccacagctgtcaccagagatcccctttcagtttccctgggatgccagccagggcattttaatgccagtgttgcatcctgttgctggcagaagcactgacaccttccatgtggtagtgactggtgtcccctctgtaatctaccctagctgccagacagctgatcccaggaaggagccgagacacgggtgactggacagtccccagatggcattttggttcatggttcctgccttacaggacacttgccagcagtcactattcacatctaagatgcaacactagatcagaatgtatgttctgcaacagagtgacacatgcacagatgcacatatacacacatgcacacacagatgcgcacatacatgtctgcgtacacatacacagatgcgcacacagatgcatgcacgtatgtgcacatatagctgtgcacacatacatgtatatgcatacacagatacatatgtatgga

SEQ ID NO: 133728 - DNA, 1050 bp, Homo sapiens
ccagtggtggtcctcaacttgtgaccactgagatggttgggaagagcctgcccagggaattgttcagtgtgggggccgtatccctccatgacaggtcagcggtggtcagacggacagcagcaggccctcagtgacacacgcaggtgagaagggcctgggtgttggagccagcgtctcaggtcagccctaagccacccacgcctacagggcagagtccacccctcagggccaggcgggccctccacaggtggtcaccctagtggtgagtgcatccctaggggaaacacacctccttcctgggccctacgagagacagaacaatggccaggtagcccccctcctggagctctcagacctggaaggtgactgtgtggggggcaatgagtgacagtgactcaccagctcctccccacgtgtgacccgccacgtcgcacacattctgaatcatctggaaggtgacacactgctcggaaaatgagaacccccacatgctgtagagctggctgcttgctggaaggacagacaccgggatgggactttgcagggccgtagccccgtaggcttgggcactttgaagtcagccccactaaatgccacttgcaggtgctgctgaccggggggtggagagggggttccaggttaataggaccaggttccttttagcagtgcagggaaacgtgagtgagatctgttcccatttgggtgctgcagagtgaatcctgaaatattgggggtttgcttgactccttcagtggggaattcctacctgggctcctttcacactgagaggacggcaggggttactccccaggccccggctgtctcagggaggcaggggctgtggttttctgatacaggcatctcaccagggtcacaccgcctccttagtccatatgcacttgaccctcttctggcatctacggctatttggggttggatggacctgagtgactgactgtatcattttaggctgcccccctcttctgactccccaggaagggaattgagggactgccttacttgggctggaagcatctggaagagaggaga

SEQ ID NO: 133729 - DNA, 1041 bp, Homo sapiens
aggccacgtgcttcctgttttagggtcgtctgcccagctgggagcaggccatctcgctgcagcactgtccagcagctctgtgcatgctcacctcccaagtttgccctcattgctacctcttgactgagctgtcttcgtgattcctgagtccaaggctggacatgagagctcagagggccagagtgacttgcccagggctacatctgcttcctcgggacttcacctctagccccattgtcccgtggccttaggcagctcacccatcctgccatggagcccccagatgactgaagtagtggccaggcctgcagggtcctcaggcacccaggagcttgccctcgccaggcgacctgctgctccatgggtggacaatggtgtgcatggcttgggtgctgggccgcaaccccccacaccctcctctaaggcagcctttctcctccttcctcagccttgggactgggccctgccccacgagcccctgaattagcccacacaggaaaacaatcaggcccacatcgctgaacagccccgctgtttaaaaggaagagaatgggacagggttgttccacagcctgcggagaaggctcaccacgggaccttgtccctgcgctgaagggtgccttgttgtggctggagcagtcctggcctgagccccaactaataacagagcccttgaaacccctgcagtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaaggtgaggccagctgggcagggtcaggggcttgggttttctttgtcatttggtaaatggtcttgtgttcccatttctcacccctcactggggttgagtgagaatgagctgagtaagtgggcttccttctaatgtgaggggaccaaatgaccagctgcccttctggacaaccagaggaaaaacacacttgagtggaccttacaggcttcactccaga

SEQ ID NO: 133730 - DNA, 1068 bp, Homo sapiens
cgaatatgtctcttttctcttagggctcgtgggtaccagcgtttgttaagaagattacatgggttgtctgaggattttctggcaggagttttcttgttttgtgtgtttgaattaaactcttgaacgtgtctagaatgcttttaacatgaaataatatgcttggggtgggggagggcaattttgtttccttccagtgtgccagcactaattagtcaataatccgtcctttgaccaatgaattgaatgacagctctgtggtctgttagggtctcatgtaaactgggttccgtctggggatcctccatcccactcgctggcctgcttgtctcttcacgtgcccacatcccgtcagtagcggctgcagagcaagtgctgatagctgggaggagtcccctcatgtgctgtgtgtgtgatgacgtgctttgtgagccgtgatggcaggagtgctcctgtgtatgcctgtatgtgtttgcctgtgtttctccttatgactcctgggcagagcatgataagggtgggtacactgtagctgtgctagaggggcagccagggaggaggccatggaggtggggagggaggccaaggtgaagcaggaaaacagagaccaccaggtggacgcagaattatgtctatggtaggtaggtataatttctaaaaggcaaggtgtctaggacaataaatgtaaagcaggtttattatggggggagcagtgaaaagagaacccttcgtgtcagggacccacccactgcttggatttcctttgggcatgagtgccctgactctgcccgtggtgggaggatgcatgggcatgcagtggggtgaccgtgtcactgcagcttaggtgcctgtgcctggcccagggctgcctgactctgggcccctgaggatgcccatgcccaggcacctctggcagctggcacctcgcagtctccaaatgctctctgtgccccatcttctgtggcactgctttagcagggcaggccacacctatgcagggagcccaggaggtcagggcctgcagttacccactggtgaccccagccccacccatgctgtggagggagggta

SEQ ID NO: 133731 - DNA, 1026 bp, Homo sapiens
ccagcagcttcccctagaagcataggataagacaggcagcaaagggctctgcgtcctcagagaaaggagcacaggttggcttggacatctgtctgggggagccagagagccacaggatacaatgctgtgtcttgcgtgtgatttcttagacccaaactcttacacttgcatgtgcttatggggagttgagtgcagaaagtgaattcctttgagtttggtggttgttttgataccgcctgcatttaagctcttccttcttaatttacaacaaccctgtagtctttataaagtgcactgtgtgggtgctgcccagcctccctagggtctgagtgtgccccactgcttggaggcagggctgcttcacctgcactgggatggagccctgttcataggagctgggctttatttttagcagatacagttccacgtctcacagagttgagagcaggaagactgtagatttaattaaatgacactgaaaggggaggtaattacttctgcatgtttcaggaggcccaggagggtgtcccaggtcctctgctgcagccctgtgaggctgttacctggaaaacacccaagatcccatccctgatgggcactcagggtcctgtgcattactctgactaatgatgaacaatgtgagctttcctctctgaagcctggctttggagataagccatgcagtctagagacagtgcagcaggtcacttcagaggaagcatggtcaagccgtgcatcccaaagctgctttaacaggacgggacacctggcgtggtggctcacgcatataatcccagcactttgggaggccgaggtgggtagatcatctgaggtggggagttcaagaccaatgtggccaaattggtgaaacccccatctctactcaaaatacaaaaattagccgggcgtggtggctcatgcctgtaatcccagccactctggaggctgagataggagaatcgcttgaagccaggaggcggaggttgcagtgagctgagatcgcaccattgcactccagcctaggcg

SEQ ID NO: 133732 - DNA, 1128 bp, Homo sapiens
agttgacatgtgacatcagccatcacactggtcagtgctccccagtgcacgggccccgtggcatgctatgttttataaaccagtgtgggccctaggtaaggtgtgtgagcttgctcaaggtgtattgtatgaaggtgttgccctgctcccagaagcctgccccagagcaggcagggcttgttattcttgcccagagatcatcgggccagcatgaggtggccgaaggttggcacttcttacattctaatggcaccaggagcgaggtccggggccttgtgcaagctgcgctcacacctcagccgaccttctgcttcttaggaaggttgcttcattccggtcaccactggccccatatttaagcatcagtaataccttaggtgcctctggggaccattcctgttgtcctccttccaaaaactgcttcattttccttcaaaatgtgacatggcttggacatgctagaggcatttattagcagaaagcctgggagctctgcctccatgatattttctttttctgggaaaaaaaatatttgtgcaagccatggtcatatcattgtttcccgctctctgtgagcctgctgacattggcctcccgtgtgcctggcgtgctcttatcagacctgtgtgccatcctgtgaattctaccgtaaacagtcacagcgaggcgggagaaacacagcctggtggtccacggcaggcttggtctggactggatgggagctgcctgatggatcagtaggggaatgcagaggggtgccagctccaggactggtaaaggtggctcttctctttcttttccatcaggtgcagtgttggagtgaatgaatgattgatgggtgaacaagtgagagagtggagctggtcacagaggtaggagggactcaggtcactggccgtgtggtgggagtggggagctgagcccatgccaaggctgtgacccatggaccagtcctggtgtggttgggctggcaggagtgggtgtttgttcctgggactggtggtcagcatgtgtccccttccctgcttctcactggctgaggctcaggatctgggggcccagcaggccccttctggctcccaggtgggtggggacatgggtctcagtcccacctgctttcaggccctt

SEQ ID NO: 133733 - DNA, 1051 bp, Homo sapiens
ccgcctagtgagctgcaaggggctggctctactggggttatgccagtaaaaacgtgtaaaggagagttgaactcgtggttgtcctctattttctggcttagtattttggggggtaggtgggagagtgggtgaatgggagtctgtaagtgggcagtttgcgtcaaatgaggcctggtgtcgagggctgggtcctgctttccggaaggttttccacatgaagttgctttgcttttgttttgaaaacctcactctgtgttgagcacatcccaggctcgtgggtggccaggcccccgaaggccaagctggacgtggggcctggggccaagcatctcaccctgctgttctgagtcttttcaaatccaccaggcgccacggaacggaagtttcctttcctgggggtgacgtgacaccagtggcctgtcacctcatatgtgtcctaggcctggggcctgcctgctggctgcccaggcgaggttatttgggaatgtttactgtgtcccagaaacaggcagctctggccagtgcaggggcaggattctggtagagatgataatgccctgattgtcattttgacagttggtgtctgcgtatatcatgtcttggtagtcgtcagccagaagaagaaagcaggcgggctcagcatacccaccagggaggctggggtgggaagatgagggatgcactggcctgtttctgtgagcaaagactgccctcccataaggccagaccttcagactgagaagagtgtacgtggtacactcagcgagtcaaacaaagaaatagaaacacatcactggtgccaggagcagccctggggtcccaggagggtgggccgcttaggagttggtagacggtggaactcagtggctgtatttcagagtgcagacaggcaaaaggccaccgtggggatgcagagccccagctgccatgccagcccaaggtcttgcagcacagcacaagggagggactccatgggagggggcccacctcctgagaagcacacccagagtctgttgaaaatgcagccttgcacagacccccctgagtgcct

SEQ ID NO: 133734 - DNA, 1048 bp, Homo sapiens
agcttgtctattgagagctggtgaggaagagggtgacagggcacctcttggtcctgggaacgggtgcttgactcagcagagaccaacccagggctgagggacaaccctctgggcctggcggggaggcaagagagatgggaggtgaggaggaaggagtggggagcaaaagtggggagaaggggagagaggtggaagagtgttgcgaaggtgaagaaagaggaggaaaaagagaagggaggaaaagaaaggttgggggagggaaaggagggaggtgagcaggggcgaggaggagggaggaggaaggaggaagaaaggggcggggccataggagggaagagaagaagggggagaggaaggggaagggaaaggggaggaggcgggaagggagggggagcggaggaggggcctgcgcgcccgccccgcgcactccgtccccgcgccggcctcagcgctctcgcgcgccgcagcatcccagccgccgctgccgccgccgggcctccccgccaccccctccccggcccggccgcctcccgccgctgccgccgccgccgccgccgccattcctggcgcccgaactcgcccggccgggagccgccgcgggcaggacgcgcgctgcaggtaagcggccgggctggcgcgggagggagggcgcgcggggccgggcaggtgcgctgggggcggcctggaccctccgcggagcccccactccacacccctaggctcctcaccggaccctcggggccctccccgaacccctgcaggagcctccttctgggatccccggacccctggactccttcctggatccccccggggcccctcctgggacgcctcccagagacacctacccggacccctccgaccccctggacctctctgctatccctccccggccttctccccttcccggttgcctccccagtccctgcgcgcaggtggctcctctgggcgcgggggagcgggggcgcgctgcatacccgggccagggagggggcggtgcgctcggccaggccccgtcgcgccccggcccgcccagtccggccccgcc

SEQ ID NO: 133735 - DNA, 1095 bp, Homo sapiens
ttctagcttgcccgtcttagcataggcatcactgcttctgaagtggggatgtctttgatcctggcagggcaggcagacctcttagttgtgctgtgacatcctagagtgccatgcatggtggggggacttcagaacagatgcatgggccccacccctgggtttctgggccaggtgcagctagacaagctgggcatgctctctgcagggccacccagctcgggctgcccttctgcatcgcagcgcaagagagagaacagctttgccagagagcagaaggagcctgagttttcacactgaatggtcataccgtggatgtctattttcctgggagttgctgggattgccagctctgggccctgggggtgttggggacattaaggactctgaggttccatctccagctactcggagagggttccttgtgtcattcatcaggcagcttgcttatcttatccctcttttagcaattgtcatactgcattaaagttagtttgctggtctctctattagcctggatgattttgcggttctggactctgttttattgaccattatgtctccagcacctcagaaagctttctgtgattggagtctttgaatgaggctgtgagtggatgacgagcctctgaaccgacgcgggcgggagggggctgctggccaactcactcaccgggccacctttactgtctgtttactgtctgtttactttaaaagaatgccttggtggtctgaaaaccttcctaagtgccaaatgagagcatctcaaagctggcagagcccctgggtgttatcagggtggagaatcacgttcctttcattctctgatgggagcgtgcatgtgtgtgcgtatgcccatcaccctccactggcttcactcatgatcgcagataaggggaaaacacttacctcggactttggattgaaaccagatcaggaggcttagtcaccccaaacgcaaccttagaaagcatgaagttaatatgaaacatcggcccgtgtaacgtagcaaaacctcccctgtgaatgagttttaaactttttttttttttttttaacatcctgaatgtttttgagcacatgctgctgccttcttag

SEQ ID NO: 133736 - DNA, 1025 bp, Homo sapiens
acccactggaaggtgcaagcagacggaggtggacaaagccctgggctcatggcagggcccctgcagtatctgcctggaggacctcaggcaccacagttccctctcccattctgtatgccctgtggctactctggacacagtccccataggaggtggtagttgactggggatgccataacaaagtgccacacactaggtgacttagaacaatagcaatggagtgttttacagttctggaggccagaaatccaagatccaggtgttggcagggccccactccccgtgaaggcaccaggactctctctgcccaaggcctctctcctaccttctgttagttccttggcttgtggcagcagagctccaatccttacatggcattctctacgtgtacgaatgcatctatgtccaaatttcccctttacataaggatatgaatcatactggattggggcccacccttgcaatcctatcttaaataattacctttgtaacagctctatctccagatctacacacacactcggagggacttgggggttaggatttcaacctgtgaattttggagggaacgtaattcaacctataactaggtgggatgtttacttgctgaaggaacagacagtcccactaggctgggaatggtagacccagagagggctggaggggagctttggggctaaaaagacagattacatgcaagccagcctcctgaacctgggaccctcagctcttcttcccactctgcttccacaggtctaccctgccctcacctggggagaagtgtggaggactcctccttggagaaagtgaaaaactcccagagaaaacattggcaggaattggcattggatgggtcctggcttgagactagctcccattgcatcagtctgcaagccctctgctatttctacctccccacccaaactccaatccacacttactttaatgtcccattctgcaatgtgagtgggcagcggaaggtcaccagaagctgtagagaaagtctttacatgaaagacagacac

SEQ ID NO: 133737 - DNA, 1053 bp, Homo sapiens
aaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaatt

SEQ ID NO: 133738 - DNA, 1903 bp, Homo sapiens
ctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggttt

SEQ ID NO: 133739 - DNA, 1044 bp, Homo sapiens
caacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgcc

SEQ ID NO: 133740 - DNA, 1050 bp, Homo sapiens
attaaagttatgttcgtatttcttctcttaacaagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcaatttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccac

SEQ ID NO: 133741 - DNA, 1039 bp, Homo sapiens
gacacgctctacagcacgcagtttccctgattaactaacttagaaaacatggccaagtacattcacagtgcacattaatctactaatagctccaaagagcactgcaaccaagatcttttcatggagcttttctagctcaacattctcctgacttcttttgccactaccactaggtgctcaatacctattagcatgatagagtgctgttccccccacactcactgggaaatgtgcttaaggagaattagggaggcatctctaaagggcaatggtcatttggtccaaccctgaaatcacaccaaggaagcaggtatctgtgttcttattaactggaaagccagccctgtcctgtcagttctcaaaggttaatttacacatgatatgttctttcactctctctctctcagatacatacacacacacacactctctctctctctctctctctctctctctctctctctctctgtctctctctctctccagggcatatagattcaatctttcctccaaagaaaaagaagaaacgatgacagcactttggtatagaaaggtgtgggcagcaagacacccaggtgccgaggcaagagactgaaggcacaagctgttccagtataataaagaaaataataagaataagaatagttatactagaaatagaatatagatatgattatatatgaatattattaatcattagtttgtagaattactctttgttctgttattataataatccctattctagaattataacctaggaataaccaggccatacggagttaggagctgaagggacacgatgagaagtgaccagaaggtaagagtgtgagccctctgtcacgcccagataagcgcaactagaggactccttggtctagtggtaacgccagtgcctgggaaggcacctgttacttaagcgggaaagggaatctccttttccctggaggaattagagaacactctgctccaccacttcttgtgggagtcctgacattagccaggcccacacacagccattcagaagcttgaacgtctc

SEQ ID NO: 133742 - DNA, 1102 bp, Homo sapiens
agttttttttggtttgtaagtttgtgaaatatattcagctataattattttattgagtactgcttatgcaccagatacttgttagtaatggctggaaatacagtagtaaacagagacaaacccccagccttcatagagcttacattcgaggaggcagacggatacataaaatatatactatgttagaccatagtaaatgtggtgatggaaaaattaagcagaagatgggagaaagaatgtgaatgagaaggttattagaatgggtatcgggtgttttcagatgaatcctgatggtcttaagacagaggtgggagggtgctgggcactgctcccatttctgctgggccgaatggaggcccagggaggagcaaggcaaacgcacagtgctctcggcttcaggatttcccttgactcctaagatgtgctgattggcccaggacactgacgggatgtgtagaaagcaacattttaaaagagtagcaagctgggggagcatgagagcaccttaagtgtacttcagcaggcacaggtgtagtgggattaaataggcaattattgtgggatgaagtttaaaagtacatttggatacaagaattgacattttaaatactttactataaaaattgaagcacatggcctattaaatctggaccatatgttcgttatcctaatgtctattttagttgtgacaccacataaagaatgtgtaggagcaccagcttttagaataacacaatttccagggggagctgctgttgtgtttccttatttaacatacaaaagcatttgatgcctgatactcacatgcttgtgcaatatatatagaaaagtcttggaattatagaaaattagaagcatatttaggccgggtacggtagctcatgcctgtaatcccagcactttgggaggccgaggcgggtggatcacctgaggtcaagagttccagaccagtctggccaacatgttgaaactccgtctatactaaaaatacaaagaattagccgggcgtggtggcgggcgcctgtaataccagctgctcaggaggctgaggcaggagaatcgcttgaacctgggaggcggaggctgcagtgagctgagattg

SEQ ID NO: 133743 - DNA, 1348 bp, Homo sapiens
ctcttgttctctcgagtgtaagaccaaggggcctagcccactggtaagtcctcagtgtgtatatttgaatgcgtaaattactgctcctggagaaaagagaatgagattaacttcaaaggatagttatacagaaaagattggagaattaataatatgagtatgttatttactttaactgcccttttttcattaaaattagctttatttatgtgttcaaattatgtaagtaatggaatctaattaattggtgattttggttatgagtattttaatttcctccttataacctcaaatttatgtcagtgtttattgctctcatttttaaaaattgctagtaacttgctctcttagaaaaaacaggttattcattttatgagtggcaggttactttcttattatccagcagtaatcaaggtggtcttatttacattttaatattctatagtgtttatttttgtatcaagttaaataaatggtctcaagaatcactttaagcagtctagaaagcagatgttgaaagacctacctttttctcagagtcattaaatagaatatgtagaaagttaatcaaggaagttaaattagttctgcctataaattaagaagagcggcagttcatttcccttatcttttaaaaataaaactgaattcactttttacaaaccttccagtttggtgactgcttttttgaacctctagtgcctgtaatgtgaaaaacagggtgtgaattgtttggacttaccatcagagagatatttcagtgtgtacctgtcagcatgccatccgacagacgtaaatgtcaagtctaatgataacaagaactctgatttggaataatagagttaagcttacattcctttaagaaaactgaacacactagctcagcagtaacatttatggttaaacatctgatgactagccatgtctacctgtggagtcgaataagtagctcatggcatgtgctttggagtgaggtccctcttggcttgtgatagagtttagatatttgtttccaccaaatgtcatgttaattgtgacccgcagtgttggaggaggggcctggtgggaagtgactggatcgttggggcagatttcccatgaacagctttgcaccgtccccttggtgatgagcgagttcacaggtgatctggttgtttaaaactgtgtggcacttccccctccttgctctcttgctcctgctctcaccatatgagatgtctgctccccctttgccttctgccatgattgtaagcttcttgaggccctcaccagaagcagatgctgatacagcacttcctgtacagcctgcagaactgggaggcaattaaacctcttttctttataaatt

SEQ ID NO: 133744 - DNA, 1757 bp, Homo sapiens
attatcctgtgtatctttctgtaattaatactttttcaataatattattcattggatttatctgtatttactcttaattctttcaccttcatgcttatacaggtaacattctatttataattatgtccttgttttattaattctcctatggatggatatttaggttatatccatttttttgctagtctttgtatgctcccttgaattttattgtacatattttcttgggtatttgagagattttctagggtatacatatctaagatctgatggatgctgggatatgtgctttgtcaactgaggttctcactcccctggaagtgtgtgagatcagaatgcccctgccctagcccttacttatattatgtatcagcatgattgatttgtaatagactaataagggtaaatagctgagtgtatgccttctatactgtaattttactttgttgttcgtctgtttgtttaattggggacccatcttttttcagattgttaattttgctaaagatcttctttgttctcagagttaattatcccttaaggaattccatgtgtttatttttctctgttccaaagttacgattctgtgctaaagtcataattatgaaatcatcagtttgttcatactttaaatctatgcttctcccttgtggttgacagtccccaaggcaggcatccatgaagtcaaaaggactgaccaaagtgtaatctgccctttttactgggttggcatttgtgctaatacactgcaaaagcagtggtggataaactgacagcaccttgcaaagcagcaaggtggtgtcaccaatttgtcattatttatgttaacattaatgggttcatttgtatttttaaatgaataaacatttaaacaatttcttagttttgatttctaatagagtaactatagatcagtagatgccaactatagtgtcttcctttaagagcgtgaaggggcctgagactggaaagctggagaagcaccgctttaagcacatggtagacgtatgaatagacaaatactttattcttgttgaacatggtcattgggaaggaaaactgaggtaatgtcattctattaaaagatgaattaggctgatcttgaagttgtatactaatcttaagtaaattttcaattctttgccttaaaattttgtttacaactagattatatttgtaaataaaatactttgcaggtgctgaccttaaggaaagagccaaaatgagttccagtgaagttggtccttttgtctccaaaataagagcagtgattaacgatattggtaagcactattaagttcttctttcagcatgccgaaggggttcttaaatgtcacatttaaaaagttacacattatatataagcattggttaaatatttatataattagataatcatgacctatagctgtttaacgtgacacttaatatatttaatttgaaaaattatgtaaaatatttaataattacagatgtcttatgtatgataaaatatgaaggtatttatttattagacaacaataataatttgccataagcctttgacttacaatatctatatttaactatatacatgcaaacatacgtttgggattcctttgttttttaaatatacaggatcatacttttttaagacttacagtaactatcaatttattttatttttaatttactgctgtatattaatccagtcttatccaaaattttatattatttcttcattaatgaacatttttttcctctgtttatgttattta

SEQ ID NO: 133745 - DNA, 1055 bp, Homo sapiens
ctctgctgggcgcggtggctcatgcctgtaattccagcactttggaagtcgaggtgggtggatcacaaggtcaagaattcgagaccagcctggccaacatagtgaaaccctgtctctactaaaaatacaaaaaattttctgggcgtggtagtaggtgcctgtaatcccagctactcaggaggccgaggcaggataattgcttgaacctgggaggcagaggttgcagtgagccgagatgacgccacctcattccagcccgggtgacagtgtgagactccggctcaaaaaaaaaagaaacctcaaaaacacagtgtaccgtttattgattatccttttagcctcttctccatcccttgaaagtcatcattttccctcttctttttcttctcccacaaaggtttctctgtatatattaatactgtattccagtgataccttgctcatttctaaatatttaaagcttagcaaatggtcttgcctcaaatttcttgagcataggaactcctcttattctttgagaatcatcttttacattctcagaacacagcaaacaacagggactcagcatttatttgctggaattaatcagcctttaaactgtgctttaattcactgatttttttcaggaatggttgggatataataagcagcttctctgaattgtctcataccactctcctatttactgatagtaaatttggctacatcttttttctaaaatgctaggaaaacagataaacattaaagagattcctacattgcattggaggttgggccaagtgatttctgacttctcagaaatctattatttagcattattaagtacttcacttacattttaagttttttaatcaatttttagtttaaaaaagtagcatggtaggtcaaaatgtatgaaaatgtatacagagagaactctctctaaccctacttcctctactttattcatcccctaatataaataattattatttttgtcctagtattttactttattttatatatatgtatatatatacacaaatacagtcatgtgctccataacaacattttgg

SEQ ID NO: 133746 - DNA, 1071 bp, Homo sapiens
tagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagcatgtgattggctctcttgcaggttgtaaggatgcgaggcagcgggaggcagtgctggatgacggagacgccaaacggtgatgatttgagctgagccctttctgtgggtttgggaggtttgccctgagccaggagccccatgctaatggggatatcccttggcagataaatgatggaactagctccgtggcttctctctgttaaggtctccaatgcaggttagttaattgcagatggtgtgaagatggtctttggttttaatctcatcccctcctgaggtcccagagcccctga

SEQ ID NO: 133747 - DNA, 1037 bp, Homo sapiens
atgtgtgtgagagaagcttcgttcaggcatgagttatgaggctgttggccatgggttcaatgtgaaggaatcaacagtacacattgaatatggtgtctttaaacagaaacacacataaaccaaggttatgtattggttggttggtgaaagtattatgacgagaggctcacaggaatttgactctgtatttcccataggagcagtggttcagtattcactaattcagtgttccctgtagctttctagaagataattaccgcagataacaacctattttagtaggtgacaaaaatcgaaaccttcccttggaagagttcatagcagagcccccaggtagcccttccttccagccctcactgacgcttgctcttttgtgaccgctctccttggcaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtgagttggacagtgaaattgtgtgggttagcagatatgaaggttcccagccaccgagcaagaggtccagttgctatttgaaactgaacacacaccagtcagcacgaggggagagcaatgaaaccgttccctagggccttccccatgtgccccagggcccagcttgacctgttacccatttactagtaataagagaaaatagggcgaggcacggtggctcacgcctgtaattccagcactttgggaggccgaggtgggcggatcacctgaggtcaggagtttgagatcagcctagccaacatggtagtagttggccagtttagtagaaactccatctctactaaaaatacaaaatt

SEQ ID NO: 133748 - DNA, 1051 bp, Homo sapiens
gcaggatgtgttggtgaggaaagaagttggtagatctcaaaatactctgacagtaaaaataacaataattggaggcttaaaatcagagtgtatctaagcagtaggaagcagttcaatgtgtgtggtgtgtgtgtgtgtgtgtgtgtgtgtgtaagtgattatagctcatagcatttaaagtcttttgtaattgggggactttgctaaattaggtaagcctataaaaagtagttaagctagccacttatgtataactttcaaataagcagaggggaaaaatggagcatttaaaaatccaatagaagataggaaagaaaaaataaaaggcaatggaaatattaaaaataaaactcatcagttaaaaatgtagactcaaaatgtaaaattatatgccacttataagagttatatctaatacagaatcataaaaatgataaagatattaaaaagataaaagtagggctatgttaaccaaaggttccctgaggatggctataataatatcagataaaatgattttctaggcagaattgttgcttagtgatgtatggaccaaatgatgtaataaaactgaagttgggaatgcatccagccccatcatttcccatatatcaactcaacttgacagaattactaaaagctatttgacaaatgcaaagtctttgaatctagtagataaacatattaaaaatatgaaaaacaaaatcaacaagcttgatcaaatgggcacttaaaactctgccatgaatgtagaataagcacattcttactacgcatatgtggaccatcttcaggaagccgactctgcggagcatatctcagtggcttcaaagaattgtgatcacacagaccatgttctgtgacaacagtgcaattaaagcacactttaaataactcatagctaaaagaaaaatgtcataagatatattacacaatatttgggtctgactaatgatgtgaagattaattaattggatggctaaagaagagtggaaggaaaattttacacttaatgcatacatagaaaaggaaaaagatataaaatgaatta

SEQ ID NO: 133749 - DNA, 1032 bp, Homo sapiens
cagaaccaaagctttgttgacaagcttacctgtgaagctaggagacctgcgagctgcagtcctggagaagagggatgagcacattgccacagggtcagcccctggaggtcagatgagagatttcctccaccctggctccagatgggaaacacagaaggctctcccatgagaaatcagttgggactggcatctctggaagccagatttacattaccagcatgctataggaaattccaagccaaaaagttaagataaaacttggcactgcctgtcaagggaacccagtcctcaagggattccctcagaaaaaccagccttacaataaaaaaattacacagcacacttgtcgaggcccaggatgagtggcaagctagtaaacaatgaagccagaaggattaaagatgaaaggaggaaacagaaaccacatagaagaaaaagcagtggtggatttgaaaaggaaccaaacagaccttctagaaaagaaagatatagtccatgaaatgagaaacttgatgggtatgttacagggtagatgcacacagctaaagacaaaaagggtaaggagtattaaaaatagggagagagcacagtggaattatcatatgaggaaaaccagcatatacctagaaggatatttaatattttatgaaatactgatagaggttttatagaattgacagaaagcacaaatcttcagatttgaggaagagcactgagacctgaggaggctaaaataaaaataaatttactattaatgatagacaatttggaatggcaaagacaaaggaaaaatattgaaaatagcctaagaaggggaaagttcagaatacttgcaaagggaacaagaactgcaggacttccaacagtcaccatagaagccagaggacagtattgcctcaaattctatacccaacgaaactatcattcacgtgtgaaagtcatggatgttttcagaccaagactaagagtgtttgcagccttagtcctttacccaaagaatgaatgttattcaggatgagctcaattgaacct

SEQ ID NO: 133750 - DNA, 1043 bp, Homo sapiens
ttcggtctgagctccaggcattgctggcaacccttggtgcccatggtgctctgtggctgtggcggcatcactccatctctgctctttcttccctctaggtccgtgtctgaaattccctcttcctgtaaggacagtgttgttggattagggccctctctaatcaagtaggactcctcttaacttcgttacatctgcagtgaccctgtttccaaataaagttacactcacgggttgcggggatgaggacttcagcatgagtggctgggggacacgggtcaccccaccatactctcagtttcttcaaaggtacaaacactcttaggtggttttcttcatctcgcaagtccccatgcttctagttttccccgttttatctgactcccatccttcctgacactgcccctggttttctgcagctggctgcatgcaccactcaacagctcagtgggaaagcccgagtggagtggccactgttccacacccgcaacggatttattaacctggaagtatcttcccttgggaggagcagctttatgtccttcctgcagctctcaggatttccattccatgtgcccttccaggaaatttgttttatttcccgctaatcaaagcgccatgacctcatgatctctaatatgtaaagttttcttgatcttcctggactgatcagtgtgacctggtaaaagcagatcctcaatgcctaagtaatttgaccaagttggtgaatacttggatgattggctggatttaaaaatcgtaagtcggctggacatggtggctcacacctgtaatcccagcactttgggaggctgaggcgggtggatcacgaggtcaggagatcaagaccatcatggccaacatagtgaaaccccgtctctattaaaaacacaaaaattagctgggcgtggtggtgcatgcctataatcccagctactcgggaggctgaggcaggagaattgtttgaaccagggagttgaaggttgtggtgagccgagatcacgccactgcactccagtctggcgacagagcgagcctccgcctca

SEQ ID NO: 133751 - DNA, 1045 bp, Homo sapiens
cagtgggtctggggatggggaggggaatgagttgcttaagaaattctccaactctgaatttattacccagttaccaggacctccatctggagggcagtctgcggcatctggctacagaagtgtttgattttgccagccagtgctttggtttctttctctccctctccttcccgctctctgtccctctctgaatgaagcccaggctccactgacttatttccatacctgtgttgcaaagcccccgcatttgctattcttgtgataagcttcaaaatcacttttactgttacatcatatctttatatcactataaaatccctctagaggttaccataatgtcttatccctctgtgttttctacaaatactgggtagttttgctagaatgctgttgtctttgcataagaagcaaattaaaggctcctgaaaggaaaacttgtttaatacctatcctggtttctttttcccaggtgaagtggaggttctggatccgaacgaccctttaggaccccttgatgggcaggacggcccgattccaactctgaaaggtgagctgggacatgcaggtgctctccatgtcctccaaatgccctgtgctgaggctcatcttgcactgccattgcctgaaggaaggcgctgggggtcctctggccccttggtgccccctggtggtgggtatggtggaatgccaccttgattcctgtgtttcttgacttggagggcattgagggcctgttggggccacaggtgggaggtgacacgcagggaggcatgggtggacagatggcggcctggcagatggggaaagggcctgagcggagccttaggagctggattcctgttgcatgtgactccagaggtgtgtgtacgtctcagtgggcagatggacggccctcctcctcccagccacctggaattctgtcttgtggcttcagttcttcccctgggcctgtggtcagagccatgctcacttggcacaccttgcaggaatgcaccatagatttgtagggtcaatagaacaagtttcccccggatgcagacctgtg

SEQ ID NO: 133752 - DNA, 1040 bp, Homo sapiens
tctttgctattgacatacttctcctgacccaggtcccagactaataatggccttaccctttcgggactttatacgctgctccttcccaatttttaacttttcttccttaactgttgcctttctagcatcatgggtgttttcgatctgacgtgttgccgagctgagtagttgttgtggaacacatgagtgacatttgcacgtgcaagtgggacagtgggtgcacagagcttgctcgcagcgtagctcattgtgaaatctgtccttgccattcattcagggggtgtctggtttgcagcaccgtcactttctcaggctgtgctttttccctgccgtgacttctgttcttaaacacatcctgcaaattataccttcacatgaggacaaccaaatccaagaatgccaagctctggtgaataaaatacccttactaattaaaaagaggctgctttgaagttgtctgaacatcctgaagactgcatctaattgcatcacagtaagcataccgattcagatcaacaggtgaagagatgaatggatgaacagtctgaataacaaagcatgtttaaaagaaacgcaaatcaaaaccagaatagcaccatggactcaaatccaagggcataggtgaaacttcattaataaatgcttgcttaatggtgtgactgctgttaatgagagaatgattgtgatactagaggtagagccttggaatcagaacagacgtgcttgctactttgcagatataaatttatcttttttttgagatggagtcttgctctgtcacccaggctggagtgcaatggcaccatcttgtctcactgcaacctccacctcccagattcaagtgattctcctgcctcagcctcccaagtagctgggattacaggcacctgccaccacgcctggctaatttttgtatttttagtacagatgggatttcaccacgttggccaggctggtctcaaactcctgacctcaggtgatccacccgaggcctcgacctcccaaagtgctgggattacaggcatgagccaccacgccag

SEQ ID NO: 133753 - DNA, 1042 bp, Homo sapiens
gcccacagagcccagggtgtcagccccacccacagagcccagggtgtcagccctatccacagatcccagggtgtcagccccgcccacagagccagggtgtcagccccatccacagatcccagggtgtcagccccgcccacagagccagggtgtcagccccacccacagagcccagggtgtcagccccacccacagatcccagggtgtcattccccacccacagagcccagggtgtcagccctgcccacagaatgcagggtgtcagccccgcccacagagcccagggtgtcagccccacctactagtcccagtgtatcagccccatctactagcccagactgtcaggcccacctactgaatccaggatgtcaacccctcccactgagcccagggcgtcagcgtcccacccaggtacccaggcatagcttagtcacactggaacctcaaatagacattatcacaactactccagaagacagatctgggaagacacaaaaattgtagagtgaagatgtgccatgagaatttggaaagaaaaggtaaaacatgtgaaaatgtttttttttttttttttttccttgggacaaggtctcactctgttgcccaggctgcagtgcagtattgccatctcggctcactgcagccttgacctcccagactcaagcagtcctcccacttcagcctccagagtagctgagattactggcgtgcgtcaccatgcccagctaatttttgtagagatgaggttttgccatgttgcccaagctggtctcaaactcctgagctcaagcattccacctgcctcagcctctcaaagtgctgggattacaggcatgattcactgtgcctggccaaaagtgttctttagaagcatacagatcttccctggggaacgtgttcagtctcaagtgagccctgcaccgatgcccaggccctctgacccttgaggttttgctctggttttcttcaggcgccaactcctccagcctggggatctttgcctgggagtgccaccagcacttgttcttttcatggtctcatc

SEQ ID NO: 133754 - DNA, 1106 bp, Homo sapiens
tagtaagcttttcatggacacgagagccttcacatgaagaatgaagactcaaagcaacatttggagctgaacgcttctatcccagattgaacaaagagcagtaaactatggaaacatggcaagacagaggggtttgggctagggtggttaattatggagaagtgtccaattaaactcctccatgctttgaattctttacatatgaaaatgatggtgggagcaaaaatgtaagtgggggtgggagggggtgagattctgttccctctgtaggtttcatgcatgcccataggtagcagagttcccaggggcccttcctggctgcattggtctcatatcctcatttctgcaaaactttcccctccaagaggagagtgttccaggccttttctcctcatccactttttacatggtgtcagacttggcatctgttttggtaaatattttaaatagggctgaagcccatgaagggctccttgctgtctgcaagccagtgtgtgtttgcacaaataacgagtctctttggaagcgtggctgtgaactttactgtggcctcgtaactacacgtgaagcccgctgggaatggcttgggaggacaacagcagtgcgtgggcgtgatgcccacgtgctgtgctctggtccctcgccccttcctgttttccatcttgatcaggaagctgatctgcctcgatggcctcagttttgtgttaacatttttaatacagtaagctcagtaactcaaattagagaccacagagaaagaggggccacaaagaaattgctcctttccttgaggccacgtgtgtcctcaaggagttgacgtttctggacatctcaggtctctctccagtcagcaactgtcatgttcccatcgttggctaagagaggtgctggccaacagtgctttgcagtacaccacagatgacagaaatatctgcactggtattattctctctctctctttttttttttttgagacggagtcttgctcttgtcacccaggctagagggcagtggtgcgatttcggctcattgcaacctccgcctcccgggttcaagcgattctcctgcctcagcctcctgagtagctgggattataggcgtgtgcc

SEQ ID NO: 133755 - DNA, 1041 bp, Homo sapiens
gggcaaaccacagaggcatatgattgaggtgaattctacggtaaggagacagatgtacatgtgaaaaagaaccacaaacattggctccaggtagagagcctaatgctatggctttcagagcataataaattgagctctgtaagtcaacacagtctttggctgggtctctctttggtgaaggggtagaatgaagcctccctctttttattttttggccaaagtgggaattatctgaagacctgtaaaattaactatttttctttacaaggagaaagggacaaggcagaaagtcccacgggtgtgagggattactgggtttctctccaccaatagcacagttcacacacacccagctccaatccaaggcctatttcagtgggccccagtgtgtgcgacaggccacacacacgtgtgtgtggggggggtggggcggggaggacaggccacacacacgtgtgtgcctgaccctcagaggtgctgatcccgccttatgttggaaataacattcagtgttggttttcacagtcaccatcaatccgtggattagcttctgaggcctcccctgacatcccccctccccacatgcccggcccccgcgcaggagcctgaggatgtatttgttttaagattacctacttgggaaaaatagaaggatcgggtaatctcaacgacctgtttgctaaatccgcccgttttcttctgcatctctacttccaagagatgtgatgtagggatttcacacaaacacacacaaggagccgaagggattgtgtagatttcagcagagacgaggagtcaagtgaatggaacaccgagaccaagtttgtccagcctgtgggccacttgtggccaaggatagctttgaatgtggcccaacacaaattcttacactttcttaaaacagtataagattttttttttttttttgcatttttttaagctcatcagctgtcattagtgttagtgtattttatgtgtggcccaagacaattcttcttccagtgtggcccaaggaagccaaaagattggatatccctgact

SEQ ID NO: 133756 - DNA, 1078 bp, Homo sapiens
gaagttactaatttgcagttctgtgacacagatttgcgtaattagaggatttgatcgccaggcatgtgaaacctatacaaatgttggtccatgttcttggaaagaagtcaaactttgaggctgtttgagcgagtcatgattctttaaagttgccacaagctgaattgatttagtttggcagaaactacaaaaacaaacacggagtttagaaaaagcaaaggctcatgtgatcaccgctctggccccagagaaaaggaaatgcttcgtaagttgcattgcggaccagagcgtgttgaggctccctttcccccacctgataattttcagatcgtctggaacagctataaacaaaagctggagacgctaaaacagcccatagccccttcccctccctctcctccctctttcccctcctcctccctccccttaacaactagctgggcctttgttttctttttgcttttactccctaagtaaatcttaatcactgtcgttaaacccagccttgactttctttccgttcccatggataccagatggggcctcatattggcgaggtggccataggactgcaggacccaggaggccccgacgggtgcctggcaggcgaagggggtgctgctcctggcgctggtggccgggtaggatgatcctgagcatcagtgcctggcccagtacagcttgagagacccccttcactccccggaggagacgtgcacaggtggccaagctggaggagcctgcaagttgcaggggtcagatgtagcaggtggcagccatcaggatctgtccaagccgaaccccttccctggtgccttgaggtagagaccatctctgtcttgcaggtcactgtctctatcttgcacggccacctgcagtggtcctatagctgcattggtctgggatttaccaggagccctggaccccacgaaggtctcctgccttccttggtggaggcacgccagggtcctggcatgaactcagggtggggacagtccagttctgcccctccctgctgggtcccggccttccttctcgactctatttcagtaaagtcaggttggctgagagaaatgcc

SEQ ID NO: 133757 - DNA, 1051 bp, Homo sapiens
aggaaaaactcaagttgactgatttgaaaatacaggatgaggaaaacttttaaagataatttttgttgaattagatatgagtcataatgaaaattgattagggttttgtattcagatgcataggtgcatttagacactttaagaaaaccaaaccaggaaacagatgaaatatgtgatttgtgaagaaattaatgtgaacggcaatgagtagattttttactcaaagaaagggctgggctgcacatctgttgattgattaatgatggttcatttatttgtattacgttaaaaatatttattgtgggtgtggatcattatttatagtacctaactatcatttttaatgtttccattaatgaacattcatatgaatgaagattcgtatggatcttggttatatccgtaggaaggcgtcagctggtccagttccagaatatgactgtgccttcatttcattgctccctgctctagttatttacaactttctttcccttggtttcaggtaacctggaaatattcacagattacacctgagctcacagccttctttgagatgtgtgcttttttttttttttttttttttttgagacggagtctcgctgtgtcacccaggctggagtgcaatggcgtgattttggctcactgcaacctccgccttctgggttcaagtgattctcctgcttcagcctcccgagcagctgggattacagttgcatgccaccatgcccagctaatttttgtgtgtgtgtgttttagtagagacggggtttcaccgtgttgcccaggctggtctcgaactcctgagctcaggcaattcatctgcctcagtctcccaaagtgcaaggattataggcgtgagccaccgtgcccagccaacatgtctgcattttattacaaatgtgcccatacacttctgagaagggtagagcatgttaatctgtatgtctcactctggctgcactccgcggaagcgactgcctgtgaagtttaattggcttggaggtgggacagtgccatgatgtctagttaacatatatttaagttatacctt

SEQ ID NO: 133758 - DNA, 1084 bp, Homo sapiens
caggggctgtgtctgcaggggtctctttaggcatcttcagctccatcaccatgtgttgtaagacatgcctggcctcaggctcctcatccctggcccacccacccacagtgacgtttgtgcccagagacataaggcagggtgcattcctgtgctggactggaaaagcaatcatttcctggcagagtgcttggtcaagttgtaaagtggtctcacttgaacagagcccatgctatcgggttttattggagctgtgtttatcttgagctctgcaggagtcaaaagctcactggaacttttaggtaaaacctgtgtgtgtgcagatgggccacaccttccttggtttcaggacaacagttttgctcggctttaaaatcgcaagagctctcatttgggatccatacctttggagaaggtcctgacaatttgactccacttaggtttttcatgttggaatcttaagtgttttgatagatgggtccctttctcagtgctgtgtgtctgcatgaatctcgctgacctttgcttctcatggctgtcacagagcagccctgctgacgacgggactggtggggtattttgtcccagctattccatgcataaggtgtagagaatatgtcttctgccatggctagagttaaataaaggaaaattcatgccaggctgagttcaggattgatgtttgctctgtgtctgcattaaaaaataaaccacaaacatggttgtcctccagcagggctggtgttgagttagcagctgccaaatgacttgtggatggtgggtttgcacgcggggacgtggtcctgggcatctgtggcacagggaagggaggagatgaaacacagctggggctctgggcaagtccacccagcgatgctcaggaaagccaggacctgagtgggctcccgtagcccacagtttctggtcttgtttcctgagccaggctgtgcctttttctctgggtaacaagatagatttactgacctttgccatggagatcatgtactttggaacccgagacctgtttttactttccatttgtcagctggaacaaaagccggaatgagctttacagtctgcaggccca

SEQ ID NO: 133759 - DNA, 1088 bp, Homo sapiens
tgttgagttttccgtggactcatgtatttattaatgtgttaatcacttccatcactctgggagtgaacacccacaaagttccaggtcatccgtgcagatccctctgtattctgtgctttgttttgctttgtaaaatgaggataaaaggagcatacgtgagctcaagggcggtcaactgatgggccaatggccggggaatgagactggacccacgtgatgcctgtttcagtctatgatttggctgtgggtgcacaagctctgctgtattacatataaggagctgtttcagcttgtctttggtagttggacacagtcttgcaaatcatgccattaatgcatacagcccatgaccacacatctataatggtctcacatgtataggatacaacaaatgcatgcaatgaaatggctagagaatgaaacagagctggagcatggggtgtggatctcaggtccttgcgtaggaacaaggggctgccgctatctcatttggacacgcagaggggatttggatgctccaggcctgcctgggagacagttgagagagtcacccaggctggcatttggttctggccatcaccgcctcacctgtcttggttgttggtgtgtttgtctctcctcattccctgtgcgctgggcagatactgactgagaaagtatgggcggtgctgttgtagggccagggagcatggccagctcaggaggaaggcccccagctggggatccagcctcgctgcatgtggccccaggcctgaaagaggggagctggcatcaaaactggaaagaaaacgtcagacatctctcctgtctcagtgatgtgggtttattttaatgaacagaggcctccttgaagcaattgggtatggtgggcccgtctggagggtgcctttggaagtgtttgttcttgtctggggtctgtcactggaaggctctgggttttcagtgcactgcagaactacaggtttcctcattcataagaagagaaggttagaaagagaaagagaaacgggtaacgttatcccgggccgttgtggcattttaatgtcacacgtgtgttcctgtgcagctgctggtccttgctctcccgg

SEQ ID NO: 133760 - DNA, 1336 bp, Homo sapiens
taatctggagactgttttcttaagcagagtcccagagtaggagaggcgtcactgtaaccgagtgaagagcgctggctggaagtgtgtaacctgccagctgatgggcttaagagcagcaagtgccttcatgtggtttctttctttgttgtcctgtgaaagaactcgtggagatctcttaagctctttattgctgtgtagaattactgtatttgaaaagtatactgcaaaaaaaaaacttttagccttagctttcacattgaggattttgtagattacagagaactctattgaagactttgctgttgaggtgagcattttgcaaagtataaaacttcctggctaaggggagtactgtgtccatttaaacttgccacttgaagaagcccgtccgctaaagtgatgtgacagcactttatcttctgatcatccccctttcccttcagagagaaggaagatgtaaaggggtgtgcaacatctgcttaaataaaacatatgctacagttggaccgaccaagatgtaatttatcttgttactttttttctgtgctcaagttatggtgaaagttacctatctttaataagttattgtctaaaatgagcacatcctgaaaatatcctggccccctggtcccttctgacatgccagcatggacgtgggaagcagttgattcttgagactcacatatggaaggagagagtgggtgtgagtgatcgctctggcagggttgctgattgtcttgatttgtgttgcagtcctggccagaagccttccacatgctttgatctatggcagcgtctctgcaaaatttggcaagaaaatcctaatgtgtttaagtcataattaagattgtgtagcagggctggattgttcattccttctccatgtgtgttgacagtgctccttatcccctcccctgtctctgtccatggctcgtgttcctggcctcctgagggacaggtggacttggggcccagcgtgggcttgtggacttgtggcaggacttaggattctcttcattgcaagaaccaagccttgttctggccagaatcactgataggtggatggaaacaggtggatctctttccctgggtgcagtgtccagtaattcacataatctaacaggaatcctggggcctttcctgtcgaatttgaattcggggaacacagaggtgtgcagtggaaaaggaaattagtctgcacatgaggttaaggatgggacccttgcatatttaagggggtccaggagtttatctcccaaactaagcccgcctgcatcttttcctgaacccaccttattttccactttgtttctgcgtctgcttccttgtgtgtctt

SEQ ID NO: 133761 - DNA, 1016 bp, Homo sapiens
tttgggcttatctttttggggattcaccaaatttattttgtgggtttacatttttttgccacatttataaagttcttagtcacttcgtcactctttttttcttcttcttctgggaatctggggatataaatgttggaccatttcattttgtcccacagaagtgatctgtttatttcttttcaatttttttctcttttgttcaccttgtataatttttattgacacttctctgtccttattcccattgatccctttcattgaggtttttcttctagttattatatgttttccttctaaaattttcagttttctcttttttatattttctgggggttttttgttgagacattttatctttctgtttgtttccaaagtgctttacttgttggcaatttttataatagttgtattgaagtctttgtcagataattccaacatctgtgacatcttattgctaatgtccattgattgagattttcctggttctttgtatgttgagtaatgttggattgcatcatggagattttgaatattagattttggtggtgagactctgggtgttgttcagccgttgtggggaatgttgatactgttttacgggcagtcagtctgtttgggttcaggctgcaagttccgaacagccttccgtgtttgcagtcccaatgccggttctactttcaaagcctctatagtgctcttggatctgtcccacatgtgtgccacactgtggccagactgggacgggggtggtgttctgctgtgcagttctgttctcaacatctgcttagggtcagatacacacacacacacacacacacacacacacacacacacacacacagctcatgggtggtctcaggaacttgtaaacaactttaaagggtcacttttctgagttttcccttctccatcatctccctggtattttcaagttccttaaaacacccatttcagtcctctagcccaacatcttgggttttagttcccttgtttggctgcatactcaccttgactat

SEQ ID NO: 133762 - DNA, 1214 bp, Homo sapiens
ttcctcatttctactgaagagctgctaagggagttcttactctgcatatttctgtatttccagcccagcctctgtaatataataaaacgcacgccctgtgtttcagcagtcgacagtgctgcttcataagcaatgtgtagtataaggaacacttaataaaatggcctataaacacaccagccccaaggtaggacttgggaaatactagggtgaaagaagaggtaacttactagtagcctcataaaaatctgtacaggaaaaaaatagaacaaattctggctgtgtggtgtaaacactgcctgattcctcgtcaaggtttggcagtaaagtgaggaatagtcattggatgtattggaaatcttggggttcatggacatttgtcaggcttcccttgggtggtggtgcatcattcacagttaaaacgacgagatgcaccccaggacgaacggtgccagcctgagagtgtaactccgagtgtgtttacatgagtggccacaatctgaaaactttccttttgacataaactcaggttatatcataccaagagtgaggagtctcttttatgctgttttccaggaaaagggagaaaaaacaaatgagggtgaataagtaatgtaaatttttttattataattatttgtggagaaaatgaaattcctccacagatctgtttttgttatctgttgctgtgtaacaaaacactactgcacaatttagaggcttaaatggataatgtgttgttacagcacacagttctgtgggttgacagggtctttcctggggtctcttgcgtggctgtcgtcagatgctggctgcggtaagatgctggtgggggctgcagtcatctgaaggctcaactgggccagacatgaagatggcgcactgacatggctggttggtggtgctgttgggtgctgggggggtctctcgacccaagaacccatacgtggcctctccaggtggcttggccttctcacagcatggtggctgggttccaaaaaggactctctcaagagggagtgtgttaagggcagaaagtggaatttggccacttacaggcttcattcagaaccagcactcaaggccactttctttgcattctgggggtcaaagcaatcacagggcccactctgattcaggagagtggggaaacagactccagctcttgttgggggagtgtcggggacaccatatggagagcatgtgagatggaa

SEQ ID NO: 133763 - DNA, 1067 bp, Homo sapiens
aagttgttcagagtcagttagaaagcaaagaaaaaatgggagagccataaacatgaaaaaaatggaagagccataaacatgaaaaaaaaaaggaagaacctcaccaacctgcttcgtggacagcctgtcacactagagtgggctttggcagcagagaggagtgaataaagaaaggacattgcttcccgtgcaggacacagccagccagaggtctctgagcattgccagcccctttccagtcttgccagtgatttcctcctgctcgttttgtccagttgccccttgtttcttattaatgcacatggacacatgttttattctgccatttctgagcaagtggtgtggcctcgatcaccctctgagagcagagtggaagaggacgcatgggcagggaggcagaagtgttgattacagcttcaatcgcatcccagcctggcttcacttgttcctgggtaggacagagacattaagccaggaaggagttttaggagtgtcttgcagtagtggctagagatctaggatgaaatggtgtcttcattgagtcttgcaggagggtatcagcgtccagtggaagaggaggttgtgattcttacccaggtgtgttcctgcatctgcgtcctctaatctggcactatttgcttcccattgagcagtggtgtttgtagtccattgtttgtacctttaagtctttaaatccatgttcagctatgctctaaataaatggatctcaaaaatataaacaggcagttcactaggaggagaccttccaaacactcatgaacctgggaaacacagttaaaatcacaaggaagtaacatcaaattcacaaaagtctagaaaaagcattgatgccatcaaatttacaaaaatatagaagtctgacaatacgaagtgttggcaaaaatgtgttatggaggctgggcatggtggctcacgcttgtaatcccagcactttgggaggccgaggcgggcagatcacgaggtcaggagtttgagaccagcctgaccaacatggcaaaaccccgtctctactaaaaatacaaaaattagctgggagtggtggctcg

SEQ ID NO: 133764 - DNA, 1228 bp, Homo sapiens
ccagtgttggaaaagaacaggcctttatgttggtggtaaaatgattagaaagtaataagaaaaatgcaggtttggacagaacattgttttgtttaatcagttctaagcccaaatgaaaaaaaaagtgcccttagaagtaagtttaaaagggattacaacatacatgtgaacatttctcccatctagtttatgagtttaaactttaaggggaagggggcagataagtctcttatttcttggtgtccagtgaggcaatttctctaatgggaaccagaagcagagagagtaagaaacatgctgatgtgagcaggcacttttgaggtataagaaactgtcaagtgattattcacacttctgttggctgcgcaaaatccggatatggtgagatctttccagaagccgaaggaaaaacctggaatctgatcaccttgtgaggagaaatagggatctgaggagaattaattctgttgtttttaaagtggtgtttctgaagataaactggatgaggacagcattgtggggaagcgggggaaccaagattgcatctttgatgttcagccaagacagagtcagggctacaaatatacccagtggagcggcactggcaaggaaggacacgcagtctaaggagagatggtctagggtgatgctgctttttcatcttcacaatattgtatgcactgcgtgaatttctcttctagaggaaggaagacagattttggaaaacttttccagtaatgtgttctatggatttcatccttttttgcaacattaaccttgggcatttgtcaaagatggaggctgtttgaatatttttgaaagattgtgacatgggctcaagttttcttgatacacaagcagtctcagctgccacaggtgtctggtgggaggtactggcacgcgggtgacatggagggaccttggcttccctgtatcaccaaatgcctgaattaccaattaagagtagagtcatttttttaaatagatttatgtatttcttttttcttttttgagacagagtctcgctcagccgcccaggctggagtgcagtggcgcgatctcggctcactgcaaccgccgtctttcatgttcaagcgaattctcccgtgtcagcctcccgagtagctgggattacaggcatctgccatcatgcccgcctaaattttgtattttagtagagatggggtttcaccatgttggccaggctggtcttgaactcctgacctca

SEQ ID NO: 133765 - DNA, 1602 bp, Homo sapiens
ctggctgtacgtttgtcttgcccttgaatgggaacactttgtcatgtataaatcacacctccataaagttgtcatgaataaaggggtggggttctgtaggacgtcttggggttgtaatcctggctctccagtgtgttttttgggcagatcatttagtatcttgggtctcaaatgtccatctctgaaacggggacaccacttctctccccacagggttttgtgaggtttggggcatgggatatgcacccagcactaagcacagtgccagccacatggtgttatccagatgacagctgtcgtcactctgggctcttagttggccacaggtcacctttcctccgagggaagtttgggatggaagtggttagaaaggctctggacacaagactcatttgcagagaaggaaccagataacggatgcttcactaaattggcaaagccacttgagactttctttccagaaccggtgaccatgaggggatcagtgattgtagacaggcttgtgggagtcagagaggcccaggggtgtggcccgaggggttctcggggtgtgtggaccccgccgtggcaaggtcaggatggagcctgtgggtggcccgtctggtgctccttctcccttcctcttcagtctcaccttctgtggctccaggcagggggactgcactctctgtccacatgtccaccttcctcaccacacatcctcaggtggatgcaatgatacacacagggactccctcagaagcagacccgtcctcagggagggaagtcttggtgaccgggcctgggctgcctttggaactttggtgtggacatcccacttatttctcttgagtgtttttatttagaaagaagggtgaggcttggagtgaggcagcctccccaggcccctttgtgagatgcccctgggcctggaagcctgtcctcagcccacctgtcttctgctccacaagctcaccccacatcttaggctcgccttcacacctttggccaggtggttccccccacctggaatacccccccacccacttccaaatcctgttctttggtcagagcatcacccagtatcactttgttcttatgacaaaattttcctaaagccatggaaggttgtactaactattgacattatcaccaaccccatgagactattattataacgtttactaaccacataacttttggcaatgccttagaggagaacatgccagaagacctggatcaccttctttcctctgtacaagtgggataggcatgtcttccctgcttcccctttgggattattttggcctaaaacaagagaccatgtttgatttcactttgaaaattaaattgtataagtttaattgctaattttaataagtagcttgactatcaagtttaatgggactcgaaaactcccagcctttcccttaatttgggagcagttattctgatcacagtgctgtgtggggaagggtggggctccacaacccacccgtgcttcctatgcacttacggggtctacgtgtgcatccagctgccagtgctgcattgcaccgaacacggaagaggagctttcacgaggagcatgggccttccccttccttccctttgctcccactc

SEQ ID NO: 133766 - DNA, 1026 bp, Homo sapiens
gcctcatttccatttattttgggggcttgtgttgtagaagtgagttgatgcccgatgggaagaactggagcagatcacccttcccagactttcttgggcaggggaagccagcgggttggggtgtgggcatctgagacccctccatgcagcatctatctgggttcctcctgggccgactgcagtcaggggcacagaaaaaaaatcctgttgctctctggatgtggcagttttaattttccatgcactcatactttaggggagaacatgtattttttttatttgcttttgtttaagtatatgtatttttttctttatcatagtaaaatatgcatatcatggaatttaccatcataagtattgtttggtggcattaaatgcattcatattgttttgcaaccatcaccgccatccacagaactcatttcatcatccccgacagaaactctgcacccattaaataatgcctcccccatctcctcccccagaccctggcagccaccgattctaccttctgtttctatgcatttgaccaccctagggaccttgtagaagtggaacatgcagtctatgtccttctgtgactggcccggttcccttagcatgccttcgaggcttatccatgttgcagcatgtgtcagatttccattcctaaggatatggtttttaaatagtcatttgttttgccagtgcagataaaatgtttacatattaactccatgctgatgaagcggtttcttcttacagtgagcttaacagtgtccctttcttgttgcttcagttgagactgagctctccaactgatgctggatgtctcagggagggccccatggtgtctgttgggggtgggggcagggtcgcccaaggagggcccttggtgttaacggagatccttggcagttcaggaggtctcaggcggctcacagccacgaccacccagctccccatcgggaactgcttttgagatctgttttcagtaggggcctgaggcgtgggaaggccctggctgtgagaggtacaagcagggtg

SEQ ID NO: 133767 - DNA, 1534 bp, Homo sapiens
ctctgttggctcgatactgacaacagctggatcttccaggatgtactaatttggggtgatggaagggaaactccctcatggtcagtggagtttttaactgttcaaagtgtcagttttatgggttttcataatgaaaatataaggtgtttacattttaaggaatttgagtcacttttcttaattggcaccctccgcttgaaatcttagtgctgtttcctttggctctactgaatgtttaaaatctcagtggagctcattttgggtaatcttttaaatatgttattaattttatttgttattagtatcaattttgaattaccagtagagggatgctgaatttattttaaacttatttctttgagactgatattgtttatttcccactggtaatggcgtattccttgattttatgtaaacatcccctcctatagtgtaagtacctggtccctatctacctcctggggttgttgttttggggattaaatgagttaatggttataaggtccttagagccagcacttgacttgcagaaagtgctagatgggtgtttgttaagataactgatactaagcctgcttgttaaaaagtcattaaaacgttatgtttttactattacattttaaaaggccttctgagttgcatggtcaggagatgttctgattgatgttttctgtcagttgctactaaaacatctcaagctggatgtgctgcgggtgccccaggcacagctttaaatacaaacgtgtcccattgtctcccttggagcccttcctggcatagatagcgtccccaccactcaccatgtgaccaagatggaaaccagggagttgctttcaactcctccctccccccattgataatacagctgtgtcacctgtgcctccagactcagtttggattccactctctatcttatccaactttttgtcatagggttttgcggcatttgcagttcccaaaggaagttctttcccacaacaattagtgtcatcacaagtcctggatgtttccctgaagaccagatagtcacctttccctttattctggccccttgccctgtgcccacctggaggcagtcatgtagggtggccctgggtgtggggtggccaagctgacctggggtggggcagcatccgatccacgctgcagctgggtaacctgaagaccttgtgaggcaggaagctcatgactcaatttactgcattcttgggtccactgggaagagaaatgctcctgttaagtatgaggtatcctgataatatgccttctgtttaaggaatggattttggaggatagatctcaggaatttgggaagccagccccctttgtagacattgcagtgagtgggaagcgccaggtttcccagcagaggaggcccttcctgtagctgctcagggtgtggctttctcagaaagatgacttaattgactcaattttgatcccccttttaaaaatatcaccttttttcactgtgcagaatcccacttcagtgataacgaaagaaacttagggtttaacgtgctgatatcctaaa

SEQ ID NO: 133768 - DNA, 1035 bp, Homo sapiens
aacgcctgtaatcccagcactttgggaggctgaggagggcagatcatatgaggtcaggagttagagaccagcttggccaacaaggtgaaaccccgtctctactaaaaatacaaaaattagctgggcatggtggtacacgcctctaatctcagctacttaggaggctgaggcaggagaatctcttgaacctggaaggtggaggttgcagtgagctgaaatcaggccactgtactctagcctgggcaacagagtgagacactgtctccaaaaaaaaaaaagtattacatattttatgtatttaatgaaaaccaattttctttgaatatgatgcttctctttatgtagtttggatattaacctgttattagatgtatgatttgcaaatattttctttcattgccttggttgtgttttcactctgttggttgtttgctttgatggatagatgtttttaagtttgatgtagtccagtttgtctgtttttgtttctgttgcctatgtttttgatgtcatatctcaaagtcattatttaagcatagattcccatatgtaaaattagtaagtctcaaagatatttgggggtggagatactagtaatagtagtaataagcccagatattttggagttgtttgataagtctggccagattgccttcagcacacagtcatcaattcaatctccagtctgaaatgtctggaattgcctatttcacatcaccagtgccagcactgggcactgacatttaagtttcttttctgctaaattgacaggttaaaagtaaagattggctgggcatggttgctcacgcctgtaatcccagcactttgggaggctgaggtgggcggatcacaaggtcaggagtttgagaccagcctggccaatatggcaaaaccccatctctactaaaaatacaaaaattagctcagtgtggtggtgggcgcctgtagtcccagctacttgggaggctgaggcaggagaatcacttgaacccgggaggcggaggttatagtgagctggattgcgccactgcactt

SEQ ID NO: 133769 - DNA, 1031 bp, Homo sapiens
atctttgaagtccaggggaagttgccaggtggggaagagggagttctgtgggtaaaggtgaggggcagggtgggagcccagggtttccctcaggactccctgcagggagtgcatcagggctggcctggctgcgacaggtggggcattgcataggcaaaatgcttggcgagattaaagaattaaccaatataaagtcaggggagcatcacctgaacaaaataagctaacaggatttggaatccacgtaagattatccatgacttagaatttctaattccattccagggattttggctcctagcaagaacacaaaaggtgccaaaaagattagttgcgggggaaacaaatttccgtgattagatcaagacaactttggctgctaggagcagaatcacccttccctcccttcttccttgttgctttcctgcgtggaatgagttacagccaagatgtgacttcacatacatcccagggcctctgctgacagatgctataacacaattaggatggaggtgttagaattgtgcaacactcaattctagatcctgccagagcctaagccaggaacttggtctttgcctcgcctgcccctcattttgagaggtgaagccagctggatttctgggcggggtgaggacttggagaactttttcgttttataggaggattgtaaaatgcactaatcagcattctgtatctaggattgtaaaaagcaccaattagcgctctgcgtctagctagaggtttgtaaaatgtgccaatgactgctcagtaaaaacataccaatcagcactctgtggttagctagaggtttgtaaaatggaccaatcagcaggatgtgggaggggacaaataagggaataaaagctggccacctccccccgccccccacctcccccaagacagcagcagcaacctgctcaggttcccttccatggctgtggaatctttgttctttcgctcttcacaataaatcttgctgctgctcactctttgggtccagtgccacctttgaaagctgtaacactcac

SEQ ID NO: 133770 - DNA, 1036 bp, Homo sapiens
agcaccccaaccccagtgtgcacccacgcatctctctcccctatgcagctctacaccaggtacgctggttttgcccaatgtggggagcaccgttgctgtgctcagcctgcagaagtgggatctgtgcccgctgtggggagggttggccaacgttgggtgcccaggtcttcctgggcatgctttccagggtttctagcacatttccttttcagcacagatgatgctcttaaagattcggggtgtggcccaggggtgccctctcagtgaggacacacgagcttccctgccctctgcataatgtgtcagcgtccacacctccagtctgggtccttttttgtgacatggatcgtacttccccatgaactccagtctctttcttggcgttgtttctctgcacgtatcttcttctcgcacgtgtctgggtttgagattatttttcctatgttgatttttagatggtattggccaaagtgtttagaactaagaaacctacagacccagcgtaagggggtaaatgacagcacaaaaaatagaacagagagtctgtttgaagagggaatttgaaattcatgccagaccaaaaatggttgagctgaagcattgctcttaaattgtttaagggagtgggaagagtgcagtggggtcaggaggaaattaatgaacttcaacgaaatggttggtgatggaaaacatataagcaacacgtgaataaacacggggaattaattttggagctgctgggaaggagtaaaactaaagaataagcaaggaaaagcagagcgtctgtgggggcagggaacattttccactccagcatgggacaacctcgaccatctagtgaagcctcttctttgaaagctcttgagagaatctttctaccatgttggtggccgacttcacctttcttcctcctttgccagtttcttgggagaaaatggtagttaagtatttttgtatgataaggcttcagattctaagagcgattccaagatttttttcttaaattaccaggaaaaaagtccatatatgaaatccc

SEQ ID NO: 133771 - DNA, 1069 bp, Homo sapiens
agttgaggctcctttgggttttcttggacttggagcagtgtgaagcaactttgctctgtcctctgtcattgggagccacctgcatgggtgttggaatgtctttgggtcataagttgaattgaaaagaatgcccgtggggaccagaggcaaattctggtgctggttcttttgtgtctctaaacatgacttgttctggaggtgttgcctcagtctcttgatgggatagaacattggctgtgtgggatggaaccccctctccacgggttacaccttgatgcacttgtcttatcctctgagaagctgcaagggcgtccatgctgaccactggcgtcatctcgaagatgccatgcctttgcggagcttttaaattttcctctgtggctgcggtaacgttttgcaaagtggatttcactgtgcccccctcccttgcgttccttcacagaatgacaaagcctccagggtgggcacatttggaaactggtgcagcctgttttacaaaaacctgctttgtattttctaacatagtgtttctcaaacatatttgatcatagcgctcttttattttggggactgtgttaggggaaatacgggtgtggaggtttactgtttctgattctgtggagccacaaaaagtcaaatcgtgttcccatgcaggcacaaagccacagtgcccatgcttccttgctcgacagcatgaacccagccttctgcagagaaaagcagtgatactgtgcaggcatggctggttttcttgccagtctttctattcaacacctgtagcaaaataagcaggataattgacatgacggcttttcaacattcagtcctgatatttattgaactagtgatgtagatgaggaaagtgcagggtgcacattttctcctgtggagcttgcatgattgacaccactgaacgggggtcctccacttactatcatggggttcttcagaagcactcctcagcatgtgattcatgccaggatctgccctgctttttagatgaattatgtcatttagtctttgaaacagtctgtgaggggagatgctgtttgtcccttttacagatggg

SEQ ID NO: 133772 - DNA, 1450 bp, Homo sapiens
agtctgcccccagggccaagccccctgatgccaggcgcctagtgctgcccgtcctagggcctttgtttctcttacagggacctgggcaaaaacaaaaaagccaacaaaagcaaacatcctcatggcggctggaattgtggggctgtcagcaagtgtgatttatgcgggacctggaagccctttgaagtaggaggcaaagtggatgcccctggtctcctggggaggctgtgttaggaccaaatggaggaaggagctgccatcctcgccctgggagggtgtgtcagggagctctctcacttttgttccatctccaaagcacaggggtaggccctgaagcagtggacagaaaaagaggtgagctgcgtttgctcctccagcttttgtggagcccgcagggcaggggcaggggtgcttggccagctggctgctcctctgaggtttcctggtgtgtggcagccaagtcatgttgagtgccggaggtggggtatccatggagcggtgcaaggaggagatttgcaatgagcatatttgggggtgtcagtgtggacccaggtggccgccggggacttgggactggaaggtgacttttcacagatggatcctagtggatgctttagattgaaatgagatgcagaattctgtcttctgattgtattaacagtgctgtcaagaacgtaattatgtaagattcaaccagctttcttgacatctcagttttccttcaccatttgcaaaatttagtgtgtcatcattttagtttggaaattttattttggaaataaaatgtcattattattttcttttgaaagaaggaaactccattgttttgcaaggcagagctctgacacaattacgtctaattagtgaagtgttgtatatgttttcagagttcaaataaggttcacgtactctctttttgttgttgttgctgttttctaaactctgagctcatttcttttctttctttttaagaaaataataattttaaaagaactaagtcaagtttctcatagttgaccaaccacacatttctatggggccctaaaaactcagctgtttaaaaataaagcaaaatgaaaaagaaagaacaacagccaaatgagggtatacgttgaactactcaggattaagtttaaacaaatgcttttcataattgctgtcttccccagccagaaactaaggcctgctgtgtgctttgggtgtgtgggtgggtgggttgctgggggaagggtccttgtaatattcggggagttttggctggggccaattatttgttcataattctaagtatttaaacaatgctacgtattttctgtcttttatggaggcagatatctctaagtggcccctcctggtgctggggtatgatcaaaagggacttctgtaagttttcactggactgctttaattttctatcagaacagtgtatttagtacttgattaagtaaaa

SEQ ID NO: 133773 - DNA, 1184 bp, Homo sapiens
ggagatataaggatggaataggggaaggcaaggaagaatctggaggggttgaattggaattggaggtatcagtgtaactcatgctttcatttatatatatatttggtatatattatgttaaattatgcaccgtaatttgtaaaacatactctacacataacagttatttcttagcacctcattagcagtgagctttcttagtgcccagatgttggtttctcaatactgttgcatcttaaaggagctagagaaccttggagaaatgactgaatatgggatggggacagggaaaaatacacaataagcctgaaacgtgttcttgtgttagaacgcaagtgagtggtgaaaagtggtgggggcatggcagatgtactcaggggccaacttgaaggagttgcagccaagtctgggaccatttaggcatcagaataaataaagacaagcatggattatacaaggaacaaaataggcatccaggactcaccattgataataagtacataactatatgtatgagtttcttaggcctgctgtagcaaaatgccataaacggggtgacctaaaaaccagaaatgtattctcccacagttttagaggctagaagtccaaaatcaaggtggcggcagggccacgatccctcccagggctctaggggagaaaacttttttgcctcttttagttcctggtggctcatggtgcccttggtttggagctatatcactttgacttctatcgccattttcacatgaccttttattgtaaggacaccagtgattggatttagggaccactgtaaatacaggatgatttaatctcatgttccttattactactggaaagactatttccaaataaggtcactttctgagcttctgggtggatagggaaacactaatttactacaaaacctaagtgggaggggtggggaagagagggcacttcctagagcaaagtgccaactgataaatgggaggcgagttgggaataatcacattttacagcaataactgtacggattgatttgggcaggcgtcatgaatgagtgctaaactcattaaagaagacatgtttgatgaggagcaggaaatgtctgtggtctcaaaggatttccccacagattccttgttggcaagggacagttgctaactgtagactggcgagatttgcatcccaatacctgggtg

SEQ ID NO: 133774 - DNA, 2791 bp, Homo sapiens
attaatcccctttagaaaggtttcagctggtggactggcactcctttaaaatgcattccctgagaggccaggatgggaaaagttattagtgaaatgggaactggatgtgaaggacttgagctccctaatctgcaggacctggctagtctgttgtagtgctggaaatttgtgtactctttgtaatcctttcccttggagagttctaattatataattccacattgtagtcagggaaaagaaagttaacgctacaaactgttactccttcccagggtttataaccatcttctaaaatggttccttgatgacaggcctttccttttggtgtttatctggttcattccctgggaacctggaggggacactgtgaaggactccctcctcctcctcttccacaccccatcagcgtcttgtggtttccacgtggtgaagggctgggcagcccaattttgggtttaccttgaggtgcctccttgggggctcctcggggcgggctcttccttgctcttgcccattggttgtgactccatacattgtcattaggatatttcctttttgggagccccgtggtgaccaccaagtggagaataccaagcatgtaaggtttcaaagtaaagaaaccagggggctttgttttgcagtggaagcattgctagctaggtctggatttttattggttgcaccccagctgcatggccaatagcaatttcatgaagggactgttgggttgaagggactggctttgaaaacattacttctcagtgaccctttgggctcttaggttctgctttgccccacaacaccaccataacactgttgaggctttcagtgggtagtgtgggcttcttgagttttgaaagtaaaaatccaagcaacaagaggcgctccagcccattaattatagctgcaactggccggggttttgtagcagccgcctttttctagcatgtatttatttggttttgttgaagagcttgccaagttggaaacgagggcgggacagctttgcttgcgtgtgcagttgtcataaaatatgtctggggtgtaatctgtttaaaatcatattcgtagagtggccaaagaattgttgaacagtgttgggaattttcataaagcttttacaaaatagggaattttattggtgtggttggcactgtttttgggatttctgtgggtgttttctttttaagtcctatctctgaaaaaagcaaaaaactcaaaagctaaagggaaggaaataattacagaaaaatgtagcttaattcgactaagtagcttggtcctctagaaatccttaagttctagtgggaagtggtgtgtatgtctttaattgtcgctggaatgagcttcagtaagcactctgtcactttctagatgttatcagaggagaatgtggcggctgcttcaagtcctcctggagtgggggagggttcccctaaatcccaaatactcctagcctaatggtttccacaccctcctggagggatagttaacacaatgggcagttaaaataaggaaatgtttaggcctgaactcctcattgtaggcttgtgctgtggaatatagtagccaccaggcacacacagctatataagttaaaattaattaaaattaaaagaaattaaagattcacttcctccccttcactggcttcatttcaggtgtcagtagccacaaattgctatgcaaaaatgtcactgggattttagtagaggttgcattgaattggtagatggatctgagtagtattaacttttttttttttttttgagttaaggtcttgctctgtcacccaggctggagtgcagtggtgcaaacacggctcactacctctggccttaacctcctgggctaagcctctacctcctgggctcaagttatcctcccatcttagcctctgaagtagctggaaccacaggcacgcgctaccgtgcctggctaattctttgattttttttcgtagagatggaggtccacttgtgttgcccaggctggtcttgaactcctgggctgaagggattccccacccccaccccagtcctgggatcgtaggcatgagccacctcactggccatcatcttaacagtattgtcttcctgtccataaacacaggatgtcttaacatttatttagacctttcatttctttcagcaatgttttttagtttttagtgtatgagtcttttgcctcttaagttaaatctattcctgagtattttattcttttcgagctgttgtaattggaattgtgttttttaaatttccttttcacattgcccactgttagtgcacagaaatgtaacatttttgtgtgttgattttctaacctgcaagcttgtggaatttgcttattagctcaaatagcatttttgtagctcttattctgtatgtaaagtcgtatcatctacaaataggcataattttacttcttcctttacaatttggatgccttttattatttttggtcttgcctaattgctcagcctggaacttccaatacagtcatgggccaaataatgatgttttcagacgatggaccacctatatgacagtggtcccataagataacactactgtatatgactgtgccttttatatggttagatacacaaatgcttcccatcctgttacagttgcctacagtattcagtacagccacatgctgtataggtttgttgtagcctaggagaagtaggctacaccacatagcctaggtgtgcagtttgtgtgagggacactctatgatgttcatatgatgatgaaattgcccagggacacatttcccagaatgt

SEQ ID NO: 133775 - DNA, 1033 bp, Homo sapiens
tggtgtgacctcagctgactgcaacctccaccccctgggttcaagcaattcccctgcctcagcctcccgaggagctgggactacaggcacctgccaccatgcctggctaattttttgtattttggtggagacggggtttcaccatgttggccaggatagtctcaatctcctgacctcgtgatccacccacctcggcctcccaaagtgctgggattacaggcgtgagcctttgtgcccagcctcaatttttgtatttttggtagaaacagggtttcataatgttggccaggctggtctggaactcctgaccacaaacgatctgctcacttcagcctcccaaagtgctgggattataggcatgagccaccacagcaagccatctatactttcttgttcttgaactagaagtgtcatttatgactttacaaataaaaatgggaatgaaccattaagttccatagtgacaggcgtcattgctgggcgttggtacagagtggacattctataatgatttgttgaatgaatgaatgaataaatgaatgaatgaacaaagttttcatacttcaatttcagtatacttaagccatttgtaagatagagcctcggccgggcacggtggctcacgcctgtaatcccagcactttgggaggccgaggcgggcagatcacgaggtcaggagttcgagaccagtctggccaacatagtgaaaccccgtctctactaaaaatatcaaaaaaattagccaggcgtggtggtatgtgcctgtaatcccagctactttttggaggctgaggcaggagaattgtgtgaacctgggaggcagaggttgcagtgagccgagatcgcaccactgcactccagtctgggtgacagaacgagactccgtctcaaaaaataaaataaaataaaataaaagacagagcctcatacctctgaattcttgggcaagtatctattagggtttaaggctgcatctttctgagaaaatatcatgttgattgctaatctgaagtaaagacgttactattttcca

SEQ ID NO: 133776 - DNA, 2195 bp, Homo sapiens
ccaggctggagtgcaatggcgcgatctcggctcactgctagctccgcctcccaggttcacgccattctcctgcctcagcctcccaagtagctgggactacaggcacccgccaccacactggctaattttttggtatttttagcagagatggggtttcactgtgttagccaggatggtctcgatctcctgacctcgtgatccacctgccttggcctccaaagtgctgggattacaggcgtgagccactgcgcctggcccacaaagataattctttgtgtcctttactgttctcagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctgattattagtctatttgcatatgtaatatatccaacagaatagtctcttaattttaacttttttgcactggggtagtattctttgttgtttggtcttattttagaaaataacaattaaatttcttagttccttttttcacatccaaccaaagaatatatagtatctgaagtttcctaggttcttgctgacctcataggactacaaaaatatcatggccattattttcataaataactgttcagcttcttttagaatactttctaagtgaaaatagcaacatcaaaataatgtttgtaataaactttttgaaaatatgatcaggagtttctgggaaagatggcggatcaggcacattatttcagtccttaaaaccaacattgtaaacgaaaggaaccaaaagtaaaatttttgtgttaaaattatagagtgaccacaatccagtaatatacaccacgatgaaatgtctactagaaacagtaaaatttggatc

SEQ ID NO: 133777 - DNA, 1178 bp, Homo sapiens
tgctttctttattttagtagagattgttttcattttttcttaatgttgacagatggttaatatataggaaagctgggtaaaactttgttaacgccagattctgcagtgcccagtggcaccatgcccagatgccacatgtggacatcgtttttgctaatatctgaagtgcagtggtttttctctgacgcagttctactggtggtggtggtcataagtccagcctgcaggactttgctcgcaccacttcctcatgtgctaactctgctttgtctaaatggtagtcactagctagctatggctgtttgaatttaaactaagtggaaataagaaaaggtgcaactgtgacctctcagtagcaccagccatatctccgtgtgctcagcaggcacacagggctcatggcgactgctgggcactacacaacagaggtatttgtcattgcagaaagttctgtggacagtgctgccaaggtggtggtgtagtattttggtgatatcttctagcaattataattggaaaagtgaattaaagctaccgttgcaggatttcagcgttcccccagtttaattaccaccatgtctgaagtccaggttgcagatgtcttctttttcttcctacagtgcatgaacagaagtattgcattaactcaggcgcgctacttggagaaagaagagaagtgtctccctcctcccaggtcagttgacgttaaaatatgaccttatttttttcccctactctgagctctatgaaatacgttatcttttgaaaaattttgaaagactatcataggctatggaagaatatctgtcattaaaatatagtacattacctgtcttctgctcttaaactagaagtttctaaaattttaactgaaaagctcccaaggactcactgagtaccctctcagttaactcagagaaatgtctgggagcccagcaatgaacttgggcaaactgagtttccatcagctcatatctgccacatctgaaaggtggcacatgccacaccaggagttcctgccacaaggaccgtcctgcagggaagatcggcagtgtggggtgggggtgggcatgcgcctctgctgctccttcagtcagcaacactcagtaacatttgagaaaaaacaagcaacagtggggaaaatgtacagcatcaagaaaaaacaccaaaagtgaaag

SEQ ID NO: 133778 - DNA, 1033 bp, Homo sapiens
gaagaaggccccagcagcaggcagtgctggagctgggccctggcacatgcagccaacacagggaagaacaaacattgggggcgagggagcacatggcaagggaatgacaggccaaggtggggcccagagggcctgtaaggaggcacagactccctggtgggaggctggggccatgagacccggtcctgcactcaggaagccacattgcaggcagacttttttagatgaggaagcactgcccagagtgcctcgtttccctttctttgttggaattggaatgatgcttcccatcagtcgcaagcttctgtacgttcactgtgccttgacattgtggacttctaacattatttctccgtgagcgatcttcaagcctggaagggacttacagctgtgtgtgtgtttcccttcttcagcatttctggattaaaagtggtgggggagtccctttctccagcctttcacctacaactggaagagagcactgggtctcgcgagcaagatgtcagactgcttcaggaaattgtagatcaagtaagtatccgttgacttgaggcatccccccacaccacttctgcccttgccccaagcaattttttaatgttaaatttttaagaaaagtctctttgccctgagagagaagagggtagaaaggaagatgctggtgacccgctcttgacatggaatcctaatcctccaggtccttcctagcttctggccatggtaacaggcagcaggccctcccattgggtcaatgtgtggctccctccaaagatattgtgttttgtaccactttgcatttaaatatacttggcctctcctctgaaaaattagccttgcagaaaactcacttgctcaccattttacaaagccaggctttcctatgtgtagttgggggaggcattgtgtgtgggcatagcacacattcctggacggctggctgtccccgcagcacagctcagggacagtccactcacagtcaccctgaagtcaggatgctcttgtaaacggaaaggaagaccgctttttataacat

SEQ ID NO: 133779 - DNA, 1072 bp, Homo sapiens
tagcttcggtagatgatttggctattttccactctttctgcttcatggaagcactgagtaaaacaaggcttgatcgtttcttcagaagttgagagtaggtctcccactttacagccatctaggcttggggcctttggtttgggaatagttgttgattatctctcatatatctatattattttaactttttatttatgtaaatttggttttgtgtgttttcatcatagtgtgttttcttatttttatgcactgtctcattgcactgtgttcttactcttcttcagcttcttacatttagcttttggttttatttcgtattttccaataaatatattaaagataaatattttcaaaggcagtatcttcaatgtttagttctgagtaatttttttgttcaatttttctctaatttctcacttctctcatctctgagattgagtttgggaaaggaagtcaacatcctatgctggtttgcctctgttttcattgtaatagagatagttattggtgtcaggttctccctatagactgtaagcacacagtggagaccgtggctaccttggtgattgctctgtccctgggagctagcccagtgctcgtttatccactgggataagatgatatgtttggcaaagtcttttgttaaggaatagtataatagactctgaaacacggcttcgctgaactcaagctataactgtgtccgtttggttttaattaaactcatctgacattcagcatctaggcaaccagagacagggcattttgtttaattccttctctcactagcatgtgaaatgagaccatttgatcaaaaagcacaagttagatctggacctcaggtgccttgtatttcttttctttttttttttttttcttttgagacagagtcttgctctgtcactcaggctggagcacagtggcgcgatctcagctcactgcaacctccacttcccagattcaagcgattttcctgtctcagcctcctgagtagctgggattacaggcacgtgccaccacacctggctaatttttgtatttttagtagagacggggtttcaccacattggtc

SEQ ID NO: 133780 - DNA, 1201 bp, Homo sapiens
gttcaagtgattctcctgcctcagcctcccaggtagctgggattacaagcatgtgccaccatgcccggctaattttgtatttttagtagagacaaggtttcttcatgttggtcaggctggtcttgaactcccaacctcaggtgatccaccctccttggcctcccaaagtgctgagattacaggcgtgagccaccacgcatggccaaaacttagctttttaatagtgaaagcagcataactgtttttagaaaccatgaccattgagatttcctttattgaggtgaaattcacataacacaaaattaaccaatttaaattgtacaggacagtgacatttattacatttaccatgtgtgcaaccatcaactttaggtcaaaaaccttttcatgactcacgaagaagacctcaaacccattaaacagtcactccccattttcttctccctctagctcccagcaactaccaatctgctttctgtctctatggatttaccttttctggttatttcctataaatggcatcatataatatatgaccttttctttctggcttcattcacttgatgtttttaaagttcattaacattgtataccatgtatcagtatttcatacctttttaatgctgagttatagtccattgcatggataataccacgttttgttttatatgttcatccacagatggatatttgggttctttctacctttttgctattgcaaatagtgctgttgtgaacatttgtgtacaggtatttgtttgaattcctgttttcagttcttttatgtatatatctagcagggtaattgctggattatatggtaattctgtgtttaacttaataaggaactgacatactgttttcaacagcgattgcaccattttacattcctatcagctatataccagggttacagtttctctacatctttgtcagcacttatattttccagggttttttgttggtttgttttagccaccctagtgagcatgaggtagtatctcactgtggttttgatcctgtttcccccaaatggctaatgatgctgagcctcttttcttgtttttttttttgtttgtttgtttgtttggccatgcgtatacctttggagacatatctattcaggtgctttgcccattttttaaattgggttgtttttttgtttttaaaagaattccttgtatattctggatactagatg

SEQ ID NO: 133781 - DNA, 1050 bp, Homo sapiens
cattacatcattcttgtgccatctgttcctcaccccatcttcatgatgatgaccttcattatagttgttttgggtaaaattgacagacattgaatcacatgaatgcagccatacaattttgaccagtgattatacccatgtaacccaggaatgtcagccccattatgatgtaaaacattcccatttctttagaaagtcccttaggccccttcccagttggaggtttggagggttttgtttgtgttttaatattctcagagggcctaattagtttgtgtgtgtggcgggtcacctagctaatgctgtgagctgaaaaacgtctgagagaagatagtactgttgttcatctcaaaataacccatcacaaacactgagctttcaattcattcagaatatttttttaggaataaatcttgtaaggtgaaagtgctggggaatatgtaacagatcttgtcttcagagttactgaaatgtaagatgtctgctttttctcttttaaagaatcctcgcaaggctcgtgtaactcggcgtttcattgtagtagaaggattgtatatgaatactggaactatttgtcctcttccagaattggtaagcaaccatgttcagctgtaattttaatatttggactatttgacagatgtgccttttgtttatgaccgcttttagtgtataacgtctgcgttgctttgcgcattaggcctcataagcatattttgctcagatcagggaagaagaacaacactgaatgccagtgctggccttcaaagagtaatcaagactgctctgttgcccaggctggagtgcagtggtgtgaacacagctcactgcagccttaccctcctgggctcaagtgatccttccaccttagctttctgagttagctgggactacaggcacatgccaccacacctggctgatttttcccttttttgtggagtaggggtctcactgcgttacccaggctgttctcaaactcttgggctcaagcgatcctcctgcctcagcctgccaaagtgctggtattacaggtatgagccaccacacctg

SEQ ID NO: 133782 - DNA, 1175 bp, Homo sapiens
caacattagggaaataagtagtttatggtatactcacaggcagaacgtctccattaaaatcatgtaatccgaaataatttagaaatgctcacagcataatgtttttaaaatcaggtcctaaaactacagtaaaatcctgattctgaacaaagtaatttatatgtttatacaagaaagacaaaaattatcaccgtgtggtatgattagctgatttatttaattgttttttgtacttttccatttcccaagaatcctacattgaatatttttaaatctaagaaaatgtttttccttaaagacaggcagaggtagcatgccctgtgtagaaattagggtggcatctcttcatccatcacttctaacatattgctagctccccagctttcagttgtgagttgacagagtaaagatgattgagcaacatcagtgatatgtactttttattcctcaacaaactttttttttagtgctactgctgtgggttgtaaaataccccttaaagcattgctctgatactttctaattctgatcatttctaattgtccattggagcagaaacttagaggcaagagatctctgagtaagaaggtaatggcaaactctatctgtggatctcagtattttttgcagtcccacacacctgaaccatgtacagtttcatacatgtgggagatttattagtgacttgctctgagcagagtgtgtgaaggtgtgtgttttttgaaaagatctctgccgggcgtggtggctcaaagctgtaatcccagcagtttgagaggccgaggtcagtaatcaagaggtcaggagttcaagaccagcctggccaacatggtgaaaccccatctctactaaaaatacaaaaatcagctgagcgtggtggcgggtgcctgtaatcccagctactcgggaggctgaggcagagaattgcttgaaccctggaggcggaggttgcagcgagcagagatggcgccactgcactcccacctgggtgacagtgagactccatctcaaaaaaaagaaaaggagacctctctaccccaccacctgggaacatcattggacaagctcatagtcaaattttacttgatccgataatacatcagtggggagtgaggagggaacagggttgcccctttttttgggaggtgaaggaaaacggtttgagttttttaact

SEQ ID NO: 133783 - DNA, 1050 bp, Homo sapiens
tctaaaagttttctgtctagctgggctgccagtattacttctcagggcaaaataatggcagagtaatgtgtcagtcatatcagagatgccactgatggtgaggcacaccagtattttatgtttcttagaaagagaaaagtatgtgaataaactgatatgtcatccatagtaagatgcatgctaatttcagagagattaatatatagtgagagtgtgcttcttggaatagattaaatatggtagttatgtgaaaaggactcatggatgaagagcaaacaatgatgtataaatattcaaacatgttttatttatttgctatgctcatgttaacaatcagtgattggtcagcttacaaaaacaagcattcctttttgagaatgttgacaagaccctttaaacccaatttggtggatctcttttccttgcagagatagagctgcctgctttgctattcagaaaggattacaggcatcccgtagtgacattaagttatttaagcataatgacatggctgacctcgagcgactactaaaagaacaagagatcgaagatcaaaaggtatgattcttttgaagaaaattatacagttcttttgtactttctaaccagctaaattatatatgaaatggtaatttgtcatgaaaacttgcctgtggatcacatttggatattaaggtgttcctgcttattaaatgtacttggtgttggagagccaagtctgattgtaattgccttgtcattgccgtaattacatatagcaaattggagggaggtaatccaagcagctttctgagagatcaagagaggctgaaaaacagcatgtgcttagtgaggcagggagatgtctactcatagctgggcataatgacaccaaaacttactaggcctttaatgacatgtacctagtgaattcagaataggcttattcataccagaataaatcatgtatcaattacatgaggaaagaatggcagcaagcttattatattaatatatgaacaaagtgaagccctttctccccaccccacctgtatcctgctctgagcagct

SEQ ID NO: 133784 - DNA, 1035 bp, Homo sapiens
ctatctccaaaaaaaagaaaaaaaatcatagtattggaaagcgctatgcaagtttttcccattactttttgtctgacagagttgtgagcgggacctagacagagagaggcaagagtctcttatgtggctcagtgttaggcagcaaccacagaactgaacaggccagacctagagaatagttggagaagggtctaggaaattgctctctctcctattgggattgtgggctaacaggcattttccaggaaagacttggcccacaaatgcagaaaagttaaccaggttttgagaatcaggctagtataacttttccatattttaagtcatatactcagtctttacacctgtctcttctttatattctgttagagttggaggaggaaggaaggagctctgtgggttaaagaataggaaatgtttgttttgaactcttaaagataaattattaaagtataattcttgtacttcaataaaggcagcagctttagcatctctaaagaagtatggcgtggggacttgtggacccagaggattttatggcacatttggtaagtttttgttgtgttctctttgagactactgctttcaatagttaagattcaattttaggctgggcatggtggctcacacctgtactcccagcactttggggaggctgaggtgggaggattccttgagcccaggaatttgataccagcatgggcaatatagggagaccctgtctctacaaaaaataataaaattagccgggcatggtgggctcatcctcgtgtgcatgtgtggggattgcagcgtgaggaacgagtgcagagcagcagtactctttatgcaggggagatggcctcatacttctgcccacagtccactgatgagagcggaacccctgccatgactagccacgcagggggctgagaaacagctctaggaagaaagtggagagcagattgcctggggtggagggaggggggataaacagtgtagttttttatctttctagaatgaagatgaaggatcattgatttccttgtgtatgga

SEQ ID NO: 133785 - DNA, 1395 bp, Homo sapiens
ctaaatcatatacttggtctttctgtcctggccagcactaccctgaattgtctcattagcaacaactgtcaggtttggtgaacatacccaccatgagaaacaaagattcctaccaggaaattccaaggatttagaggttcacctcaggagctgggacaaaaggcagaactcttaggataaggccaaattccttactacacaagcagttaacatttttttaaatattcacccccaataggtaaaatactgattttttttcaactttttctttccattctagaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaatcccaggtgataatttgagtcctcagagaagcagatgacatgacaaagttagatgtgcaagaatttattagaggaaacataaatggaggataaacgggagatggagcaagcgtaggtcgagagagccttcagactgcagtgtgggtctgacacctgtaaaaagagaaaatgaagattgattagcaaaaacttagactgcagtgcaactctaagatgaagtcttggtcaggccaatggagagttcccaagcaaggattccttttagtagagttcagaattgggcagaaatagcctggctttgtttctctgacttcctcaagtcagtttctgggaggagaccaaggggagcgtggccttcgcacaaatgccttgatggatctgaaagtaccaactacactcctcatgtcagattcttttgaagggagatctgaa

SEQ ID NO: 133786 - DNA, 1806 bp, Homo sapiens
tcacatctgctcctgagtcaaataacatcttctgactgtaattagcactttttaatgtaagtttttcatggtgaagcttgagattctgatataggaggaaattttaagaggagctgtattatacagagaaaatactaaaatagagaaaacaattagccctatatttcagattatgaatattatgatgtttgttttgcaacattgagatttcctaccattacatgtcattaaaggctggttttatagaaaaggcaatgtctcttgataaacagaaattaagtggaaagcattatcgtaaaaagatacatgatagttaaataggaaaaattgaatgacttcagttttgaatttgttcgttaaccctgaaagaattgttgttgttatttttagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaaggtatgtgcctccccacagcaggcagactgtggggtgctgggcattgaagttgtctttaatattcaaatatgtgtgtatttctagtcggcttcaaagtattgctttaaagtgtgggctctcacgcaactttggggagcaaccacaggcttttcttttggtgtgttatagagaccctcatccatctggcatggttaggaaatgaaaaaattggttaggtaaaaattacaactaaattgtttgagtgccaaaacattttaatctcaaattttactttcttttctgaggaaaaatgttctgaaaacttctatacctccatgccttaatcaacagactagattgatagtgatttttttcctgatattttaggatcctcattgtgcacatttgtactgaagtcttcgggctcctcacttcactgtgtactgagtatctgctccccaagctgctgggcttttatataagttttttttttttctttttccccttccccttcacctctatgaaatgttgagagctgtttctgcatggactgcatcttcagcggtcacactcacgctcctggacgcactgctggcctcagcactgcctgttagagctgtccgcagtggccacctcttttggagctagagggtgaactctcgagatttaatccagtttgttctgtcttccacagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcagggtaaggagattgtggaccgtaagttttttatttttgttgaaagtagattttgatgccattaaccatttgtagcatatacatgtaagatagtactattgttatcctgttttgttattctttccccagaaatttaccataatataattttcttttctttttttttttttttttttttttttgagactgagtctcactttgtctcccaggctggagtgcagtggcacgatcttggcttactgcaacctccgcctcctgggttcaggcctggggcttcaacccaggaacaaggattctcctgcctcagacttccgagtagctgggactacgggcgcctgccaccatggctggctcatttttggattttagtagagacggggtttcaccatgttggccaggctggtctcaaactcctgacctcaggtgatccgcccacctcggcctcccaa

SEQ ID NO: 133787 - DNA, 1076 bp, Homo sapiens
gctgcattatagactctccagatttaaataacattttgctgagttgggaagaagtgtttctccttatttgattgtcatggtgtgcactgttcattcccacaggctttggtcctcttagatgtcactcctgaccagtcaatggtagatgaaggaatggctcgggaagtcatcaatcgcatacagaaacttcgcaaaaaggttagtttgtcagttaagaataagctactgttttggctttttgtttgttttggttgtttggagaagataggagaggcaggtaatataaaccatagtgatcaatgcataacaatcactaatccatagtccatttggaatgtattctgcagaaaagtcactcctcttcctctccccacgtgttcactcccaagtcgtagctttcagccagcctgtgccttttcccatccttttttttagctccgttgggcttctacagaatatcccctgtgactggagcagaaggtaatcagagctgatagtgtctttgcagaagggcagaggtgcagtcagcatagacaggcttctagcttaggggagattcccggatttggacagagttgggtagtttttccttattagagagctgaggaatatgcagggagctcatcctggagcgcagaggggctgcaaagcccctgctagtgagagaatcaggaatttcttgccctgtagagggcagtgacagctaacatacatctttcttcccagacggttcaaggtctgaggaggctgttccagcagatgagtgggtgcttgtgacctctgaatcagttcagagctttgtaagtgggttctaagtaatttcttggtttcaacattcatgaggtactgattgttctaggaaaagaaacatgccctatcccccaaagagtggtgaaaaagacacaaagttaatcatgtactgagtgcagttagtcttacggatcacccagcagggagggaagggtgactgcccttctgtgatgattcagcatgggatctgtagcccttgttcaacagtaccttccttcagttctgattaatagaatgtacttcccttttaaatttttctgtgtgtg

SEQ ID NO: 133788 - DNA, 1100 bp, Homo sapiens
gttcttatcagttcagatattagttaaataatataaaagtggaacggctccaactttaattctttttatcctgtttcctttactccatatgttataaggctcctatttattccttaaccgaaggaaaatctgctttgtacaaggtgctgtgcctggtgctctccatgcctgatctcatcacctccatcctgtgaagcagggggtattttccccagtttacagatgaggtttctgaggtgtgggacagtcagtcttctgtgcatattgacttggctgatacatcattaggtgctcctgtttctattttagacatccttcagaattctagaggtgctttgggtttttctatctacagtcctgcagctatgcttcagggatatgaggccatttctcattcacagggcatgttttgtaacctcatgctcattttggtgcctattactgtgtcattctctaacatgtttagttgtttctcagtataaatgagatcagttgttgatgactgcatataactgacatgatgtcctgtgtcttcatacaggctccctacacaccttttctcactgaattgatgtaccagaatctaaaggtgctgattgaccctgtttctgttcaggacaaggacacactcagcattcactacctcatgctgccccgtgttcggtaggactcaaatagaaataagcctcacctgtgccaaggaggggagagttgctcaagcatgtggggaagaggagggatttccctgctccagctccatctgtgccttgcctcccgccccagctgacatgaactcctcaggctgcaggatggggcccactttggtacacggtagcaaggatgcttggtgtggaacccctttgtagagctgtggcaggtggggtgtgggcatgccccatgggggctccttggggagatgccgggtgctgagtggtaggcactgcgctgcccttccccagtgcttcaccaggagggcctagccacacttctctagcctgaccctcttcctcgcttatgcatgcctagtgccttcaattttctcctcttaaatctaaactctttcatattcctacctctaccactcagagaagaattgattg

SEQ ID NO: 133789 - DNA, 1485 bp, Homo sapiens
tattaattaaatgggaggtgaatgagaatccttaaaataagccttgcctcagacaattggctaaacaccctttctttcctacttgatctctgagtttctcagggaactcttcaaatcctcctaattcctcaagaccttcactacctctgatgctgtttttactcgactgttttaatgtttagaaggccagttctattttattcatagcctgtgccagagtttcttaactgcagcactatgggcagtttgggccaggtcatcctctgtggtggggctgtgctgtgctttataactgagcagcatctctgggtctacccattagattccagtagcaccgtgctaccctccaagttgtgacaagcaaaatgtttctccaaacgttgacaaatgtttcccatgggataaaattgcttttgtttgagaatcactggcctatgctgtgcctcttagcatctgaattgtgctttttgtcttttagttgaagtacagtgtaatacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaaggtaagtgcagactgctgttgggaaaagcaaaaagtgtatgaagtttgaaagtagaagaaatatgagaatagccagaagggagaggaacattttcagttgctctccgtttttgaagctttgtttttcttttccttttacattgcattttaactatatttgtcatttgagggatagggatctataagttctaaaagtcattttgcattattttcacaacacaattatgtacatgtcatattggagggagaatgtcaaggcacaaacaggactacactgagcagacctcttaaaattcaaaataaaatcatgcaaatattttataaaaatactggtagatatggcattaatattgagaggggtacttccttctaccacaagggagtcagatattatttactgtggacagaactcctctgtagctgttgggggtttaggatgagcagagcataggtcctggtctcaggacttaagccaggtacataaataacaatgatgcttaatagagagagcgaggt

SEQ ID NO: 133790 - DNA, 1058 bp, Homo sapiens
cttagtgctggtgtaccccattggtcctgcagtgagagtggcataagatgcatttctgtgctatacagtgccatattttggtgtcagattatatacgtcttttataatttgctaagtctcttatagaaagtgagagtgagttttgtgagttttaaattgaccactcaaagagtattcataattacccccttttgtagaaaataggactgattttcatcttgctctctcaatatgtcgagtagtaataattggtttactgtctaagtaccttttctgtctaatttttctccctcttccagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcggctcactgtaacctctgcctcctgggttgaggcactgcctcagcctccccagtagctgggattacaggcacccaccaccatgcctggctaattgttttatatttttagtggagacttggtttcatcatgttggtcaggctgatcttgaactccagacctcaggtgatccgcccttcttggcctcccaaaagtgctgggattacaggcatgagccacggcacccagcttcgtcagccagttcttggtaccaggaacaccatgttgagtgagacacccctccccttatggaaccaatgga

SEQ ID NO: 133791 - DNA, 4395 bp, Homo sapiens
aatgtgctgtcttcagattccagtcctttttgtctataggaacagctacccagcacaaattctgtttttagaaaggggtagatgccttaccaatgagcttgttcctttgaggagtagcaaagtctgttagctggtaacagtcctcatgtggatcccgtgtccttggtgcctgcctccttctccattcctgaggcctgggctacctctcctgggcaccagggctcctcccaactctcctttagaagtgggagggatatctggatcagtgtttatgttaactatggggtctggtctcctcagctcatgtcccttgatgttctcagagtgcaggactaggtaagagaggcaggaaagcatcacccccaggacagtggtcagggatatgagttcatttgggaaacaagctaggtagcacataaatgaggtacataacattttacagaataaaagcattttctagtctgccttatcacttttgggtgagagtgcattttgcatcttttgtcatcaaattgtcttttccatatgatcttgtgccaaattcaaaacccatccttcatcttcagctaggtgcttctgggtggtcctgagaggccacccagtgctgccatgtggctctccacacagacttcctgggagctctggtaacagagaaatggtcagtaaatcattccagacgtttatttcaatgcttctttcaaatcttagacagtaatttgattggtctccagtaaccaggattaagaatcattgctttaagtgattctcaagaagtgtgacttatcaaaaatagaaattcaatgaataaatacagtttctttcttatgcttggacttcatttctatttttattgaactgtttggggttttttttcaggttttataccctgctggtgctggccacggccctctttggacaaccgcctttcaagaacgtaattgtgaatgggcttgtcctggcaaggtaggtcaactttgttgtagtgacgggtggaactttgtctccactgtttcttaagaaggagtgcgtgagagcggtcaactttgttgtagtgacaggtggagctttgtctccactgtttctcaagaaggagtgtgtgacagctaagcctgatggaggaggaggaaggggaggactttcagattgtgctactgctagtaacataatgctactagtgatattactagtaataaaatagcatttactaaacttagcactttatgaaatacttttgcttatagatcttatttaatctgtacatcagtcctttcatgtagattttgttgtcctttttttaacacacgaggaagctgtgggttctagagaccacaggtgcccaggatcaaagctagtgacagccacactgggcttgaccgaggtactctgccaccagatcccattcttcccctcatctgaaacttcctcccaatgggcattatttcccacattttgctattataaggaagtctcatttttcctttactttattacctctagtcattaagaataaaaataaacataaatgaaaattttaaaatgaaatattttaaaatagaatttgtgctgagtacccacacagaaatcctactttatatgctgtgtgaggaggaagaggatgtcacctaacattttgtgcatccttattttttgccaggccccactgtgtgcattttcacattttaactcatttaatccccagaaccatttgagatgggtcctataatccctttgtgacctttgaggaatctgagggacaggaaaaagtgacttgccaaaggacacacagcaaatgagtggtaaatgcaaattttgaacccaggcagtctgcctctgtagtatgtgtactactttttttttttttttaattgaaaattttattgagggctgggtgctatggctcatgcttgtaatcccagccatttgggaggccatggtgggcggatctcctgaggtcaggagttggagaccagcctggccaacttgataaaacccccgtctctactaaaaatacaaaattagtgggtgcagtggcacacacctgtaaccccagctacctgggaggctgaggcacaagaatcgcttgaacctgggaggcagaggttggagtgagccaagatcatgccactgcactccagcctgggtaatagagtgaggctccatctcaaaaaaaaaaagggggaaattgtattgagatcattgtagatttgcatgcaattgtgaaaaataatagagatcccttaaattctttgcccagtttcccccagtggtcacattttgcaaaactacagtatatatcacaaccaggatattgatatagcccactaatcgtattcagatttctctagttttacatatacttatttgcttatacgcatttacctgtatacggctatcgtgtgtaggatcctgtatccagcagcacagtcaggttactgaatgaattcaacatcaaaggctcccttcctgcattgccttcccctcctgccttcccactgtcatccccaatccctggcaaccactggttttttctccatctctgtaattttgtcgtttccagaatgttatataaatagaattatacagtaactaacttgggggaattggctttttttttcttttttttgagacagagtctcactctatcacccaggctggagtgtagtggcgtgatctcggctcactgcagcctccacctcctgggctcaagcgattctcccatctcagcctcccgagtagctgggaccacaggcatgaaccaccacacccagctaatattttgtatttttggtagagacagggtttcaccatgttgacaggctggtctcgagctcctgagctcaggcgatccacctgcctcggcctcccaaagtgctagtattacaggcatgagccaccgcacccagctggctttttttaaatccacataattccattgagattttagatgactgcacctaccaatagttccttcctttccatggataaatagcattctgtattatgggtatgccatggtttgtttgatcatccacctcttgaaggacatctgggttgcttctaacatttggcaattgtgaataaagctgttgtgaacaattgataataggtttttatgataatgtaagttttcatttctttgggatatattctgacacatctttcttcttcagtctaccctgaagcttcctcatggacttagtatgatattcaaaaagaagtttgcaaatattaacaaaatatcttaccattgtaccttaacactgtttgtttcttttttgagacagagtcttgctctgctgcccaggctagagtgtagtggcgcgatcttggctcacttcaatctctgcctctcaggttcaggcaattctcctgcctcagcctccccagtagtggggattacaagtgtgcgcccccacgcccagctaatttttgtatttttagtagaaacaggtttcaccattttggccaggctggtcttgaactcctgacctcaggtgatctgcctgcctcagcctcccaaagtgctgggattacaggagtgagccaccgcgcccggcctattagcactaacttctatctaagttactccttcccatttcattttgtatattcctgtttgcaaatgatttgtatccttaaaacaagatcatctgtgatattgacttacttaattggcatctcccttttgttttacaagtgatggccaaaaaatgagcaaacggaaaaagaattatccagatccagtttccatcatccagaagtatggtgctgatgccctcaggtacaaaccagtgctttgccttgtgtgtatctattgtttttttatgtaagcatctcctatactattaatcagtattcttagatttggtttatagttaggtttttagcaacatatctctgttatttggatgttatgttggtatggttgttgattttaaacccccaaaatagttttctaaataataaaggcatttttaaacctagaggtctgtttgaggaagaggacctgtgttgggtgttgttgagctgtccaagtcctccccaggctagatgctgattgcctctgccttacttcctttctaggttccctgtcttgttggtattagaattctctttcatcatttgttttaattttgtacttacagagccatgtgagatatatctatgctagaggtgataaaaaaactcatattgaaaagcttttggagaaatttgagccactgcttgaggtagctgtaatcatgaaaccacacagtgttcaagttgaaagggacctagagatcttgttcagcatccctgtgtcctaggcatgagaccagtgcccaggcctgtgactcagcaccttcacacagtacctctgttgaccaggagccattagtggggctctcccccaat

SEQ ID NO: 133792 - DNA, 1791 bp, Homo sapiens
tgtgtctttcatgagagagaagccacattagcaaatactatccttcggcccagattggtgtgttaatgtgcctttaaatcatcagtctcaggctgggtggctcacgcctgtaatcgcagcactttgggaggctgagggtggctgatagctcgagtccaagagtttgagaccagcctgggcagcatggcgaaaccctgtctttactaaaaatacaaaaaattagctgggtgaggtggtgcctgcctgtagccccaggtacttgggaggcttaggtgagaggatcacctgagcccaggaagctgaggctgcagtgagctgtgattgtgccactgcactccagcctgggcaatggtagtgagaccctatctcaaaaaaaaaggaaaaagaaaatcatcagtctctcaaagtaaacatgcatgctatataaattaactcagtatgctctgtttggctctaaggagctcctgctattgaactttgtttttgacaggtggtatgcattgggtcagtggcggaacttgaagaactgtcaggagcaaagatctcagatctccacagagagaggtcagtttctaaatgttcgattcacttcagttttacgattctcctattaagacctggtctctagcagattacagagccacacatggaagtgactagcttgctgaattactttgctgatgactcatgtcatattgcagtattgtggcctctgtccttgtgaaatgtgaggtgaatggtgcataacctttcagatggaggattcatggtgctctctgaaagcctttgagaattgctgatatttctgtttgcaaatgtgtataatatcttgtcagggttttgtgtttcctattagcaattaaactgcaagttctgttatgcttacagttaatagaaatgactacttttctgtttgttagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggtatgcctccttgttctttcatcacgtgttttattgattttattttatttagggagtattttactaagtcactgccatttatctactgggtgatggagagattgtggcaaataagacaggctacattcctgccctctcccctccaccaccaagcacggacattaaagtgccttttgagtaggactctcccactacaatagggctgtagttttacaatttcaatgatctcactggcattttggaatatatgtgttacactggatgttaaaatgataaaaaaagttatgtgttcttagcttacgtcagatcatttactcaaatgtttgagtatttgcataaaagacagtagtttgggtgctagaaatttgagggatagttggtaatgtgctcagatattgaggctagccttataaatcaacattctaaaaaaatccagatttttaaaaaatatacatatgagagaggatttgggcattgatttttatctggtgccttatgtaaaacagttccttaattggaagaaggtgaattactttctttccatggattggctttgctggcccaggctttatttacttttttttttttttttgagacagaatcttgcactctgctgcccaggctggagtgcaggggtgtgatctcggctcactgcacccttcgcctcctgggttca

SEQ ID NO: 133793 - DNA, 1104 bp, Homo sapiens
ctatggtgaggataatgtgaagactagagttgtatgggatgaggctggctaaagctaaggtgactggttagaggtatgtggcagctgtactccagttgaagaggaggacatgggaggcctgtgtgctgtggggtaatctattggatgtaggtcattgatggcagcacaaactgttgtgtgtgctatgctgtccatttagaagacattctctttgcagtgagcgccacgtttccagagtgtttggtccacaaagcgttatacaaaggctcctgtgggtattatttacatgttgaatttttccatatttttatgtgattggttatgtgatctgtttattgcagggtcccagagttggtacgagaaaaacgatttggaaattggctgaaagatgcacgtgactggacaatttccagaaacagatactggggcacccccatcccactgtgggtcagcgatgactttgaggaggtgaggcatggcagtatttccttgtgttgatttttgctaaagcattttgttcatgaaatctgaatgtggtttaaaagaatagggtgtttttttctttgcccctttcttatttcatcttttttcctctttattcctttctagaatcatgacataagataatctgtttctggggtttttaactttttttccttgaattaaatacaatttataaaactttcctctgtaaaaataaaaggatacagttttctcagggaaatacacactttaaatgttttttttgtgtgtttccccgatgtcttttcttccccctacattaaggtatactattagcttatggttaaactgactttatagatgatgaaaaaagaaaacttgaaaagaaatttaccaaagcattacagacctttaacttctaaaatcaaatgaataagaggatgtgtgtagatatatagatgtatgtggatatactatgtcctcacttaatgtcatacagaggttcttgataactgactttaggccgggtgtgatggctcccacatgtaatcgcagcacttagggaggccaaggcaggaggatcgcttgagaccagatatttgagaccagcctaggcaacataatgaggttccatctctacaa

SEQ ID NO: 133794 - DNA, 1433 bp, Homo sapiens
tggtctcaaactactgggctcaaataatcctcccaccttgtcctcccaaagtgctgagattacaggcatgagccacagcgcctggtctaggagagttttatgaatggctaaaaatgttgctttcctaaggaactgtgagagaaaaatagacctgtacaaatctgttttgtattgtggccacattttttttaggatgagaagcatctctaaaattttgtaatagagtttattgaaaaatttaatatgattttaacctttaatataagaccatgctgtaaaagtatgggtgaaaatgaaatgttcagttgcatcgtgtttggtttccacattgcctcttctgtgttgaagttgaagttgacattgtttcttagataattgtcactagcagaactatttttttctactcttgttcttgtattagtttttgcctttcttactattgtggaaagatatgaccaattttgaagtcttagatgtttttatctataataaaaatgaatattagcagaaggccaagtaagtgatgatgctgtcaataagacatgaaaagtcagtcttaccgtagtgcctactagtctcagcctgagcagctatgtgtgtgtttctgcttccccagatcagacactcctctaatttacaaagcagtgcccagctggtttgtgcgagtggagaacatggtggaccagctcctaaggaacaatgacctgtgctactggtgagcagtaagatgtgtttcttcatagtgtcttttgtcatgtggttagtaagtatggtttacacttcccccaagttataattttaataacccatcttttattgggtattgtaatagctatcttttcttctgtgtgtttaggagcacaaaataattcaaataatgttacagaacagaagtaacatccttcttgtgataaagtatgtaagggagtatttttctttttaaactcattggaaatgataaaccaccatttattcgatttagggaatgaaatgaccttggaaaaatatggctgtactgccagagtttgctagccttcaataatagtcattttcagagtaaacattattttcagatatacctgcaaaagccatttgtacttactcttgttggtcctgcagtggatgatgtaccctgtgcttggctgtatggataagctccaagcacagaagcctttgctttccatagctgatatgtgtcctgcaggtgatagcccaagaagtatcatttcagcctctgggtacaaaatgaaacaaggcttgaacctgtgtatttcagatgaatgtttttcactacaagtttgaaaagtaatcaccactcttaacttctcacaaggacccaactagactctagaaaactgtatctgagtttaggagaatggggagaatctcagggcagcaaaggaaatagttataaactgtagctttctaatatt

SEQ ID NO: 133795 - DNA, 1250 bp, Homo sapiens
ttttcctgtctacccacatgacaccacaccagtcagcctcagcacagggagaggtgaacacagatccaggtggaagcatgtcagctttccagcttgtcttggagtcaacccagagtgtggtttcaccaacataaggcaatctctttaattttatatttaggcatcataacacagtgatgaagactatagactctggagccaggctgtttggttttgaatcctagcattgctgcttcatagctgagttacttcttggtacctcgactttcctatctgtaaaataggaaatttttggtttttcagatgtgtgtgctgctgttataaatcaaatttgatttagttttaaaacattcctgtgtggctgctctgcttatggagtagccattctttattgctttactttcttaattcctttcacttaaaaaattgatgtatgtcatctatcttctcatttagtggatactctgctacatatggaggtctgggaaataatatttgagaagactagactgggtgacctaacccctgtccaactgtgagggtctgattctccgaatggtcttgagttaccttcagtttacaggacaaagttgatgaaatgtatatgttacaatatagaacaattatcttgggaatctattacctcatgctcacacccatacatagactgttttattcttccctctcttttgccttttctcaggaggactatcgggtctgtatggactttaacattattcggaaagactcactccctgtttgccctgtggatgcttcaggctgcttcacaacggaggtgacagatttcgcaggacagtatgtgaaggtctgtaatccatatagcatagaagggtgactgttacttctgattagtctctaccatcatttataattgtattgtaattcttctaggaagttgtttttatttggttttgtcatcgcatgaaatccgtaaagacagatgttatcagttacgttcagagggtctcatatctttagaggatgcatgctgaaatttcatggggaaagatcagaaaaactccagttcatgcctcatgaagcacctttgtgaccttggggttgtcatttcagatcgaaaaactttatgaccttaaatgttgtggaatgtacttgaaaattacttaaagttagtgactaaaaataataaataatatttgttatttgtgccttttattcataacaaggtatcagattctagtaatatattgttcctaagtattatagtatgt

SEQ ID NO: 133796 - DNA, 1098 bp, Homo sapiens
taaggtggtggagtacctgtaagtagaacttactactcgtggctcccacctgttcctttcaagatttgcctttatgactgaataacttgagctgagttgaaaggagaaagagaagcaaaacatatgcagtgattgaaaatgtaccaggaagtgaacaatttagggagcatgctttctgagactgtatcctaaactgcatagggacaaaaagttgggggagggagaactaatgaaaaacacgtttgtaaccaaggaaattagaaatttttatctgccattctccagataattatttcgtttataagtggtaactttttatttatgggaaaaatgtattgaattagcatgtttcttcccagcctgcattattctttcttttctatttctgaaaataattttaccggttaaaagcattttcaggttcttaggaaaaactgttacaaagttaacgttgtaacacagtaatgtttcatccctgaagcctgctgtcctttctttccagtgtaaagagaatggcgctttcactgtgcttgttgacaactatgtgaaggaagaagaaggcacaggggttgtccaccaagctccttacttcggtgctgtgagtagcataagtctggcaaatgtatttgagtatgtcggtagccacttttcatagatgcggagtcctgtgtctcatcatgttgggttaccaggttggcctcttttctggctcactgcctgcaagatggcttgtaaaatttgcatctgcaattccctttcatcctaagctgatttctggaaagagtgggccaaatccagtaaactctttttggtgtgcagttccgtgagttttgacaggcatctagagacgtgcaggtgcctcagccaccaagatacagaccattcccatcacctctgctgtgttcttaattaaatgttcagaagggggaatctgacctctcccctcaaaacagtactctacagttaattttatattttgactagaataatttttctaaaaacacattcctttttatgtaatttgtgtatgaataaaaacagaataacataaaggcacatgctttacagtaaaccacctctcaccttaaatcatggcac

SEQ ID NO: 133797 - DNA, 1100 bp, Homo sapiens
tgcttgatgcatgtctttggaatcagccaagttcagaatataacccaagtccatgtttttcctttttctcgtagatgttgccagaggacgattactcattttaatggaagccagattgtcagccctctataaattggagagtgactatgagatccttgaaaggtgaatattcaaatagttgctctgtgtttgtgtgcatgtgtctgtatgtgtgtctttagttttaaaaagaaataaactttgttatccaaaagcttgcattattcaaatttagttttaagtactaatactatactaagtactttgcagtcacacattacagcatgaatggctagggctaagaagccagtaaaccagaggggagtggtagcttgatgtggctgcagcctcatatttgattttaatctaattgtgagtttgcctttctccttttctagatttcctggtgcctatcttaaaggcaagaagtacaggcccctgtttgactatttcctgaaggtaagcttagggaccgctactgtgggcgctctccacaatctgattatttgatagctggggtgttgtgagaagtggaattgacattacttttatgagtgtacctgaatccagaaagtctgctttagtaccaacaaaattaaattgtttgtgtagctttcttgtcttagaggatttttttttttttttttaaaaacagggtttcctctgtcccccaggctggagtgcagtggcacaatcacagctcactgcaacctcgacctcttgggctcaagtgattcccctgccccatcccgagtagctgggactactggcacacagcaccacaccgggctaagtttttagttttttgtagagacagaatctcgctatgctgcccaggctggtcttgaactcctggaattgcaagcatgagccactgcacctggctgggattttttgttgttgttgtttttgagatggagtgcaaatatcgtgcaatagcgcgatcttggctgactgcaacctctgccccccaggttcaagcaattctcctgcctcagcctcccgagcagctgggattacaggcatgctgtaatttttgtactttttagtagagatggggt

SEQ ID NO: 133798 - DNA, 1516 bp, Homo sapiens
aatacaaaaattagccacgtgtggtgacacgcacctataatcccagctactcgggaggctgaggcacaagaatcacttgaacccaggaggcaggggctgcagtgagccaagattgtaccacagcactccagcctagtgacacagtgagactccatctaaaaaaaaaaaaaaaaaagtcaccaggtgtcaaaagacattatttttgagactactaaggtgatgattaaaacattttttaaagtatttaaaaatttttttacttggaatttcttgctattttctgtttgtaagtctggtaagtggtttcttcggtttaccctgaagatttattttattcctctttaggagtagttcctttttcttaggtgtctgttattgtggatttctaaaacaatactttacctcaatttatttcaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaaggtaagtgggaggctggttacttatgattaatatggataagataattttatattttggaaaatatgaaagcttacctttctttttgcatgaagaatagaattatttgaaaacaatctgacttaattagaaaaataactttaaacatttgttttcatttctaattgaaaactaacaaaacaattaaaatagtacagagatataaaaagtagaacataaaattttcttataatttccagtttatagtacatttttccacaccatgcccctgtgacagatgaagaatctaagattcagcgatgtggcatcacgtcgttactagcaattgataccagaacttgagaactttttgcctttcaaatgtcccctggtagagagttaccagtctcaacgagggcctttccgagatttaaaaagaagattggtactttgtgaacaaatataccttcaggtttggtagttttgtggcggtaaaagaaaaagagaaaaactcattgccatgaaaaaagctatggcacagctgctgtggaaggcagtgacatttcttcaaaaagctgaatgagatgacactatggcccagcaatttcacttctgagtgttttccccaaagaattgaaagcagtcttgaacagttacttgtacacccgtgttcataggagcattattcacagtagtcaaaagatagaagcaacccaagtgtctatcattggataaatgaataaaccaaatagggtatttacgtacagtggaatattattcagcctaaaaaagaaaggaaattctgatacaggctatgccttgaatgaacctggaggacattatgctaattaaaatgagccagtcaccaaaagacagatactacatgattctatttatatgaggtatcgagaagtgaacttcagagagcaaagactagtagaatggtggttgacagaggctgggagggaaggggga

SEQ ID NO: 133799 - DNA, 1785 bp, Homo sapiens
caatgcattatatcaggtggcatgtgttgcggctatgtcacattgatggtgataactttgttcacttggttaaagtgctgtcagctttctgctttgtaaagttgtagtttttcctttgtaattaataagtatcttgtggggagattctttccaaatattcttttttttgtcatacattcacttattaattttaacatccatggatggtttttgccagtaataattatgcctgtgatatttgccaagtggtggttttggtagacttttataagtgaatatttatacttgtaaataacattttgtgcatgtaggatgaatgccgagaaaactggttcttaaccttacataatatgttgttggcagtatagatttacttgtaccattgattattctgttttcccaaaattttcatttgtgatgacaacagaaataaacacacattgatgtacaattataaatatcattgtctaatactgttctaatattaatattttaaagtctactgttagcagacttggccgatggattgactttgacaatgactataaaactctgtatccacaattcatggaatcagtctggtaggtttatttaaaattgtaaatatggtaaatattctattctgttgtattgataattggaaaaatgcactagcatgaatcagtttatttttgagtccatcgttatttctctgaaaatctttgggaacaggtttgtttttgaatgtagaacttttatttttatttttttgagactgagtctcgctcagttgcccaggctggagggcagtggcacagtcttggcccactgcaacctccgcctctcaggttcaagcgattctcttgcttcagcctcccaagtagctgggattacaggcgcccgccaccatgcttggctaatttttgtctttttagtagagatggggtttcaccttgttggccagggtggtctcgaacttctgacctaggtgatccatccaccttgatctctcaaagtgctacgattacagacgtgagccactgcgcccagcctgccagttgcttttcttaacattatgtgttaaatatcattcgatatcagtagatattagcattttaatgtctgcctgatgtcttactatattgatctgttataatttaccagccagtctcccaatgaaagacattgttttttcacttatttggcagacagaaactctaaaaagaaaatggcataaatgtttgcattttcagaaatagaattttgttctgtaattgtgaaactccatctcttaccaggtgggtcttcaaacaactctatgataaaggccttgtttatagaggtgtgaaagtcatgcccttctctacggcatgtaacactccactttccaacttcgagtcacaccagaattataaggtacgtgaaatgtagagacattattcagcattgagttttgtaggtggaagctgagtagttatgatcacagtaggtattcccaagtagacccagtgtggaatgttgcccacgacatccaccactttgaccacttcttactgagtgctggaaatattgccagttagtatactaaggctctgttaagatgagggattttttttccacattggatttatgatgtgtcttaatgtgataggttttgcttgttttgaccatatttttgtgcctctctgttgggttaacaagtccagctttgacatacttcctgtagtcatcgtttcttaagggttgagtaattttatgccttatctgggacctcatgatatcatttatttgttaacggtatttgga

SEQ ID NO: 133800 - DNA, 1431 bp, Homo sapiens
caccctcgtttaggcacttatacctaagtaccccatagaaggctactatagtactacctgcctttagtcctcattcacctaaaagactagtcctttaatcagtgttttcattatatgtctcctctggtcaaaaactatgagataggggtttattgccctattttactgatgagataactcaagatcaggataaataatttgccttatgtcatggaactaataaatgaaaaatggataatcaaatggaggtctctgtagctctaccacaattgtagcctttctgaaggcaggaccaccagtaaatatcaaatcaattatgtctgtcggtttcctgatcttgctgcttttctccttgaagactccactatgacaagagctatctatagaaaaatgccttaaattttggctgtttttaaatggcttgatatatttttattacctgttagatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggtatgtttgagtatccagctttataattttctgattttttttataagcattagattttgtcatataatatgttcaagtatgatgaacgttgactgtcagaccttctagttcatttctataatatttgtagtttgatttgttttgttttctagagttgcatagttgcagttgttttcatagggcagcgtggtaacagtcttatcacaaattttcaggaatatgaaattgataagacactgggaatcagaggaccagaggatgtggccaaaatggggattacagagtataacaatcagtgccgagcaattgtgatgagatattctgctgagtggaaggtatgttgggtttttttcagtagaatgaacagcaaatgtagttactaaatgggcattgaaatggtttatggtcccttgtgctttttttattaatttattttttgtagaaaaagtgttagcttccaccttcaaccctattacttaaacggttagcttaaactgaaccatctctcttctgacttctgtgtgcttaattggtctaactttcttgcatgatcaccaatagggaaaaattctaataagtataacatgatatataggccttttctttttttctcaaatacttttttcaatttttttaacttttcattttgaaataatttgacttattaaacaattgaaaaagtagtatgatgggttcccctatatccttcatccatctttcccagctgctaacatcttcggtaaccataatattaatagaattttcaaaagcagttgccccattaatttttatttctgaccaatcacatattgcatttggttgtcatgt

SEQ ID NO: 133801 - DNA, 1482 bp, Homo sapiens
tgacaaattgggcatcattaaaatgaaaaatctttgtgcttcaaaaaatgccatcaagaaaataaaaagacggcccacagaacaggagaaattttttataaatcatatatctgataaaggatttgtatccaggatgtatacataacccttaaaacccaaccacaaaaagagcccaattagaaaataggcaaaggataaatatctatccaacgtggatacgcaaatggccaataagcatgtggaaagatgctcagcatcattagtccttagggaaatgcaaatcaaaaccacaagatactacttaacatctcctagaatgactgtaattcaaagatggacaataagatgtgttgggtaagatctgaagaaattagaatcctcattcactgctgagggaatgtaaaatagtacagtcactttggaaaaattttggcattttctcaaaaagttaaatacagaattatcatgtgacccagaaattctacttctagctacaaacccaagagaaatgaaaacatagatccacacaaaattttgtatgtgaatgttcatagcagcgttattcgtaataaccaaaaagtggaaacaatacaggtatccaagaaatgatgaatggataaacaaaatgtggcatattcatgaaatggaatactattcagctatcaaaagtaatgaagtatgaatacatattacatcatggatgagccttgaaaacatgctagagaaaggaaaccagatgcaataggccacatatagatgattcctataaattttcccatttatatgaaatgtccagaataggtaaatctgcagggacagaaagaagataaatcgttgccactggctatggagaagaaagaatggggagtgactgctaatggttttggggtgttttggtggggaggggaggttgaaaacgttttgaaattaggtattactagttatactaccttgtaaatatactaaaaagccactgaattgtacactttttacattacactatgtaaattgtacatcaataaagctgtaattttttaaaagtatggatagtgtcatgtacacccatgttaataatatggtactctgttattcctagatttctcttttgacagtaataaatttgatttcttttgcagcaacaaaatgcttcaacaagttccagaaaacataaattttcctgctgaagaagagaaaatcttggagttttggactgaatttaattgttttcaggaatgcttaaagcaatcaaaacataaaccaaagtatgtgaattttttaggttaagttcccttaagaatagtcatttcttagactgaattccattaaagcagatactttttttttttttttttttttgagatggagtctcgcactgtcatccaggctggagggcagtggtgcaatctctgctcactgctacctctgcctcccggatgcaagtgattctcctgcctcagcctcccgagtagctgggattacagg

SEQ ID NO: 133802 - DNA, 2261 bp, Homo sapiens
aaggagaaacagaaatggatttagaggagaatgaaaagggggaacagaaataggcttataggtaggatccacatgacttgatgattaattggttgtgtgtatcttctgagtagtgtcaggggtgactcaaaaatgtcatgcctaagtaatgggaagaatattggaaccactaatacagtagtttaaaagggaagcaattctggaaggaattatgaaattttaaacaaaacatggttttagtgtgcgtttctaaaatatattgaggcaaaataatatgaagtaatgtgaataatatgtagttaatatcagggagggtggtctcgaaattgctgaacgggaagttgaggttaaggtgacctgaaggagttgtggagcagcgaagagtcaagggcctggattataataagagggaagcaaaggggatggcatccctctgcacaacaaggttgttgtgcaaggttaacctgctctgtccctgccctgtggttgctggatgctgttgtgcatggacagctctccagtggattcgatgggccatagcaatcctgtgatttatgcatggaggctgcttctcctcagcagctgccatagcccggtcgctggtacatgattcttcctgaatagtcaatgctgttatactgagtgtttatgcttgacgtaataatgcagtgattcttaatctttggggaaagtagagactccctaaaaaacacagtaaaagctgaatgagctggccaggcatagtggctcatgcctgtaatcccagccctttgggagcccagggcaagaggatcgctttagcctaggagttgaagaccagccagggcaacatggcaaaaccctgtctctacaaaccaccccctccccaccaaaaaaaaaaaaaaaaaaagctgagtgtggtggtgcacacctgtagtcctagctacttggcgggctaaactgggaggaacacctgaacccagggaggtcaaggctgcagtgagccatgattgtgccactgcactccagcctaggtgacagagtgagccactgtctcaaaaaaaaaaaaaaaaaaggaatgatcctcttctcagaaagcttaaatcttattttctcaaaaataaaaattcagatagatattcctgaataattgttagaacagtgcaagagtggtgatgttcagactttgatgtgaatgctcatcccctagggatcttgttaaaatgcaggttctgactcgtaggtgcgaggtgaggctggtaagtctgcatctctaataagctcccatagatgtgggccatagtaggaccagccttgaagagattagaatgtgttggtatctaaaggtctgttagtcttcagataacaatcccataagtttcagttggcctctgataaggtacacaatgaacctaaataaatcagtaaatgcacaaacacttattttggtccttgaaaggctagaggttataataagagttgaagatctaaaatgccttaaaccttctgtttaataccttttaatggcatactgtgatcagaaatagctatttcagttagttaaacagcccaactgttcttgtcctgttttttcttaaattaaactcagaggcactcacacatctgaaaaattaatgagggtaaaagaaaatgaaagatactacttgtcacagacttttttttaaatgataacttgaatcaataacttgattagactatgatgcttttgatgctttcaaaactgtttgaggtatgtaggtgtcttttcctgtagagttgattaccctggtctgttgtggttcttgagtacttaagattttttatcttctctgttgttcccttattagcaattttatccccttctgatctgatactgacttggaaagctcgtcacccaccttgttagaattgttaagtaaatataaatagactttgagaaggaaaggtctcaagggtggctcactagatacttaagtcatagattgatcaagtatctctgcatgaggttattagcaaaacatttaaaaagacactttaagacttctctcattagggactaaaccagaaaggtatagggctcatccttcataaaaatcatgaataagcaataaaaagggtaaaatggaaaactggaatctatatttgaatgtgagattctcatctttttagctttaagattttttaagttttaccagttttcctcaaagagaagatgaagttacttcaagagaactgatttctgtcatgtgagtgtaggtaagaaaattcttaactactttgag

SEQ ID NO: 133803 - DNA, 1060 bp, Homo sapiens
agtcctggaagggaactcatgaatggtataggtgaggagactgcagactggctcaattgagtgactggtctcagaatccagccaagcctattaagtaacacgaaagcatcagatttttaaagactgaattatagttcccattataaacagttaatgccaaaaatgccaatatcccctcttcatttcaaaagagcactttcaaaataggtttccacagccctgacagtgagaataacctgttttacttctatctactgaacatcttaaaaacaatttgtttattgctaaccaagtcttttttttttcctaggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgtattttccagcctaggctttgtgtgaattataggctatttgaaattttatttctgattatgtcaaatacaccttccattttgtcatttttgtttaaactgataaattacaagtcaacattgagttttatacttgtgttttggtgaatggttaactgaaatataggacatttcagaccaacatcatataagagttctgtgaggaccaggagaggaagccaaatacagttatcttgtcattgcctctaggaattaaggaacaacatctagatgtacaccaatcccaaaattctagttagactaaaagcttatgaaaaataccaagtgcctgaaagataggtagtcacaatt

SEQ ID NO: 133804 - DNA, 1108 bp, Homo sapiens
gacttgtgaggtgattgtcctgatcttatagcagtagtttttccagcagttctagcaaaaagttttgggtattgaaaatgtaaagatatattccttttctcatttataaatagacaagagggaaacctgatttccctgtatcctattatattttaggcttctcatgcaagcacagatgccatggttattttaggtgtcatttttaaaaattatatagctcatttataaacctttattttttaaaccttttttatattactgctgtccttatcagatcattctagcaatgccaaaattatgatagtggcttctgaaaatatttgaaaaatctaaaaagatgatactacctatttttttgatactattttaaattaatgattaacatattggaactttagatatgtctacgtggtaaaagtaatcaaatgaatgtgttcagaaatacttggctgtggagttacaatcccatcatcttttgttgtcataacgatatagagacctacagagttgaaacagtgaaacctggaaagattgtctggcaggaagaccctcgtttacaagacagcagttcagaagaggaagatgttactgaagaaacagatcacagaaactccagtcctgggtaaacaatttgtttctttgcaggcatagttcataatttgtaaaatctgaattagacatactttagaaatattttagcttctcttcacatgacaactaaattgtcttagcttctttttttattttattttttttttttgagacggagtgttgctctgtcgcccaggctgtagtgcaatggcatgatctcagctcactgcaacctccgcctcccagattcaagcaattctcctgtcccagcctcccaagtagctgggattacaggcacgtgccaaccacacctggctaatttttgtatttttagtagaggcgaggtttcaccatgttggccaggctggtttcgaactcctgacctcaagtaatctgcccaccttggcctcccaaagtgctaggattacaggcgccctgccactgagcctggacatctcagtttctttagagtgttctctagcctttttataatggagagtgtgtttccttttccatg

SEQ ID NO: 133805 - DNA, 1111 bp, Homo sapiens
aagactgaaacaactatccactaatatcttatattgtcagatataccattaccatttttcactctttatcatttttagatttacgtaatttagattatgtttagaatgttaaaaaaatcaaagagtctataatcactgtagttattagtatcttgctctattacatttgtcgatctttaccttaaaagttttagacttgctactgaaagccattaaattcagactttcataattaggaacagaagtaggacttttcattgtctggtcacgcagactttctgagtttgctatgactgagggtctttggttatggaggttagtgaaatgaggttaaagtttcttcttcctgtcttaatggattttgaacatgtttaggtacttggtaaatatttgatgattgagacttctcaggctgtgttttccaagagagtattaattatcccttttcctcaaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaagtatgttttatgttccatcccattctaccatatcatcctttgccataaatgtcttcttgaactcaatttaaaactaggtctcttttaatggcctggggaggcagctggcaatatgtatcagacccttaaaaatatacttgcctttgacccagtgattcacttcaaggaactaatcttaaattatttctgtatttatacacttagatgtcatagcagcatcgctttcattagtgaaacaaatgggaaacagtttaaatagtaactgtaaaagtatttatataaacgtaactgttatggaaattttcaggcatgaaatttagagagactaatgaaagccctgtataccatcattacctgtacaccaggtaatgaaagccctgtacaccatcacctagcttttacagtcaccaacatgtgaccagtgttctcttctatacctttatccaacccctactttacacaatgaaatgttttatgcaaatcccagatagtatatcattttatctgtatgtatttt

SEQ ID NO: 133806 - DNA, 1001 bp, Homo sapiens
atttataccttgccaagtcttgccaagatttactgtaatgggcttttgttcattcttctaacaattgttaagtacacctttatagtaagtgccagatttatagtatgaggatggtgatcttgcctttcatacagtttttggctcatggtgtggcatgctgacagtcacagttcagttacacagggccaggagggggttgtgcccctgtgccttggcagcacgcaggagacacactaagtcagttgggagcttctgtagtctgagctgagtggtaggaaaagatttgtgggaattggtcaggcccaggtgaaagggtggaaagggagtggaaaggctttcattctaggaaaaaggaaccgtttatacaagggtgaatgttttcaatcagtgtaattaaaacttatacagcatgagatggcaagaaatgaggctagtggtttcattttgttcataaaatgaaaagagagtgaagaattttaagcaaaggagagaagattaattgtgtctattttggaacaggagttgacaaactacacctcaaaggccatccagcccatgacctatttatgtacagccttcaagctaaaaatagtttttgagtacagaacaaagacgatatgtggcctgcaaagcctaacatatttactctggccttttacagaaaaagtttgtcaacctctgtttgggagagatccttcagaccatgatgaaaacaaatcgaacggctccgtctgtaaccaaggagagcctttggggaggtggaaagtcaaaaccgtaacaacagcaatgggaatagattgactgaattgataccaaaaagtttaattgataggacttggtgataactggatagggatagaaagaggaattgtaagtttctgtcttaggcaaataaacagatggtgatggcattcactagataaggaaaaagggcaggaagtagacttggcaggggaagggagtgataggtttagacatgttcagtttgagattgggttgtt

SEQ ID NO: 133807 - DNA, 1788 bp, Homo sapiens
aatgacttatttgagattaagcaatattttttgtatcaaagattgatgagttttcctaaaaccaagtgctttagttttgtttcttgacttgcgtaacatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggt

SEQ ID NO: 133808 - DNA, 1068 bp, Homo sapiens
aactaggctttgtgacctgtggcaagttacttaaacttctcagcccaagtttgcttatgtgatgaatgacaaaagatagtgcttgcctcataatatttctgtgagaattaaattaaatgatacatttgcaatactttgggaggctaaggcaggtggatcacttgaggtcaggagtttgagaccagcctggccaacatggtgaaaccccatctttactaaaaataccacaattagctgggtgtggtggcagacacctgtaatcccagctacttgggaggctgagacaggagaatcaccagggaggcagaggttgcagtgagccaagatagtgccactgcactccagcctgggcgacagaaggacactctgtctcaaaaagaaaagataaatttgtacttagtacagtatctaccacctacaaaattctgttaatggtattattaaggaagctgacggcagatgctcagagaaatcaattactacggcatagtaattcaaacagttcagtcactcatagttaattcatctgcaagttctacagtgataattagtatgaggtgataaataaaattaaggtgctgtaggattccagagtgtcctctgattcacctgaaaagatgattgttttatagttacaggaaatatatgttttatagttacaggaaataacaataaaatatacattaaatatcagttattcagaggttcctgacatttgtttacaaacaaattgcaaataaattttgctttactttttacacattttgcctcattccaatctagtaacactgtgagatagggagtgtaaagactcttttggtaagttgtcaagatgaaacaagagcctaggctccctctctccaggtctcatttcttttcttccacttcccctggatctctttgtgataaacaagcctgcttttcttgatactaaataattagaaaaagcacaagctgaaatatatttttacattgccatgtacttgtaataattctttactttataggtatgtctgttttaaataaaacaaaatggaaaggtggaacattacaaattcaactagcaaa

SEQ ID NO: 133809 - DNA, 1051 bp, Homo sapiens
ggaagaaggctggggtgggtaggttgggggtggagacaattaggaagaggtaggctagctctttttatcttttagtgcgttacatcctgtttctgtcagactttgttaaagacagtaaatgaatgtatgagtgagtcaaggaaaaacatctaaaaacatgaatacataaaattaagagggatagagtgtaatattatggccatttggaggaaaaaaactctgtctgtacctgtgtctatatgggtatggggttgctgttccaaagtgcattcatgaaagatgtggatgtagggcttgggcaaaacctcgaagactaaaatttggaagtaatacaataggaagtgaaatacagatccaggagacggatttgatacagaaggttcagaggaagtagttgttttgttagattttagaagaactaagggaaagaactcttctctgtatacagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggtaatttatggtccttcactgggcagttataggcagacataactcaggttaagtgctagaaaataaaacaaccccaagataaatgttagctctgaacaccaaaagttttaagtgatgttgtggaggtataatgtgtgatgtggaacttgaccagaatttgtttctgaaataagaaaaaattccaaattctaaaacatctgatttcagaaacatattaacttccagttttgagaactagaattttctaacatggattaagtgtcccgttaagtagactatcactagcatacaatcaaaatgtttccttatctgactactggacattttcttctttttttttttggaatattttgataattatgcttatttttatagccaataaaaaacaaggtttatctttgaaataataagttttc

SEQ ID NO: 133810 - DNA, 1127 bp, Homo sapiens
gagactgaggcgggaggattgcttgaagtcaggagtttaagaccagcctaggtaataaagccagaccttgtctctatgagaaggaaaaaaaaattagctaggcacagtggcatacctgtggtcccagctactcaggaggatcctttgagcctgggagttcaaggctgcagtgcactatgattacaccactgcactccaggctgggtgacagcgtaagaccctcatctcttaaaaaggaagaaagaaaaaaaaagtggtggtgttagtaaccacactggttttgagaaaattctttttaattttttaattttttttattttaatgggggaaggtgacttaattggaagagagtaagagggacaaaatgggaatgctttgaggaaaatggggttattagatgaaacacgtgttagtaattggagtgattatttttgatatttgccttttagaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtaagcattttttttaaatctagacatagtatggaagcttaccttattatgcataagaaattggttgtcataatattgaattaaaattctacaaggtaagtatttgaaagtatggttgtggtaaacttgtttactcacatatcttttgaacatcacggtgttcaaaaagctgcctgggccaggccccgtgatcatgcctataatcccagcttttgggaggccaaggcatgcagatcacctgaggtcaggagtttgagacaagcctggccaacatggtgcaactctgtctctactgaaaatacaaaaattagccggatgtgttggtgggcacctgtaatctaagctacttgggaagctgagccaggagaatcatttgaacccgggaggtggaagttgcagtgagctgagattgtgccattgcactccaccctgggggacagagcaagactccatttaaaacaaaaaaaaaaagggctgcctgagataaatattaaag

SEQ ID NO: 133811 - DNA, 1079 bp, Homo sapiens
gagattatactgttagctcacatgctgaatgaattagagtcagttgagctgtgccagacagaaaacttaaaaataaaggtactagaagtgtatttctctattacttaagtaaacttgtaagttttcaagggctaatatggtggttttatgataatcaggttctaccatcagccaacatggcttcaagtcatggcacaatgatcacattagcatttcaggtatcaggaagaagttgggcaaagaaagcctcgcctgttcttttaaaggacactttctggaagttgtacattcatcattttcacttatattctattggccaacaagttcatgcaaaggatgctgggaatttagtctttgttatgcttggccatatggccagtgaaaaactggggcaagaaaaaagtataaatagaggggactactagcagtttctgtcctatatgctttagcggatgcagggggaaaaaaatctaaggagaggaactgtagatatcttctttgaaggacatagaacctagtaattgctgagtctctaaagagacatgagttgtcattgtttaagttttaaagtatgtatgtgttttgggactgattggttttactaacaaagtgctacagaaagagtgtgttctccctggctgtgttaagaactctcactttctctctgagccttttagattttatgattcttcttgaagaccaggactggtaaacaaggtgttggaagaaattacagagagctgtggaatcaacagggtttttggaatcagttgtgtgagaggcaccaagagttcttacttggggagggaaaaacaaaggactatctcgtttctctttattgcttacaattctgatataataacttgatgaaaagtttttgaaatgtttattacttaatggtaaattctagcatattctataccaacttgtgtatgtatgcctttagaaacatatctagtagaattgctgggtcaaaggaaacttacaaattctgattgatagtggcaaattgccttctaaaatagttttaccattttacatactgagcacatttttacatttttactgtgaagactgat

SEQ ID NO: 133812 - DNA, 1050 bp, Homo sapiens
tcaaatttatttaaaatccgcattttggaaaaacattctttcaagagtatttgaagtaaaacaacaaatgttaataaagaatatcatcacagcaggcttatcatgtagtggtatactgctaacttcctgagccagactctgtgttttcagcttctcaattgtgcatttcgagtttaaataccaaagcctgattcttgcgaagtaatgcttcctaaagcctgatatgggtactttaaagtacttccttttattccctttctttgttttcgggcataactgaaattaagtttggttgcatcgtaatacctcaggttctactcatttggatagcatcaaattattgacagcattaatccacacagcaaccagttctgaaagtcaacttaaataatatttcagggttcagattctctcaaaagcctaaccagatcatgaatattgtttttaggacttgtactaactctcctttatttggggttctattgtttcttattattatttattctatttggttgagctaataaaatctgtcaggcctaggatttttttccacaaagaaacatgggcagttctgtactatagtaccttgaggtgttctcatgattttgttatattcgatcataggtagtcttaaaatgccagaaaaattaaatatttctgcttcacaagtgttataatacagtaatgaccagggagtgtgctggcagttatggtaatagatgaatcacctaatgttgctgtttccttatgcatttgaatgggtgatggaaaatgggagcactagtctccatttccaaagctgatttgactctacgtgctttccagtcaggtatgaagtataattggtgtatttttcttatggagggtaaagagcttctaggagctggtctttgctagttataaaattactagggtggaaaaaacctatcacattgtcctgtaaccgtcaccaatatccacattgttttgtaaccatcaccactgtccttctccagaagtttttcatcatcccaaactgaaacatacccattaaacattaactcctcattc

SEQ ID NO: 133813 - DNA, 1066 bp, Homo sapiens
tctgagtgccccctcacttcaaatccttgtgtcaaattaattaggaaatactcaaatgtacacctggagacaaatacaatcaagagcagacttcacacgtactgtgctggtctacttgttatgctctggatggaatctggacttctgggaagaaagttcatgagcctagtattaatctttttgataggcagacatttagctatcacgctactacagtgatctaaccaaaatttgtatgtgaataagtgaggttcccaatgagtcacaagattttgactcataggtaattagagtcagatattgtgaaaggaactatcatacctgaagatgaattacacgtagactttctggtaaattaagaggcacggattccagggcattatggtccaagtagaggaaggtgaggttattcagtttctgtaaggaaaatttcatgtgagtgttattgaggttctgtacattctttcacaggattcaagcaatatatatgtgcatatgagtatatgtctatatatacagacttgcatattgatatgaatacatcaattatatcaattgttcgtatggtagtttcttgtttgggttttttttctgacttcacgtgtagtgtattttgatcctttatgatggccagtggagctctgccgcataccccacacttctgtccattcatctgatctctgaatatccggctctaatgccaacttctggtactctttgtgtttgtcttgataggaactaatgaggtgagtccctatgtgggattgaattttgaccctggtgctgccataacctctcctgtacctctggagtttcccatctcagttccaccaatttctagctaagtggttacttcttagaaatgtgtgtgcttgtatgtttttagtagagacgaggtttcaccatgttggctggtatggtatcgatttcctgacctcgtgatctgcccgcctcagcctcccaaagtgctgggattacaggtgtgagccaccatgcccggcctaaaaaaatacaaaaaattagacaggcgtggtggtgggcgcctgtagtcccagctactcgggag

SEQ ID NO: 133814 - DNA, 1051 bp, Homo sapiens
tctgatgtaactttaaaatgtcccttaaagttgaataaagataccttaattgtaatgaaaaatgaaaaaatggactatttgtacactttctaacagattgtacattttttgacagaatttacctgtgtgtgattatcataaactttatgataatgaatatttgatagtttctgaagttacctttagaagcaagaaaccttgccttttgaatgagattatgtctgttaccagcaatggcatggtcatcattttatctggggaatgattacatcagagctatggaaatcctggactaaagtgattactcctgtaggtcatgcattttgagacaaattgtctacctaaaccgaagtagattactttccctttttcctacataatatttgcttgaattgttaagaaatgtatttaattcttactacatataaaattttatattacatgctctcatgaaattcaaaggaaaatctccctatagaatttcacagtctaatatctttaaatattaaaagttaaattcagtatttacttttggatctttatttttttctggtgtttataatttgctaacattgtaaggaaaaagaaacacaggaaatatcccattttgagctttcgtagactgtaagtgtcatgagagggccaaccatgtctgtctaaataaatatttgctgtatgaacaagtgaaaaaatgagaaacaaaatagtcccatgaaataaaataaaggttatgtattttaactgagatatgggtataagctaggctgaatgagcctaataggatggttatttattatgtaaataatgtcttcatttattaaatcaaaatagtttttaagtgtaatcaaaatacaattctagaccaaagtttctcttttatctatcatatcatcactcatactatgcttagttttactataaaatacttactttgaatgcatttgctttgattcccctactcttgattttgttgtattttgcattaaataaagtgagcttgggaggaagaactggaagttttagtagttgattttcagcaagtgaaagttct

SEQ ID NO: 133815 - DNA, 1787 bp, Homo sapiens
attaagtaggacttgtaatttgttatttcatgacaagttttctattttaattgaaatgtatgtgtaattattgatgtatatgtgtgtttctgttctgtaagtttcttaaaggcaataattatatttaccgtatactgaggctgcacattgtattttgcaaataatccgtgtttaagtatttctcgaatagattttatatggatggaaaccacactttgtggaggctaagcttgcctaagctttggttgttctcacaagttcttgctccacatttctcactcataatgtgggatggcaaatggtgtgcactcccagtttgagtttatcattggaaataaaattccactgtttgtatttactgtatcttgagtcagtttttgattaccacaaggaataaagtccattatagctatttttaaaagatccatttgaaaaatatttagatgatacttaccatcattttctttcttgggaggtaatggtgttattgcctcatctttttgtaattgaagacttttctcattgggtattatcacagtttctttttcctattggaaaaataaaagtttgttacctagcttcattaagtctgtgtttctctgtaaaatgaagggatcacagacaccttctcgtagttacaattagtggcatttcctttgtgctccattaggctttcatacatatttccattttatcatctattaaattacaataagtattttttagcttgtttttattctagactatgagctccttgagtaaaagaactgggtgtttttatttttatatcgccagtagctacactcagtgcttaataaatgttgaacatcctgaaattccaaatgaaagctaggtgagaattccctgaattggaatgaaagtttttctgaggtgaaactgttcctcaggggtcttgtctgaactgagtttctcattcagattctaccattttgagtaagactagagctccagccatgtcacaagtataaactaccaattaaggtctttaggtctcttcttggggtgaccctttaattacctatatccctccattaagccctggctcttggatcccttttattccagcttaccttacctaccctgcttgggccactggggtaggccattaattctggggaaattggagtagatacaatttagatcctgtctttcctgttcttggagagtacgttttctgccattagattacagtgtattatgtggtgtcctattctttctgtcctttgtaagcatgttccattttagtctcggtcttgactcctgactctgcccttcaccttcattctcccatctgtgtggtggttgaacttcctccctctactctgtgtttgcacatcaagtcctgttgaattctactccactccacaaatatcttagaccctgcatttatattaagatagagaaacttctaaagccctgtaaagagaagaagcagagagaaaaataatctctaaactctttagggatcagggaatcttaatagattcaaatcatccaagtgagccaatagcctatgttatgatgggacttttttttctttaacttgaagctataattagtaatacctatcctttgtgtcttagtgatgggcaaaaataatgctatcatattaaaagcattaactgaaagaaagaaactgtggtgttaacatttgctcattgtgtacccctgcaaaaaagaaaagagaaagtagcaattataactggtcaatcttataagtctttatcctccaatttatagtggagaagaacttctgaaacaatcag

SEQ ID NO: 133816 - DNA, 3013 bp, Homo sapiens
cacgcccagctaatttttatgttgtcagtagagacagggtttcaccatgttagccaggatggtctcgatctcttgatctcgtgatttgcccgcctcggcctcccaaagtactgggattacaggtgtgagccattgcacccagctgagttctagttttgattcttcatgaaccttcccctgaccttggcaagttctttaacgttttgggccacagtttttttatcgattgaacttttatcgattgaatcgggttactacagagttcctcagcctctgcactactgacattttggacctgataattctctgttgtgggggctgtcctgtgtgcactttaggatgtttagcagcacctctgccttctacccactagatgctagtagttgcaccccacccccacccctactttgtgatgaccaaaaatgtctccagacattgccagctgtccactgatgggtgggggttggggaagcaaaatcattcgtattgataactgctgagttactagatacacatagaccctttttaatccagcattctggattttgtggaaagtctgtggtttggatctccgtcttaaatctcatacttatgcttgaagcctaattgtttgttcaaacaagaaatatgagaacccatgtattttacttcccagactaaagggtaaaatttatatggagagaattatgactcaatgtaaggaagagctcatggtaaaattgtattttatttgttaatttagtttttctcagtagtacataaatctctgtatagtgaattcataacctaaacaagtaaagtgatgcaagatgtgtccatgatgttatgatatttacacctaggcagatttataacttggaatagttatatcaatttaggaaattggaacatataagaaacttcagatgtgtagccattatgatttaattttgtttccagctgctcttatgctttatttccaagatgtagaagaaatggatttagaatcaggaaaccagggttttaggtctagccatccttggggacatatgaattcttaaaacagaaaaattatgtagaacagacaaggtttatttcttctattttcttttttacatcatggagctgattaagtgtgttatataatatgcatacatctgtattttactttagtgctcccaagcttgagaaatcgagtgaaaatgtgtagtgtttcaggtaattcttaaacactggctaaacattctcaaccagtattattgtgaacaaatttatgaagtatccttcttaaaatttcctttctaaaagttaaatgtgtgttcgttatgcatttatatttgttaattaaatgggtttatggtgcaacttggacttatttgttaatagttacagtttaacctattagctaacataactaaatacttggtagtataatgagaaaaataataaatgaattttcacatttttatttcctgctataaatatcaaattaactggtttagtctgtagctccgataggtaactgtgcagtcttgatgtactatttgaagaaaatactttattcttcatcgtctcccagggaatgcattgaggtttttctttgttttgttttgttttttgtttgtttgcttgttttgagacggagtcttgctcagtcacccaggctggagctcagtggttcaatctcggctcactgcaacctctgcctcctgggttcaagcaactctcctgcttcagcctcccaagtagctgggacttcaggtgcgtaccaccgcgcctggctaattttttgtgtttttagtagagacagggtttcaccatgttagccagggtggtctcaatctcctgacctcatgatctacccacctcggcctcctgaagtgctgggattacaggcgtgagccaccgtgcccagcctcattgttttgtttttaatgagaagtacttaagcaggtttgagttaaggcattttcaagtaccaaaaaatgattgttaatctgtctcctccttgggccctgagctagaggacgtgggatgcatttacttatatgcacttttagagggaggagccagagcagagttgaactgttcttgctaataaacaggaggaggttgaccacactctggggcagggaagccagcaactgagtgccttgtgagggggtggagggaaccctgccatcctcaccctggtgggccatccagatggtgctttgaaaagctgcagtgtccaatagtggttgtgaacttgtgagatatatgatttaagcaccctaatgaaacccttagtagtctctcttgtccactatcttttgtatgagtaaaatgttggaaggaacccaaagagatgcttactctgttttgtgtgccaggaaaaacagtgtgagcacccaggagtgtgcagcatctggatctgtgggctgctgggccagatgtgctacagtgagccttactgtttacttgatacctccaactcatgtgcactttatgtgctttattataccaattatttatctttatccttatgacaaccatatggaaaccatcttttttaaaaaacaaagaaagagacacttaaactaaataactcactcaaagtcacctagcttaaaagtgtcatgtcaggctttatacccacatagctcttatatcagattcctttttttttccttttgagacagagtctcgctctgtctcccaggctggagtgcagtggtgcaatctcggctcactgcaagctctgcctccccagttcacacctctcctgcctcagcctcctgagtatctgggactacaggcgcctgccaccacgcccagctacttttttgtatttttagtagagacggggtttcactgtgttagccaggatggtctcagtctcctgacctcgtgatctgccctcctcggcctcccaaagtgctgggattacagatgtgagacaccacacccagccagattccttgttttgaattgctaaatttgtttttgttttttgaaacaggatctcactctgacacccaggctggtgtgcagt

SEQ ID NO: 133817 - DNA, 3490 bp, Homo sapiens
ttgttgttttggtattctgaggcaaaaagattagttaattttgtgaatctgtatgccttgggtccttagtacctggatggcctcttacaaatcaaaaatatcattctatgtgctatgtggtgagctagggggatggatgtcataatggtgagatcacaaataccagtgtgaaagctttcctgaagaagaggtcagagaaaatggtctattccttaaatgaatgcttgttacattaatataccttcctgtcatttaaatattgtcctcagagtgatcaaaaaggtcatggcctgtgggtctttactgctaatgctacttccttcctcatttttagaaaaattactgttaatagaaatgatacactcactttctttaacatgatatttctatatttaaaaagagcataagaaaccattaacgtttaatttatgattcccacttgtcattctaatttatatttttaaagatttacattattttgagtaagttctaatcctatgaaatgatgcagatgtcaccaacaacttaaattcaattctgatcttatactaatacataattctaaatatattactttgagtaatacatgtttacttagatttactatattaagtataggttttgtgaagtcgtaagtgtatacctatatagtttcttgctattcttgattttcataataatgaaggtcaaagtgcccttctgctccttcttgttctgggctctcatgagcattgtcaggatcatcgtgatcttcactttcatcatcatcatctggaaatctcctgaaaacttgtgtctttagttgtattgtttgaccattagtgcttcgttgttcaccataataaatagtgtgtatatgagggaagcagaagaagatgtatgagcttattggttcttttagtttattttggtccacacgaatgtatgttaaatggtggtaatgtagtgggtcaatagaaggacacatcactgtaagattcatctctgaaagaaataaattaaaaattaatcttgtattatagtataatccatagttatagccataattctatgttagattttatattgtatgggatataattctgttaattaaaatatttataaattgaattaggtttcctttttatattaatcaaataataaaaagaaaattaaattatgagttttatattaacaaaatatatatggcttcattggcttttctgattaataaattcctagtagaacaatctcaaaaaaaaattatctacaatcccactacttaggatactcatatttcttcatgtactctattatttctctcttttatatatatacatatataaaactgacaatttatacatatatataaaaaaatatatatatataaaattatatatttcttctttttttctttttttttttcctgttgcaaggagaaaaggaaacattgtggagaaagtgagtaaactcagaatacgctctgtataaattgtcagttatatatatatgtataaattatcagttatatatataaaagagaatatatattttttatatataaataaatatattatatatgtgtgtatatatatatatttatttatttatttatttatttatttattttattttttttttttttaagacagagttttgctctgtcatccaggccagaaagcagtggcatgatctcagctcactgcaacctccgattcctgggttcaagcaactctcatgcctcggcctcttaagtagctgggagtacaggcacatgccaccatgcctggctaatttttctatttttggtagagatgggacttcactatattgaccaggctgatctcgaactcctggcctcaagtgatccaccccacccgccttagcctcccaaagtgctctgattacaggcatgagccaccacgcccagcctatttctcaatatttaaggcaataaaatttaataaaaaggactataaactgaatagcacacatttctctggggcagatttctgccattcccttaagcaacttcaaaacaactattttcagcaatgtctaaagcatagcttattgaatatttttttctttaaaagatcaggattccattctttctctcttcaaaacacaataaaagtctacatactttctatttcattattttgtaggtataggtgttccaaatttcttggaatatagaatgcttgcttcaatttgttgtgtccaacactgagttctacaatgttgggaagattaaaaatattatatgggatgtcttgtagtttgttgtgtgacattcttagagtatgaagttttggaagtttgtcgaagtatttttcgggtatagaagaaattgaattattttctaaagacagatacataagtgaagaaggcaaaccaggaggcattgattctaatctgttactgcagaggttgagctgcattagtttttccattttggcaaagattttgtcttttagcagagaatcatgaagataattataacagagatcaagcatggtcaagtttactagcccatccatagcatttgtctgcagtttggagatttcattgtaaccaagaaggagtctttccagagatttaggaagaggaaatggaaattcttctaaattattatgctctagatgaagttgtagtagatttggaagcttagcaaacacaccataatcaatcttttgagatttaattttgttgtggctgaggttaatttctttaagatgagttgcattgatgaatgaatttgcagtcacagcctcaatttcattgaactgaaggtagagttgctgaatgtgcatcggaatatttgggatagtcttgagtttgcgattatcacagtacattgatgatggaaagttagttggacagaagcattcactgacacagcctaaagtatactgatgaaaaggaactccgtagtctacattttgacgaaatgggaatcctgtttggtaatcatcatctggctcttggtcatagtcttcatcccactgataagtttcatattggcaatgtactttgactccaaaaaagaagaaaataacatatattggacttaaaaaacccatcttctttttttttttcctattgcaaggagaaaaggaaacattgtggagaaagtgagtaaactcagaatacgctttgtataaattctcagttatatgaaatgtattatacctatgtctatatataaaagaatatccagaaagaatgggcagtgctcaaaccaaaatttttttctttttttgtgacagtgtctcctctgtcacccaggctggagtgcagtggcacaatctcggctcactgcaacttctgcctcccaggctcccaggttcaagcaattctcatgcctcagcctcccaagtagctgggactacaggtgcatgccactatgcccagcttatttttgtattttttagtagagacaaggtttcgttgtgttgcccaagctggtctcaaactcctgacctcaagggatcctctggcctcggcc

SEQ ID NO: 133818 - DNA, 1107 bp, Homo sapiens
ctacaggcgcgtgccaccacgcttggctaatttttgtattgttagtagagacggggtttctccatcttggccaggctggtctctaactcctgacctcaggtgatccacccacctcagcctctcaaagtgctgggattacaggcgtgagccactgcgcctggccgagattttttttttttttaagtcacatattacactgaacttgagtcaaaagtctggtatactagactttctactaagtaaccatcttttaagagtcccagtttctcttgcttactagggtatagatctatgataatagcatgacatcagtcaactacagtctgatccctccactgtaaatgctgtgtgttctttggaattacctgatcctttaatgatggtcactgcctgggggaggaaagacctttattttagttagagagcttttgcctgggagattctacaacttctatttgctgatacctttttctgcccttcagaagaacgtgaaatgctcccttttgtgtgataacttcagatatttagaaatagtattcatgtttccttttaatattttctgtccaaaactaacagcaccatcaaattttcctcatgaaacagtttccagaatccaattatttagtctccgactctgcttgaataactactttaaatcctaaagacatacagtgtttacattctacaaagttcaagtgtctttacatttttcttcctagcttccttttttccattaatatatttaagttttagatacaaaaatattattaaaaacacactgtccttgtctcccaggtgtttaaagtcttgtggagaatcaaatacacgtgcagtagaatgcaggaggaggatattgtgtggaaaagaattgcaaaagggcacacttcacaatgaacactcagtgctgaaacttgaagttctagggaagggtcaattatgtcccagatgagaagcctgaaacctatatttcatttctgtcacttaacatatctgcctcttgcctcatcaataaaataagaattgcaattatagctgaattataccttggctgcttatcttgtatgttgccttgtgtctttttttttttttttttttgagatggagtct

SEQ ID NO: 133819 - DNA, 1453 bp, Homo sapiens
tgcacgttgaaaactgctatccagatgaaatgaatgtatcatttaggaaaaaggttttaaaaaatcctacctcttttattctgagacctttctacttttcccacccagggtttcatgagagaatgagtttccaaacaaatcattgcatataatgaaatgacttatctcctgttcatgtagaatggttctagctatttttcatcattggtataattgagagaatagttacttaagttattttctttgacagaaccccatttgagaaaggttaagaaacatctcaatttcttcttcttttcttgtcagaaattataaatgtaactattgtgtgtatttggaatttgaagtagttattcaggtagagtcagagacccttgagctctcttcctgcagtgatactttccttcattcttcctcaccatttgctcccatgcacccgcatcctgggttttgtcttttctattactggaacccttcatactcttcattttgagtattccgcactcagaccactatctctatgtagtaactccagctgcaataattctccaatttccgtggaacctcagctatattgattctactgtttttcactgtccctcatccatacctcccaacattgtcagttccttcttaccaacttagaccccatagttgatcactatcgttgctcttttgcacatgccctaaactttctggctccttcaatctgccaaactccaactctggttactccaattctctacctactcacagcctgactgtcacagctgaatgtaactaaagaaaaacaggagcatggtgactggtctcactctcgattcaagaccactaacctcaagtgctgtcctgctgcatttccttagaccatcctccttccctctcttctacgctactgttttgtaactttcctctctgaagcctctaataccttattccccattattgtttttgggtgatgaccttgcttcttttttttaagtcaagaaaataggatcaagatatcatttatttctattttcttatatgtatccctacctacaagaaaatgccaaaatagcaatggtttgggttttgtttttgttttttttttaacaatatgtgcttttgaaattcatgatgtttctttgtgcaactctatattacatccatttttctttcttttctgtgagattcgtggaagatgtggcatttgacctagactttgaaggagtgttgaggttctcatagagggaagtgaggaagaagatctctggctagaagagatgagcaaaaacatagaagcaacagatggtgatgtgtttgggaaatgtggttggttaactcttgaaggagcaaaataagactattaaatccagatctgaagggattagcctaactttttttttctgagacagtctcactctgtcacccaggctggagcgcagtggtgcactcttggctcaccctccat

SEQ ID NO: 133820 - DNA, 2353 bp, Homo sapiens
ttttttaattttttgtaaagacagggttttgccatgttgctcaggctggtcatgaacttctgggctcaaccagtctgcccccctcagcctcccaaagtgctgggattacaggcatgagccaccacccccggccttggagggcctaaattctgacctgaggaatttgcactctgggaatgaatgcctaatttaatgaattaacatatttgggctgtgatttcacactacagtcagtgttcgtgggtgaaaaagtagagaatcttggaaggaggtagatttaaggagttatggtatcataccaaagggcagtgttcagagcaggctctccttgctgggctggaagctcccagtgggtctgcttggaaatgcttattcacctagtgtactctactactttactgtatgtaaacatgcttagtgaagcactttacaaatattagtagttagtttgattgggttacatcagtttaccgttgtcctgaattatttctagtgatgaggcactatgctaagttggtggagaatacagaaatgaagaagacgtgaagccatagtcccttctgtaaagagcaaacagcttagtggaggagagagatacaacaaagtgaaccctaatctaaggcagagggtaatatcctttatagcagagataggcaatgctgtggggccagtggcttacctcagccttacggagacaggaaagtcttttgtagacatcatttgacccagactttgggagattaataggaatggatatagaatattctatacattttatactcattgatgatattttatgtataattttataatattttattgtacttattatagtataacatattaacttttttttttttggagacaagagtctcgtgctgtcacccaggctggagtgcagtggcacaatctcggctcactgcaacctccgcctcccaggctcaagtgattcttgtgcctcagcctcctgagtagctgggattacaggcgtgcaccaccacgactggctacatttttttgtatttttagttaagacgggattttgccatgttggccagcctggtctcgaactcctgacctcaggtgatccgcccacctcagcctcccaaagtgctgagattacaggtgtgagccacctgcctggctgaaaactcagcttgaattttatccctttgttgagaacattagctaatcatcagttatcaaccttacatttgagaattagagtctgttgttcaacaactatgaaaaattgttgggaaaaaagaagaaggccttgaatcaagacatgactggggcgtctctgaaaataaagaggtttttaatattgtctgctttccgcctttgtgagcacctaagaagaaagtctttccttgaggaacaatttctcttctaaacctgaacttatcttaaacatccttgtcctcctccctccacgttcctaaccatgtagtacaatcttgtcccactccctttgattaagtgcagttttctgttttgaaatccatcctgttttcatctatatgctcattattttctatgcctcttgctctttccccaggataatttcccctgttacaacaatctcttattttatccaaatttttcattccccaactaatctcttctgagtcatttgctaagcatatttttgttacttctgcttttcatactctacaatgtatgccttgttctctataggataactcacagcaatattgtataattcattgttgatcatctcatttcctaatatcttttaacagaatctaatacaatgcagtgttataagtgctcaaaggtgtgttgaatgaataagttaataagttataggttaaggcttgctagcaaatgcttctctctactaatgttgattattcctaggcatttatttcactatgataatttcttcaaatgaacatattcatgagagcttgactgttcctttttctattgaatatttcttcatcacaatatactgtattcctcactttcctagtacatcgtgtagcaggaaaagaacaaatgtgaaaaagaatgtttggagcaaagtaatatatatatattaccagttttcaatgtgaatttttcatattatagcaataaaaccatctgtgtcataatatttctcttacttggagaaaagcactcgtgttcatcaagaaaagtttcaattgaaattactaatgaggtataatttacttgttcaggaaaagtttaaagtaaaatcctcaacattttattatgttaaagacataattgtttttatttgtatgacatagaaactagcatataagaaagcaaatattagcatataatttagatttttccaaaaaagttctaaattttaatt

SEQ ID NO: 133821 - DNA, 1967 bp, Homo sapiens
aagcttatgttactcaatagctattgcctttattttgtagatttagaaaatttcttcatttcatagagctatctctcctgaatagtaacagttaactgtttttaatgtttaatttttacactgttctcatattctaaacagagagttgacttgtgtcttttggcagtagattcggagttcattttgggggggaattcttttaagcttttacaaactaataagataaagtgaatcctggagttcattttgtttcctcaaaaaagtgttttccattagctttttacaaagaactcacaagatttattttgttaaactttgcattaagaaaagtatacagtgtttcaagtgatgctttggcagttgtaaaaatctagtctattatttgagacattggtatgaaaaacgtggcagaccacactttagccaagattccatcttgttactgatcttttccatatgttttctgttagtgtctttgttcttaaaactcaggctttcactaaggaagagagagcaaatctgtgtactttttcaaaaaattgttttataggccttcacagtccttttggaagattaactgaaaatcaacagcctaatgtttatataacttctcattaactctgtgatttggatttatgatattgattatgttattcatgtttttaacaagtgtgaaagaaaaatcagtagataactagagcagacagaataaaaatgtctagaaaatttaaactgattggcagtgtctatctaggaggtttaaggtggcaagggatggggatggggggaggtggtggtagttagagtcaggccttaaaggaaaaaataggggatgtgagtttgtaatagttcactgttttagttaagtggttataattgtagcaattggggagaaaaggagttgaattgttgaaaagtgtaaattatatgctatgattatactttgattgaaatagattcagtatctcaaagctgagtgacacaggactggctaggaaaggccctcctgagacctgcttaattaacataataagcattacaattttctgctcatttgttccactttattcactggacacctactttgtgcagattttagatgcttgggactcagcagtgaaagtctctgttatagagaaggaaaacagaaaataaacataaataagcataaaatgcagaatataaacaatgtagagtgcgatggaagagaataatgcaaggtaaagggataaaaatgaatgaggcatgggggtacgggtcaacagttcaggcaccgctgtatgtggggactggaatggaacaattaagttactgtatggcagatggtgagagccaggtgtctcaccgttggagtggaagttacaaataaataagcgaggtgaggtggtgacagtgattcatgtggtaatagattagagttgaagacatcagtatgaactcatatttagcttaatatagatacagctggttaaaagggaaatgtaattatgttatatacacatagtacacacatagacctccttgctctgttggctgagagatcctacaagcaggagcactttaagcagcaacaaacacaaagcccagatcttggtttctaacatcattttccagtaaaaggaaccagggctgctccttggagaaatggctgtttccaggaggactggagcaaggaaagtaggagatgggcctggagcattgtacagtaccagaaaaagggcactcagcaaagaaagggatctggggagtctctgttcttccactcagttttgctgtgaacctaaaactgctctaaaaaataaagtctattaatcttttttgttgttgttgagacagtctggctctgtcgccaaggctggagtgcaatggcgccgtcttggctcactgcagcctccacctcctgggttcaagcgattctcctgcctcagcctcctgactagctgggattacaggtgtgcaccaccaca

SEQ ID NO: 133822 - DNA, 1022 bp, Homo sapiens
tgcccaggctggagtgcagtggtgtgatcttggcccactgtaccctctgcctcccgggtttaagcaattcttctgcctcggcctcccaagtagctggtattacaggcatgtgccaccatgtctggctaattttgtattttcagtagagtcgggggttttccatgttggtcaggcaggtctcgagctcctgacctcaggcagtccacccgcctcagcctcccaaagtgctgggattacaggcttgagccaccatgccctgactattaattaatctttgaaaaagggcaggcagaaactattttaagtagtttagatatttagaactaaatatggtgatggggcaagccaagttggtatcagagtggtgacaggccagcttggctgatgcctagtgatctaggaggagggagtaggtggtactctcacaggtagccagtgtcagcagggtcaaggcagacatatgcctggaagtaaccacctctcagcattctaaatggaatcaagtttgtaaggcagataatgacacttagctgatgaactacttctatcagaaaggccacttgggcagccctatagaaacagtccaaacattaattgcagtcagtctcttagtctatctgctcccagggggctatgaggagcagaggctcctgaattcatggcccatactcacaggctttcttggccatcatcattcacattttctgtaaatggtgcccccatgccaaccctgaccactctcttgtgtaagccagaagtttgggagtcctttaaattagtaccttctcaagtgtggccggaggtccatcatcatcagaattaccagagctgcttattaaaaattcaggttccagcatctttatactcaagatctacaaaatcagaacctctgagcatgggcccaggaacttccattttaaacaagtgtcccaggtcccaccaaaccttgagaaccactgatgtaaatacttctccctgactttcaaattgaatctattggtgaatcttttgtgttctacacc

SEQ ID NO: 133823 - DNA, 1017 bp, Homo sapiens
tttccagtattttaaaattttggttttgtcttttctttttgtaaaaagattaacttggctactttaagctccactattcagatcatagataaatctgtcttttattctaaccttagtatttaccttatgattttaatgatgaatttcaagatgttgggttttttcaatgtcagtaaacattttttacttttacatatgttcttataagtgccatgatatcacaattttttgttacattgtagaaaaatttattttgtttattaaagcaattgaaactttagaatattttaatttttgagtgattattatagtattgttttcttttatctttaaggacttcatgatcttttatttttctttgtaaatgtttatggtttacaaagcattgcatatatatttttatcatttattcttcatagcaaccttgttcagtgttgtcacccctaccctttataggtgaggaagcaggctcagagaggtggtaacttgcccaagactataaatggaactggatttccaaggcaaagttctgcaacccgggacactgctggttctagcactactggtggtgaacatttattattaaaatcatactatcatcatccctctactcataccatggtcttccctctttttttgctcaaaaaagtagcagttttgttctaggtttccagatatgtcattttagaaattgactaactttcctgtaaagccgttgtttgcaacctgctgagattttgccctaccttccaccactccctgcagggacatttgtcaatttctggagaaattgttgtttgtcaaaactatagaggtagaggggaggctggatgcagtggctcatgcctgtaatcctaacactttaggaggctaaggcttggaggattacttgaagccaggagttcaatatcagcctgggcaacaaagtgagaccctgtctccacaaaaaattagctgagcacagtggtatgcacctgtagtcccagctacttggaagcctgaagcaggaggattgct

SEQ ID NO: 133824 - DNA, 1007 bp, Homo sapiens
agtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaatatttgtgctttgatgttatttttcttcacccacccagcaatataaactattcttcagaaaactctaatctatatataacatgtttagagcagtattaatgtcaattattattactttttgttttgttttgagatggaatctcgccctgtagcccaggctggatggagtgcagtggcctgatcttggctcactgcaacctccgcctcctgggttcaagcgattctcctgctccagcctcccaaatagctgggattacaggcacatgccaccatgcccagctaattttttgtatctttagtagagacggggtttcaccatgttggccaggctagtctcga

SEQ ID NO: 133825 - DNA, 1027 bp, Homo sapiens
tacaataatgcatttaaaacattagaaatgatcagaagaatgaaatttaatgctctaagaattaggctcacaatttgattgtgaagaattattagctagcattttctgtgaccaaaggagaatttttctaagttgttttgtagaaagatctatcaacatcctaaatgcagaattgtaatatagcatcaataattgaaatcacttgatcttatgtacaccagtggacaagtcacaattttacaggccgtgtacatgtctttttaaattaaattcttactcaaaaagtatggtaaatagaggaactttccctcattccctttaacagcccttctaatttcttctttggccttttttggtaacagtgagatttctgggaaataaaagcaatctacttaactgacagcatttttgtgtactgaagagcagaagtcttttgctggccaacgtgggatatcctccctggctgttgttacctctagattctgcctttatgtcttagtaagactgatatgagaccaatcatgaaaattctaggcattgctaaaacatttaagtttggtgttcagtcccccagctgctcaatataagtgcaaggtatagtttaccatagtactgatctcactgggaatgaaaacctgctggacatcagtgtgtttactttgtggacattcattgaaatatatgcttatgacatgtgttcttctgtttgtgttataattctattcatttaattaatgctagcaagagtataggtagatttaagagagaccagaagctggaagcagagttgtggagcaaattaagcagaaatgacatcagggatggggcagcttgagagaggacggactcaagttgtagtcactggctaaacagacatccaaatgcagcatttggaaaagtcaaagcaaaagttgtgatcttgagattagcacctgcctatattacattcattttgatggtttgtatctcaaaggagtacagtgaacgaaacttgtttaaagatacaccggaaagaaaaagagaagag

SEQ ID NO: 133826 - DNA, 2234 bp, Homo sapiens
ggtttgcactcatttctgtcaggggagaatgacatgacttagcacacataggttgtatataaaggaaactcacagtgcagagagacacatcccaagaatgaatatcccaagaagcgtgagcttcatcctttaggctcattttcactcggtatatctgcttctgtctatctactgtcctttctgtcagcatcagaaaaatacggctttgtattatgtaaactggaatatatgagaagttcactatttttcactttgaattaccatatcagtgacattttcactctcctccaaccatgagcacaattaaggttttgttattgtaatagtgcatcaaaaaagatcatccttcatataatccaaaatgtttatgtttttctgtgtacatttttgtgtcttaaactttttttaaattgtaagtcaattagaaattgttgttttgttagcagaaatataaccttgaagaaatgccagtaagtgaggccaggcacttggttgaattaaatgaataaatgaattagtatcttggttatgaattttgaatggatattatagggagatggcatggttatatgataggtgtcagaaataaaatcaggtagagttttaaatataagacaaaaaattcctcacatcgataatcttaaagcagataaccaaatgttaggtgcacattccaaataatatccaaactaattttgtgtattatatttgagtagcttatgcaatacattaaaaatactacctttaaattaaataataagttatattttattagggtctggtcagaaacagaaaccacgctaagtgtttcaaaggaggttcttttttttttttttgagatggagtttcattctgtcacccaggctggagtgcagtggcgcaatctcggctcactgcaacccctgcctcctgggttcaagcaattctcctgcctaagcctcccgagtagctgagattacaggcacctgtcaccacacccggctaatttttgtatttttagtagagacagggttttactatgttggccaggctagtctcaaactcctgaccttaggagatccgcccgccttggcctcccaaagtgttgggattacaagcgtgagccaccaggcctggcctcaaaggaggttcttcagggagagagagacagtattacgaagatcatattttctttaagtgctaaacattttgttggacattttaattggtttataaatggcttatctaggcaaagattattcaaaaattaattttggaaattattcttaatagtgacgataaagtgttctacatctgcttgtttgttataatttcaagatgtcccattcatttgaaaaacttacccaaaacgtgtaaagcattcattcctttgaatgtgtccttttgtattttcttaactttattttcatgaattctgagttctgctaatgatttgggaagattaagtggtatttcacttagttgattgtgggacagatacagccttcgcaacttctttgtggttagaaaggcttttgggtgaatcttcgttagcttgttgttgttcaggatcagacccttgatcaagcatagaaagttacacaatattaggaagtggatttgatttaccagtattctacagtgattagccaatgatggaaatcagtacaatttatatcagtggtgtactagatcacccatgtaaaaactttcccagcccaatctaagcttttaaaaaaattttactactgagttagaaaagtgcagagctataataattaatgttgtgccattggtttagatagaagtgcatctttttaatctttgaatagataatactttcatatggctaagccttcaacctctactcagcctcctatttcccttcagggaagtgaccagtgatattatctttatcttatcttaaaatctatttactctacaaaactatgtttagtgcacaccaaatatacttttgcatgattttgtctactttgaaaacctcatttctttcatatttactaatgtttaccatttctcccagaacagaggcctgtaaggaaaaaaatcctaccatgtgccctcagcattctggcatattttagatattggggatatagtaatggatcctgagaaatgactcaatctcttatcagttttttgggtatttctcagggcaataagacagcatcctccagaggaggtctaataactccagagagtaaaaagagctcgtaccagtgtgagtgtgctct

SEQ ID NO: 133827 - DNA, 1925 bp, Homo sapiens
ttaaactgcactctcagtgctggcttgattatcacagagcttccaattcatcattaacaaacagtgtaaggacagaagatgagaagagcatagccattcagtagtaggacagtgattcatgccacatgtgtctcataatggctggaagtgagctgggagggctgtgattgtgttcagtgattttgctctgactgtatcatcctttgtgtaagaacccaagtgccaaacaagcagctaaaacttaacacagagaatttgtagaatgtctaaaaaatagtttgattctcttaaaagacaggtaccatataaggtgatactataattatataaatgttttgtaattgtgtggtatacctacaattcaagtataaagcatgtactttaaaaagtgatttacatcagtacacctggtcagtctgctaatagtagcttggcagtaatactacttaacagctgggggctttccctccattgctctacacctgacatgcatttctcaaaggaaatcaagtaggtctaagaaagctcctgataccatttagtttctcatttccctgtgaataacaagaataagtatggactaagtccctggaatgctcctaaaatgtaataaaataatgatatgatgaatttaaaactttcatagccccagtattaaatatgccattagttattattcttgtggttatctaagctgaaaaggggttgaagaagtggtaaacgcatcaacaggctatatttccaacttctgttggtggaataatggcctgccattctccaaaagattctgtggcctaaagttagtggggtggactgggtggatcctcggtggaatccattgtgtcatttctgactgtcttaatgttttagtgagacctaacttataaatatatgctcttctagttgctcttttatattgataatggaggcttaccagatctgagctgcctgcacactttgaaagtgaaaagagcagacaaggtgctggctacctgaccgggcagtgtgagagctggattttgtagggaggcttgatgcaaggattgagcatccctcagtctgccttaagtatgatcagcatgcatgtcctcaatcccagggtgacagggaggaagagatgggccagcagggtccactgcactgacccagggtgacagggaggcatggtgaccccacatctctcagacacaggaacaggccaggcctgcatggtagcaaggggctaatattgttatggtattttctaccctgttctcttagttttatcttatctagagatgacagactttaaatttgttttctccagcacagcctgagagtgtggggaaatggcctggaatagccaggcctggcttaccacctcagatgatacagaaccagagctcttcctctaacaccatgccagagtcagcgaggcaggagctgtgctgaggggaggcggtggcgggggaaatgaggtgctcctccaaacccaatttcagactaaatcagaaattttacttgctaaaatctggagacttcgaaatgatttttttggtttgtttttgtttttaagacagggtcttactgtgtcacccaggctagagtgcagtggcatagtcacagctcactgcaacctctacctcttggctaagactacgtgcaccaccaccatgccaactaattttgtattttttatagaggtggagtcttgttgtgttgcccaggctgatctcgaactcttgggctcaagtgatccgcccgccttggcctcccaaagtgctgggattataggcatgagccaccacacccagcccaaaatgttaaacatggaagtagtaatcttttaaatcctagaatattaaaatgatactaatacagtaaagaaaaaattcttttcttctttaaagatccaataaataagccatacatgtatatattaatca

SEQ ID NO: 133828 - DNA, 1065 bp, Homo sapiens
tgagaaggtgaccaaccactgaggtgcagcttctgttgatgtacctttggctgaggaatgttagctttctttgcaaattttcaggctgttatagtgctaaattggagcatatgggtcttgataatttttctttctttttttttttttttgagatggagtctcgctctgttgcccaggctggagtgcagtggcatgatcttggctcactgcaacctcggcctcccgggttccagcagttctcctgcctcagcctcctgagtagctgggattacaggtgtgtgccaccacgcctggctaatttttgtatttttagtagagacgaggtttccccatgttggtcaggctggtctcagactcctgacctcgtgattcgcctgactgggcctcccaaagtgctggtattacagtcgtgagccaccgcacccagccgggtcttgatcattttaagaagccttagatagttgtgtttagaaaatggaaaaattagatttttttcatgtatattaccaaaaactttaccacccatttcctttaagtaattaacttctctaattagttgtaaattctttgatttccacatactgattcatatattattctttttttttttttttttaacttgagacagtcttgctctgtcgccccggctggagtgcagtggcgccatctcggctcactgcaacctccacctcctgggttctagtgattcttctgccttagcctcccgagtagctaggatgtgtaccaccatgcctggctaattgttgtatttttactagacacagcgtttcgccatgttggccaggctagtctcgaactcctggactcaagcgagatgcctgccttggcctagatgtcagtacacttttgatagaaccgtcctcactcctgaagtgtagtcatacatttaatagccaaaaattgaagaattgaaaatctagtatttgaatatcaacattctatcctacagctctatgtacttttcctttctatactttaaaattggtcaggcatggtgccttacgcctgtaatcccagcactttgggaggccgaggtgggtgggt

SEQ ID NO: 133829 - DNA, 2239 bp, Homo sapiens
tagtctcccctttttctgaatgctttttgtttgcctctcattttgtcatataatgacaaacttcattaaggtctctagagtagattattgtaagctttaactcttgccatgaatgctatggcagtaggaagcacgtctaatgcttttcaagacatctgctcatacagactcatgaagtgaccctgatgggccatcagcccctgagtgggagttgtgtgccagaccttggcctccacagtggggccagtctcagctgtcccctcttggaaatagctgaaggcaacaactcttgatatgcattcccattaagtcccgtccttgaacgggacatggctgtgctcttgagtgctccttcattagaagtattaaagaaataaaatactcagcaaagaattataaattttaaaaagactttatccacttttttcttaggcagttttaaacccaaattgctaaaaagcaaataaagcattatctttaaaaggtctagattagagatttcacaagctttctataactcatttcattgttctagacatgcagcttattttgttatcatggagttttactgaaaagtacagtctcaacctgctagcaccctgagatagaactgcatgtgatgtccattctctctgaagggaattaaaattaaatgctttgatttaactggggaagagaaggaaatgttctatggacaacattcccttagttttcctttgattttcttaattttaaaaataagtttggatgtactttggggtttgctgtactttccacctaaaaacttaaatgaaaaaaacttatacactcagattatttttgaaatttcaatgagactttttccatcctttaaattgtcagaatagcattactattcttcaaaacaaaatcgacttatattcttacctaaatctgagcaatgtacaactcgtgaatagcactgacatccaaatggacacattggaaacagatcaaatggaaaaaaatggcttcttggctctcttgttggaaaaagagagttgtcctcatcatcatcatcatcatcatcatcatcatcatcatcatcatctgtgtcttccatatccttcagcatcatattcttcagtgcgatgtgtgaagggctaaagaagggtttggcagagcacaaagccaggaataataggagcacatactccttcatggtgtcttagtgtagaagaccagtctaggactaaacagacatgggatattaaatttaaatggatataattcctgcatatatacatttctcagttctggcaagagtgcaatgaaatggcattttaatccattgcttagctaatctgagagtaaatttataaagatttttggaaagcaattcagcaatgtgcattgggaactctaaaaatatctctttttcagatagtaattctactttttaaaatctagtctcaggaaacatttctaaagtgcacaaagatgttcatcacagaattataatagcagaaatatttgagacaattatataatggttaaaggggaatagtaaaataaaagagtatatttattccatgaaatattttggaacccacaaaatgcttgcaaagacacttttaaatatgggatattatcttttgtgaaataaaaaaaagcaaatataaaaaatccataaactgtatacttacaaacactcataaacaaacaaaaacaaacctggcaggaatatacctgattgatgataaactctgggcactagaaccatagatgacttgtgttttcctttttcctttaactttcataatgagcaatgagtattacctttataatgaaaaagctaataaacatcgtaaaaacagaaacagattatcttacctaactctgtattcccaaaatctttctattgccttaatgtattcagtgtccctgaaggaggaatatcttcattgtctccttagacaacatctggaatttttccttaactgatttctctccacctttcccaacctcactctcatagttggtcactttttccacaattggtatctttttccttctaatctgttccattgtctaatatttgatccaaactgtctgatgtccagactattctttcttactcatctttccactgagttcggtttgcttgttttgtttttggggggccaggttgttttcagttgcatttttaaaatgcacacaaaacagaactatacaaatgagaaccttcagagcatagatttattgccatatttacatatcc

SEQ ID NO: 133830 - DNA, 1111 bp, Homo sapiens
gacagatctgagaatggcaagagttttttatattttaataatcctatgctgattccaatttcaaaactagccctagcctcccatctgtacactactttgtggaggtgttaattcagatgttattctagactcatccctcataggaaatgaggcgtaaagagcttaagtgacttgcccaaagtcacctaccaaatataaatggagccagagctagggctcatgtgtcccaactccctgttctgtgctgccttctgctccagctcatgtggggggactcagttgttttatccagaaatctcgtggcttcatgggcatactctgtcattttttcttatctaaccagtatacaaattactgttctgtacacatctgtacataaagaagcacctgtgtagcttggattggaaggtagagaacagaatgattgtgtgatcagatttgtgtagtactgggtgagagattgtgctggcaacacagggttcagtggcttcttttggagagccccaggtggaaatcaccaactgtggctgactactgttctgtagcaggcatggggtgtccctgctggcaggcaggttgatgtttcgtattccagtcatcctgtgaatgctgtatggggtcctggtaaaggttactgggggcttccttctcaatatcactttgtccctggcacattgtctctgtgcctttgctgtctgtctaactttgactcattatgtgttttgacttagggctgttgtgtggctcctgactccttaaggtttagtgcccagctttgcctcaaccttcaaaatactcattccctagaaaattcagctcttggtccttagctaaatcaaagttggcccctgattccagtttattctgtaacattcttgcattacagctctgtcttctaggtgcatagctgcccttgaccttgtctgaccttggcaacaaggagctatagaattataatgtcatttaaggtcctgtttctggctttctttgaggttgctggagttattcagtgggcatttaccaagcacccactgtaccccatgcagtgtcactcgtcagaatgctgaatttcttaaagtagagcacaccttcctccccatcctcttctctc

SEQ ID NO: 133831 - DNA, 1928 bp, Homo sapiens
ttgtaccccctttccactcatccccaagagactgcccaattctacatcaactaagaccttcaagagaggacagttttcttttttttttttttgagacggagtctcactctgtcacccaggctggagtgcggtggcgcaatcttggcttactgcaagctctgcctcccaggttcacgccattctcctgcctcagcctcccgagtagctgggactgcaggcgcccgccaccacgcctggctaattttttggttttttaatagagacagtgtttcattgtgttagccaggatggtctcgatctcctgacctcgtgatctgcccgcctcggcctcccaaagtgctgggattacaggcatgagccaccatggccggcctgagaggacagttttctaaccctagtggcaaggacttactgttgtaagtgaccccaatggttcttcccaactgttgtatagatttggaggccagcaaagagcttttccagtgggttagaagacctgttctctactgtcatcaagagtctgaccatcgtttgttccctctctccagagaaatggcacacattgtgttaagcaaggcagctacagtcctaaagaatacatgtgcctcagatgtgcatagcagctggctatgtgttcatcctcccctcacttaaataaagtactcctccttggacctctaggctgacagttccaggcagctcggtagtcccattagtggccctctgtaactcaggccccatcctagccctgcagcaccttagggaatgacggccctcctgtttggtttagaatgctcatattctcatttattcaagtatatttcagttgcaaatgtatctgttaactggatgaattgggaacataatgaaaatatgaactggatttttaaaatctttgtatccagagcatctagtgtttgcctaaattccttcagaacacagtcataaacaggaagcccttgggtcaaattcagtttgtcctgcacaatgttttgtttctgaactgtttattgaagtgtatgttaccaaaaaaaaacatatcataatggtacaactcaattaatttttacaaaatgaccccaatcaagaaatcccagcctcacactccattctcatacatccagaatccctcctcttactcctcaagtcacagcctgagttcagcaccataggttatttcctgaactttatataaatggaatcatactgtgcattctcttttgcatctggcttttttcattcagtgacatgcttttgagatccattcgtgtcattgtgatacacagtagttcattcttgtcactgtatagtattctcatacatgaataagccacaaattgtttatatattcaactagattaattaccttttggagaggtactatgaacgttcctcagtctgtcatttgggggtcatgtgtatgtatttttgttaggtgaaattgctgtatttaaaaataagatttcaacttctctttaaaaattaggctttcccagtctgtgatttctggttttgcatggcaactgttgtctctgggacttgtgtttttctcttctatactcacaggatgttgtccacgtcacccacccaaggcactcctcagtcgagttgcctgcatggcctttctgggtgcagttttgcctcccatatctagagagttgagaggcagttcctgtaagattgtgtttctaaagatatgttacagctacttttccttctccccactgtgagacttaagctagtcttcctctgatattttgcttcgatctttggtcagagggcctagggaaagaaataggccctggaataagatgctggggttaggggtagtatatttggcttattcactctgttctgcagataatgtggtaaaggtgcaggcctcaggcacaaccctccaccatcttggggctgtgacatggaaagct

SEQ ID NO: 133832 - DNA, 1037 bp, Homo sapiens
accacctgcacacagcccaaatgaaaaggtttgataggtgaggcaggagctataggagcagcatgtgtcaggagtatattgtggggcacacacacacctgccaaaaaagtaggcagtttgaattttctgatgttcttttgccagtctgtggtgtccttcacattctaaatgaattggaatagattgtacaatgttcttttatagtagtagctacaagaaaggccgtccaccaatccattcattcaacaaatagtgtaagtgctatggagagaagcaggataggggtgggggtgtcaagggtgccctccctgtcaggtgacagtcacaagacctgagggctgtgagggagttagccgtgccatgcaaacacccactttaagaatgttctaggccactgaattctaggatgtaaatatgcataacatagggttttttgtatagtagatgcttaaaaaagcttctgtgaagggataagtgattaagatttcatgagttttaatgttcaagtgtccctcatggtggactaggcacttcggtttctaatgaacttattttatactgtaggttgtgacccaggggcagtattcaacatgcagattgtttggagcatatagtatttttaaaaaccaggacatttgatatcgaagtccaaatttacaatgtatttggaaaaatatgagctggaaaaactgaccctgatgtcctatgtagcagcaatttgctgagcacgtaggccctccatggttctctgctgccctgacctcctcttaccctctcctcacagctcttcctgttgcagggactggcttctgctgtgtcatgtggctgagctcactctgtcatcctacttgaagtttctagttctgaaaaatgaattataataaattgtcactaaatgttcattccgttgaatttatgaaaaatgaaggacttatacaattttgtttattatattttgcatgtgtcaatttttttttttttttttgagacggagtcttgctctgtcacccaggctggagggcagtggcacaatctca

SEQ ID NO: 133833 - DNA, 1747 bp, Homo sapiens
gctgaggtgggagaatcacttttggctgggaggtggaggcttcagcaatcacaccactgcactccagcctgggtgacaaagccagaccctgtctcaaaaaataaataaacatataaaaccattaagtgaaagtttgctcgatagcaagaaactgtactttgagtacccatacaaccattgtgtttttcactttcagtacagcattcagtaaattacttgagctagtcagcactttattataaaatcagctttgtgttagatgattttgccaactgaagaataatatagtattctgagcacatgtatctagcttaggccgagctatgacattagataaagtttagatgtattaaatgcgttttgacctatgatattttcaacttacggtgggtttatcagggtgtaacccatcataagtcagggaacatctgtattattcattggtgaatataagtgaagggtatgtagatgctcattgtgaacttaaacttttctgtggccttgaaaatattaccaaataaagggggaataaatgctaaataattggagcagataaggcagtttgccttaaattaactttaactctttgatttatccttcactctagtgaaatatttaccgccaaatttattttaagttaattaagatgttacgttagacagggattcttaacttgggtatatgaatacttagagaatttgtggaaagactttatgagtcttttgatacatgccaagtgtttttatctatgtatttttctgcatagaggatccattatagctttcaccatattttctaaggggtccatccttcaaatagttaagaactgctgccctagaatagatttacagtttataatgtattctttattcctagtgtcacaatactagttaaattcactttccaaatgattcacatataaatttgatgtttgtgaatgtaattcccagtttaggcaaaacaatgaaccttcagcagattacaacttataaaaagatttgcttatatcaattgatagtttaatgtaagtttatttgaccacagagattctgttacttagaaacacaccaggacattttaataacatgatgtattccttttcttttccaaactaatatgtatttagtgtaatcacatgttatttttaatacagtcctgctttcccttgtgtggattcacattcttcacattttatacaaaggaaaaaatatgctagactaagttttgattttatccattttcatacagaaaagggaacataacttcacagaagaaatggtcatgcctttatgatttagttgtatcaccactaaagtttacttactgagtttagaacatttattcctttacaaataacagtatgtgacagactgaaatccagccgggcttacagtctcgaatgctcctgttcaccttgtagacatgtcataagctgaagccttatttaagacatgtagaatcaaacatggactaattcaggattacacagtttacagtagattttcctctgaaaaccttttacaaatgcctctgattctgttggactagtttcaattgagctgatggtcgtagggccagaaatgaataggaaaggaacaaacttgctagggaagcctctgcccaaagtttgctatgtgggctacagatggaaaggcctgggtttgccagtgcagactgtcttgctatactgttggtgactcattcagcggttatttctaagggaagaattcatttataggacaggctc

SEQ ID NO: 133834 - DNA, 1021 bp, Homo sapiens
atttttttttttaatcttatgatgagatgtcatttacactctttgagttccagtttcctcacccacttggctccctcagcctggagatcctgctcagatgttcgtgtataccatggttcactctgttccgtgccatggacatgatcatacagtaacacagaagaaaggcagtcaaactcaggttttgttgttaatttcccacctactcctcaggagagccacgctgttgccaaggctgcagggtccccgctggacccccactggcccacagagtccaaggggtttacttctggccctttacagagcatgtgtgcagagccctgtcttagtgtattagacccactcctttttccactatattcaataccaatctaagaaatcagttattttaaataattaatattcaccacactcagaggcctggaagccttgagcgagttaagtaacttcctgctcaccagtttcctgtagtctgtccctggaaacattgacactcacctttattatgtctaccctgtgcccagcacctccacaggatatcaacttgtttagtcttcccatcagccctgggaggcagatgttgtttcctgattttgtgcacgaagaaactagaactctaagtaacttggccaggtccatggctagtactgattctagttgagagccaagatactcattattgtttttttaactacaagagatgaatctccatgtttcacagactttgggggcttaaggcctgtaatggtcatttggtgttaagttagagctgggcagaaacttcttttcatgggtacttttaatatttttgaattttaagtctatcaaggatctgaatttacgttcaaccatggatagataaatagttcagtcatctgtcagtctgtaaatgtttctgccatgaggacattttctatcctttttctaaataagggaaagaggtggaatcaatatcataaagggttttactccgccctttggaagtttcacttcaacagcagaatttgagtatttcattctt

SEQ ID NO: 133835 - DNA, 1228 bp, Homo sapiens
ggattttaaaacctagtgtgtcatttagatagtacctagtttgttgattgtaagaagaaaagggggatgggagtgaacactttctgatgagagcaaagctgctttgtttgaagagagaggtctgttcacttccttatcagtgacatgaaacccctaatgaaccctgtctgaaaaccactgatctgttccaaacatgttattttataattgaatcaaatgaatcccaaagaagtaaaatgactgcataattattgaagaacaagatgggctcccaagtctcttggttcctggtgtagttatttcattataccaggttctgtatgtctttcactaaataatttctttagtgctgcttataatattcttattgataataagccaaatctcaaaattatactgttccttgtatatatatacaaagacaagacacaccattaatatttttagatcatggctagaccaggacttctttagtgtatatgtgtgttagtaattatagtgtaatttttgaagccaaacagaacatctgttttttagtacattatattgtgaagagtgtttgctataaggacatttatcacttttttatggaattaaaacttcccatctagaacatcatgaaatttcagggctgaacaagttccatgctagccatattttaaaaattataaaatcagtagaaataagtacaacttccacttaagaaaaaagcttcaatcagtcattctgattttcatttttttcttgggattctgcagccagagcagagttgagaagcgacatacacagcaagcccacagtgcgtctgctccacaggcaccggtctggatctgctgttaatccaggccgttgagggtggccgtagtctcctggcggccctcaggccccagtgtgctcgtcgcattgtcacccatttttctgactgcacagcacttgcctgcttacttgtctgtttgatttcctgcttattgcctctaccagagaggaaaggccacatctgatctgtttgtcactgtctctagaacagcatctgaaacacagctgaataaagtcagagtaagaaatgaatgaatgaatcgtttagtatctgtctctgtgtcatcccaagatgctagttctgctgactcaccttattcagtttgagccccctttaatactaattttgtttacagcttagattgccttaaaccatttatgtcaatgtgtttatattcatacatcaataagt

SEQ ID NO: 133836 - DNA, 1064 bp, Homo sapiens
ttggttccccttcccctacattttcattccacatttgatttgatgacctggcacacctgggacttgaggcgagcctgagggaatctagaaaatgctgttaatcatctagaagatctggggaacgtggtgaactcactggcttgtttcaggaaccccacctgagtctcctaaggcttctgccccacgccctcttttcacctgatgaagacttctctgcctacagtgggctcagtgccacatgctgctgagcccaattggcctctccatcctgcttctgaatgacacgtgtcccaggctgtgctacttaggcacatagttccaggacacgcaatcccagatcccagttgtctgctggatttgctgcagggcttgcttctgactccctcccccttcactgaaagctatagccagaggctgctgattcttgtccaggaagacagagtctacttttggcctgcactgttaggccaagcattcttcagtctattttgtaagagttgaggtgaagaaatagtttggagaaaagaaggctgtgtagtgtaggagaacaggcctgggctctggagcctggtgcttccacctaatgatgatgaggagaaggagtatggcagatttctttctcactgtgtgcaggggaataatccttcattcaaacctcctgacaacctgtgaggtagacagagctagagtggcatttgaccactagtgggcagacctcgaagtcagacagctggggctcagttcttgctagctcagcacttggcatatgatagggtgtccagtatgcagtatggtgacaacaacagtagttactgcaataatcctaacaccagtcatgcagcgcacaggttggaaactgcatgaagtagcccactttggggatagggtaagggttcactaagaaacgattctgtctccgagcccttcagtatcgtcacctccctcacttatcccattcccagtttccatactctgtttaataatagcgagaggaagaaatagttcaataaaatttaaattgtagcatgtacttactcttgatttatccaggctaaaggagcaat

SEQ ID NO: 133837 - DNA, 3183 bp, Homo sapiens
cttaaattacaggaaattctgtatacagcatgaaactagagtttaatttacatcacaatagtcttaaaatatattttgttgtagtgtaccatatttcaaatataatacatttaaaacactaaaaaaatatattgttacctcaatagaaccaggaagaccctgcggtataattctaaatttattttttcccagacgcaagtaggctaggctcttcaaaggtttgaaagctaaaggattgacattggcttcactgagattgtttccttccaattctaaggtgaccaactgatttaagtctataaaaaataaaagtattagaatattaggataattgaaaaaccatgcaaatttttgtagccttttgaaatgtcatgtgaaatggccggtttatttggagggcaaatacagttttttttaaacctttgtatcctcctataaaaccttttcttaagtactttgtacatcccagatgctcaattcaaccagaactaaatgcatggtccagtagtgaggcagacctgaaaaaaatcattgaaatgctaggtgctaacaatatgtgtaaggaacagaagcaagagagaagagagggagggagataggaaagagaggcagaggagtttccatagaaattgtggtggctgaacagggatttggaattcaggtaggaaaggaatagaaagttgtggacagtcattggaaacattgcaaagacatagatgtatgaagtggcagcataataggcaatggggtgggtagaagtttaatgcaatgaatgatttctttttctaggacacagaaaagaacactttccctggctcaccctcagtctctgaacaagggagtcagaagtaaaccagaacagtgaattcccatcatagttactcacttgttggcacagagtgcagccaaatggaagctttgaaagaatgatgatcaaaaattctccatgcattcagattgaactagcaagaaaggcctttatacaaacaaattttttctactttgtttctactagtctcaggagtggtatgatccaggtcaaatggaagttctgtgctgcaaaatggacagctcagcaatgataatacccaaaggcatctgagtcagaggctcagggtgtggccaaaattcccagattaggggatgttttctattcaacccccttcatgggcattgcaccgaatgccatgtgggactccgttctgctcttaggcaacagcaaagacggttgcatcaggaatagaaataataaatgctggaagattaaaagaagaaaaagcagtgtagatgtgagtggtatgaaagtgccaggctcctacagacagaaagatttagatagaagtaggaggaacttccaagctgaaatagccagctgagcacatgtaggtgaaagaccatgtgggtttgctcagggagagaggagactagccctggagtggctgtgcacagtggagtgaaggttggtgctcagagagaagtacactgggagggcctttttttacattttttaaattttattttattttatttagagacagagtcttgctctgtcacccaggctggagtgcaatagcgtggtcttggctcactgcaacctccgcctcccgggttcaagcaattctcctgcctcagcctcccgagtatctggcattgcaggcccccaccaccacactcagctaattctgggagggcctttgcaccctggacaacaacgtctggctctcattctctaggcagcaagatggggatggcaggacaagggccacattttacaaaggttaacctggtggtggtgctcaggattaatggaagtgctgagcaacaggaagtagccaggccagccagtaaattgggataagtggttatatttcctcatattctctttcatttccaaaactaaaggtactgagaatctgacatctttctctagtacataggtgaagttttgaaatgcagtggaagtttttcattgaaaaatagataacagaaatgaactagtggccattacatgactgagagaaaaagagagaaacagtgcaaattcaggacactgtgttttcttttgcaattattctctggtatatataggaaataggaggtaacaggaaataggatggagctagagaacgtttcttgtaggtgagacttgaggtggatgttgaaaggattcatggacaggaaacaggaagtcttccatggtgggtggtaccatgacaggctgtggacatggcaggtgcctcgatgttcctggcaggcagcatcacatggtcatccactagagcagcctccagggctcctgatttagttgtttcagtcattagtgacaacaaaaatgcttttaaagcgtgcctggttttcctcagctgtccctccctccacctttcacacctctctctcaattgtaagtccttccctttctccataacacgtgtgcacatctcaggtggactctgctcctcctgcaggtaaattccctgcccttcagcaaggtgtgtgcagccccttgtgctgctctttgcttgcctttcaccttcaccgtgcctgcttgcagctcccacagtatcccaaattgtctcatttatttgcatctttgtgctgttttctctccctggagtgccctccttccccctctctggagctataatctgaaaggtcatgagtgaggagccaccccaagagagatgacgggagagcagtgggccacctgcttccacacagaagcagggtgccctcacagcactcctggcagccagcctgaccatccacagcatcaggactcccagccagggggagcccagcacccgaggggccagtactgcagtagctcttagaactcagcccacccagggagtgcagccgggggtatctgagccggaggacagaagcactgccggcatggggccgaggctcctcgggtgctcggactgtggagaaaggtgggctaagaaaggcaggcagacagcccgttcaccctggcttcctgtcaacactctgggaatctagaagcatttgtgagtgagggaggagaagagtactctggaaggcagttccaggggtgtgtgaaagcacgttcacaatcaggagtgcatgttttataacatctcattttgataacccaactaaaagtgtgactgacttatagttcatatacagcctgttagtacagttgttctaaattgctga

SEQ ID NO: 133838 - DNA, 1579 bp, Homo sapiens
tcatttggcaatacagtaaataaaatttctacaggactatataggaaagattataaggaagcatatcattgaaaaacaaatattaaatacctgataaactttcttcatcgatagcctgaagattgttctcattgactttaagttcttctaatgtagatggcaattgtgaaggaatctgtatcaaattatttccatccatattcaaacgcattaacttcttcagaagcttaaaaagcaaatctcaaagttacttttttatctagtcacagctgtgcagtcacatttcatataatggtcgtgactaaaagtctcacaaacctatccttccttaggcttagacagtaatgtccaggccacacagcaaaccccttattccccctgccaggttgatattgatcctggtaatagcattgattctcagggattttcagcagactacatttgattattttgtagcttactcaccacgtttatattgcagctttagaaagtgagagaaagctgccataactactggattggtcattcttgctagatcttaggtttccacctttacagcaatagacagaaattttatgaaatcatgcagtaatctgaagctgtcatggatgctaacaattaagatagcaatcaatcctttaaacatacttgtaaacctcagttttttatctactccagaaaggtcataaaataacactaattactgtggaaatttttcaaaaccaaggactacagatatcacaagccattccaatatggcatccagttgactgtctggaaaagtgtctttttcacatttgtagttgtgtgttcattggtcaaacctagcctgtacccccacaagtggggacctgtggttgggtaggttttagtaaagtcccatggaatgattcacttctccagtgatcatattcaaatttcaacagtttcggaatgggacagagaattccaaagcaagaaaaggaggtaatctcttacaaatttttctcttggacaaataggaaaaggaccccctaatgctagccattttctagaagaaggatggatagcatgaagtagatctagggtgtgaatgtagaacccttttatctgccagactccagataagaaacaggaaatgagaatagaagagaccagtgatttgtctgaagagtgggtggaagacccagaagactgcccaagggagtaacagtttcacttagtggaatatagtgtgctttatttttggcttttcaaacatacacatttatgagtttttgtttacaaacataaaccccttttctcttggctctgaaattccttgaattctctcttcttttctcctttttgttgtttgagacagggtcttcctctgtcgcccaggctggagtgcaatggcgcgatctcggctcactgcaacctccgcctcccgaattcaagcgattctcctgcctcagcctcccgagtagctgggactacaggtgcatgccaccacgctcggctaattttttgtatttttagtagagacggggtttcaccatgttggccaggctggtctcaaactcctgacctcatgatccgcccatcttggcctcccaaa

SEQ ID NO: 133839 - DNA, 1031 bp, Homo sapiens
aaactactccataaattaaaatcattacttttgtcactgatgctattgttggtgtccttacagcaaagctaaaagtatgtaaaatagtaaactatattcaagggaaaacttgaattcaaattagggacatcagagaggaaactttcttagaagaagactaccaattagaagcattttccttttcctcccttccccatctccaaccaatgcaagtcatagtgaagccattcatccaaatagacaaatcagagcatgtatttaccttgaatgcttttggacctatgcctgaagaagtgatattatttttactcagatcaagcctttccaaatttggtaatccattaaatgcttcatctgggatggaggcgatggaattgcctaggacacacagcggttatgttttaggcatgtgtgcatatacatacatgtacacacatgtatgggcatgtgtgcatagatatcaagagagagctttgtctggaggagaaagcaatactcagaacaaggacagaatatatattatataaccaaagcatgttcagaaaagtaacaagctggaaatagatggtttaacatagttgacattttctctctaaggattcatcaagctgtaaatatatcatggtttagatgaaggtgcttaacacagccagaatgtggtctgctggagagtactggtaacattgtacatttacaacaaaggtgtggaaggttacacagaaactgatttttattcttcatattttcccatagccattttcctggactagaaacatgcctctgtttttgtccatgaatgctcatgccaatcactcacctcctctgagcctgtctccatctctgcataagaagcttggggagatcatctcccagactctctcagatctaatgttatgcctctacggcttcaatctacaaaggttcctgtatgctttaattttataggtttttgttttaacatttagttaagttcagtagtcaatttttaaacccggaaagtgagcataccagtagtacataccataaaagcc

SEQ ID NO: 133840 - DNA, 1038 bp, Homo sapiens
tctctgcacaaatgtgttgaccttttcagcttccctcaccccagcatctccagggacacccgtggcatgggggcctcattacccagacgaatgctcctgctgctcccagcacccaaagtgtccccaccagccagcctctcacacctggtcctgctgttgttccactcagagccctccctggtggtcctatggaaacatgggcagaaggtctagatgaccacattccctctagaatgtcaaaaaggaagggagaaaacaactgacagtaccaagtgcgggcaggctgcagagaggcaggagctccccagcatgcaggtgggaaaggaacagccactttagagaactgtggggcattttcttataaacttaaacatgtatttaccatatccgcagtcccactcctgggcattgccctagagaaatgaacacttaggtccacacaaacatctgtacgtggatatttatagcaactttatacataatcaccccaaactggaaacaactcagatgacgtttaactgataggaaaccctgccccatccacatgatggaacactacttggcagaagagaggaatgaactactgatacacaaaacaaaatgggtggctttcaaaaacattagaagccagtctgaaagggctatgtattgtatgattccacttatgtgacactctggaaaaggcaaaactgtagagacagaaaacagatcagtgttctgtggtggccagtgactggtggagggggaaacaaggaattttggggagtgatagaatgtcctatatcttaattttggtggtggttacatgactatgtgcatttgtcaaaactcagaactatatactaaaaataagttttactacatataaattatacctcattaaagctgatttttaagaaacatcagtaggaaatcatcatttgatttggaggagtttgctttatacctaactgctattctgcagtaaacagctatctcttctgcaaagtttatatatttgaagattatgaaattagtctattcaggatcaatttttag

SEQ ID NO: 133841 - DNA, 1678 bp, Homo sapiens
tcttaccgggtcctcctcgtcctcctcatcctcctcaccctcctcaccctcctcctcctcatcctcctcctcctcccttccttggcgttgttgctggtgtgccagcctcctctcctctccaggcctctgctttctgtctcctcctctgctgtccccctcactgtaaagttgcccctgatttctagattcaggggtctctctcttttgctctgtatcttcttctttcacttcttcatcctcctcagattgaagtgcttcttttcttactattcggtccattcccacctgaggaggtggcagttgcttatgaagtaaattggtaggttctctttgttctgaagaatcaccagaaaattcatttctatcatttaatgctataccactgagtagagaataggagactaatgaccacgcaaggatgaggtagcagagataagttgatgatattaataaaagaaaaaaccataatgaaaatgaggttagtaaatattattccctccaagtatttgagtgcaatttaaagatgaaatgcaccttgaaattcttgcttaaaaagttttaatagtcactttatttctattttgtaatatctgttacattttattcacctgtgggccttaatactaatttttatattaaataacttaatgcttatttttgctaacatatcatgatacctggtgactaaggagggaataatattgccacatgaggcaaaatggtaagcaatcctgttgtgagattgtgttataatcagttgtgatacctttataatagatactgttctgttcactggggctattgctaatgtgagaatttgcagactgtttaccagacattagaaaagtgaaacaggtgtatattttacttgcttatagcagtgaaaccaacttttgcttatagatttgtcattatttttgtccatggcatcataacatcatcctctgaaattcagaattatagagagagagttttcctccttctctgtcccagactctatacttaaatcatctttactacctgagacttacaaatgacattctggacttaagtgatgttgctttaacttagacatatgcccaggagtgctgtttatccttccatgatggtgggagtagaatagatgatagtagacagttaatctacatttatatttagctgttaagtctttggcagaaagtggggaagacatgacaaagactagattcaaattcactctctgggtaaacagttctaggaagaactgatttcacagtgcatacttttttttcccccccccgagacggagtcttgctctgtcgcccaggctggaatgcagtggcatgatctcggctcactgcaccctccgcctcccgggttcaagcgattctcctgcctcagcctcccaagtagctgggattacaggcaccccaccaccatgccaggctaatttttgtatttttagtagagatggggtttcaccatgttgaccaggctggtctcgaacacctgaccttgtgatcctcccgcctcagcctcccaaagtgctgggattacaggtgtgagctaccgtgcccagccagagtgcatacgttttcttccatcaagatttaaaaatttacttaatcatctgcctacttttatttaacactatatataaactactcccaaaaagaactcaggaaatataattatttgg

SEQ ID NO: 133842 - DNA, 1035 bp, Homo sapiens
tacctgactgaatgaaggacccttgggagggaggcccagtctcctctgagaaaagcctaaccaacaccttatgaaaataagcaaataaatacttgttaaataattggctgggaagggatagggacatcttctcttgtctataaccaaggtagattgctcccatgcacacagatgatcacagggtaggtgtctacaaaagtctccttgccaggaaaaacttttgactatttagaaattgtgttttgcgttatactaccaaatatttcactaatatttaaaaagagttaggaaaaaagtgttcaatgaaatggattccttggagtgaaataaatacaaggtttacaaagtaagagtcacaaattctcagaaattttttcagaagacttggagtattcttgaaatgtagttattttggaaaaataaacttggatatacaggaaggattttaaatgtttcaatatgatagctttagtttccttttactaactttttcctattcttctgcatgttttgctagagatgtgaaaaaataattcacagactttataatacatactgaattgatatctcaagtaatttctccaaataattatatttcctgagttctttttgggagtagtttatatatagtgttaaataaaagtaggcagatgattaagtaaatttttaaatcttgatggaagaaaacgtatgcactctggctgggcacggtagctcacacctgtaatcccagcactttgggaggctgaggcgggaggatcacaaggtcaggtgttcgagaccagcctggtcaacatggtgaaaccccatctctactaaaaatacaaaaattagcctggcatggtggtggggtgcctgtaatcccagctacttgggaggctgaggcaggagaatcgcttgaacccgggaggcggagggtgcagtgagccgagatcatgccactgcattccagcctgggcgacagagcaagactccgtctcgggggggggaaaaaaaagtatgcactgtgaaatcagttcttcctagaactgttta

SEQ ID NO: 133843 - DNA, 1043 bp, Homo sapiens
tcccttcccagccaattatttaacaagtatttatttgcttattttcataaggtgttggttaggcttttctcagaggagactgggcctccctcccaagggtccttcattcagtcaggtatgagcctcattggagaaggggtccatgagcagccaacaaaacccgcgctgtgatctcctgcacacagaagtgccacatgagaaaatcatgcttcaggctacactttttctgcattttcctgggattatccaagcagtgatgtgggttcctgtgctgcctttgagtggttgggtatagccagagggttggggctttgttctctttagatgcaaatcactcttcctttgtttaccctggcttcaagatgataaaggcacgttgcactggattaagtgggataatgcacatatagaccaaagcagagcccttaatgcaataagaattcaggatctgttgtagaaattctgttaccatatctctaaagctgagagtcaaatgtggaatgtaatctcatccaagtttactgaatctgatagagctagaactataaagccacagtctattatttatatcccctaccatacattttcccagatattttctatgttaatcagcattttgccaatattttaagtactcagatctgactaatgtatcataattttaatctaaaattagtaacaaaaacaaatggaagttaaagattaatcacacactgatattttgcttagctaaatctctgtaccagtagcggagcagaccgggcagcattccccttcaggtataactgtttgggggcacctctggggatggcacatggtttcatcacaaagaactcttccatctgagcagaggcaggtagtgcagggctcaggcgaccacacagctttgttgtacatggttatgccctttaccaaacagtgtcccttctttcctagaagaaaacaaaagcacaaatttaaatttcttatgtgattatcagtaactgtgaatggaagtaaacacaatgtgaagtcaaactgctctaaccacacaagaatagaat

SEQ ID NO: 133844 - DNA, 1100 bp, Homo sapiens
attttgtaaatatagtggtaggataagtaatttttgtctaataattataaatgtgttccttaagttgtttttggttttttgggggttgttttgttttgttttgttttgttttgtttttaatctcgagacggagtcttgctctgtcgcccaggctggagtgcagtggtgtgatctctgctcactgcaacctccacctcccaggttcaagtgattctcctgcctcagcctcccgagtagctgggattacaggtacatgccaccacacccggctaattttttgtatttttagtagagacggggtttcaacatgttggccaggctggtcttaaactcctgacctcgtgatctgcccacctctgcctcccaaagtgctgggattacaggtgtgagccaccgcgcctggccctattttttaaattattttaaaatgtatgtttgtagattaaaccaaaaagtaatataataacctggatttttctttagaaaattatcttcatggagatgttctccctctctccctctctccttctctttccccataccatctctcaccctcctccctctttctgtctctctctcatagtgttctcttacctggtaacacattataacttgattctactccaggaaaacttgaaaaggattcaaacttttcctccatgctataatcaaagttaacaataggaagtcttgctactggtgtaaaaactgttgtttgctgaattccaagctgtctgtttgatctgtgcttgtgtgaggttgaacttttcctcaaccttctgtggtagatcttcctcctttgcttcctaggaatttcttcattttttccaaagtcagtttgaaaaatgataagcagaaaaaaacaaaacaaaactgcaatcttcatgtttgatttttttccaccagccaatttctagaatgaaacaatatttcaaagttagtggtgactaaatttttacttctgaaaattggcttatatatttgcttgtatgcctcagtaggcaagtctttgagaaattacacttatgatatatggactatatgctatagtattattgccaaatcataatttggaattcttctatcagaatcaaaaaact

SEQ ID NO: 133845 - DNA, 1049 bp, Homo sapiens
gtttgaattgaaatatactttctatttgctttttatttgtcctacatgttctatgttcctttttctgttttctttctttttaacttgttgcttggtttttattatttcattagtaattatacactttttaccattcttttctttgtagagattaccacatacatccttgacttatcaaagtcttaatataaattagtacctttacctcttcctggacaatacaagaaccaggatgaacttcaactccatttaccctatcccagtatatattctgtttcagttctgtgttttaattatatatgtatttttaaaccctcaaaagattatttttattttgtcaaagtttatttagatcagatttttcatcctcatcactattaacgttttgcgccagataattctttttttatggggagatgccctgtatattataggctatttatcagcaatccgtggcctctacccactagatgccattagtaccttcctcctagttgtgacaaccaaagaatgtttccaggcattaccaaatgtaacccgcccctcaattgagaaccacttgtttaggtttacctaaacatttatcattttccttcgttccttcctatatctactttcttctattaggattattttcttcttgactgaagatcaccttctaataattccttttgtgcagatgtgttgatcagttatttttgtttacctgaaaggatgtatttgttagatatacattctggggttgacaagtgttttctttcagcattgtgaagatacggttgattttttccccctacactttcatttccttcctagcttccagtattttattgttgccttcttcccacctacttttctttttctttttttatttaatgtttttttttttttattttattttttttttgagatgaggtctcactatgttgcctgggctggccttgaatccctaggctaaagcgatccacctgactcaacctttcgagtagctgggactacaggcacgaactaccacacccggctcgaagatacaatttctatgtcttctt

SEQ ID NO: 133846 - DNA, 1114 bp, Homo sapiens
ccaatatggtgaaaccccgtctctattaaaaatacaaaaaaaattagctgggtgtggtggcacgcgcgtgtagtcccagatactcaggaagctgaggcaggagaatcacttgaacccgggaggtggaggttgcagtgagccgagatcacaccactgcaccccagcctgggcgatagagtgagactcggtctcaaacaaaaaaaaaaaaaaaaaaaaaaaaaatatatatatatatatatatatatatatatgctttgggtccacttcacttttcctaccatcccccactgcttgcttgcctccattttgtttgtttgtttgtttctctctgtcctcctgaggctgttttaaaactctattaatcttctcaaccacctcttctggaatccagatgcttctagaagaaaaactgttctaaacctctctgggtttcagtcccatcccaaatattggccctgttgtttttctcaccctttctagttattctcagcaggtctaatgatctgacttgccttgtctgccattatcagaaggagaagctccctcagattccttttatttcttgcagaaatatatcctctttttctcagagaatgttgtaagttgtaaaattctgtgctcttattaaagatctgaaaatgtcattgtttaattggaaacagaattacggtttcaaaatcattctaatcatttttctttaataccttatagatatttgtccattatttcttatatttagtgttgccgatgagaaatttgacttgaatctgattctcatccctttgtaagaaattttttttctttctatagaaatttttttcaaattttcaacatatctttgatatttggaagttttaccttggtaaaagaatggaatgtaccttggtataggttgtttttgctgtttaatgtatccttcttgggatcttttaaactaaaaacttctttttttcctatacaagctctcttcactctgttttctcccatgactgttcaagggtacatttttcctctttaaattcatttctgtcttctctttgtctgtgaaggactcctcagagtgtctgtcccaccaggagctcccctttttatttcctagtgtagctgtatattc

SEQ ID NO: 133847 - DNA, 1077 bp, Homo sapiens
caagagttaaacagttgtgaaataaaatacccaaatattaaaaccattccacatgctaagtagaaacttaaaatttaaaacttttttacctggagatctaaactaagtaggctttgcttggtgtcatttaagtctccagctgaaaatgaaacaaaatcagagctttctttaaaaacaaagaaaggacagaagggaatgttgaaaagtatttgctgaacttcttagtaaaatctaaaataactgcctcccttggggataaatgcctttcagttctttgtgcagaaaatcagccaagaaagtaaccagggaaaatggttaccaagggaaatattttttttaatcataagaaaagtagaaaacagcagtgggtgtgggggaagagcattttgtttgcaggctgaaaaggcagagttggaaacacaaaaatgagcttgattaagaaatctgtggttttcatagactattcgcattaaaaatgttaaagtttatactagccaggatgatgtcacttgagctttatcagattatagggatgatattctcgtcagctaaaggctgtgtatatctggaatctattttaaattggattaataatatttaactcatctgcccacccacctcgatctcacacacaatactaacaaaacgacaacaacaaaaaaatggttacgtattaatatcagtggaaattatgtaacttctaaccatgaaataatagaaagaaaatgtgaaagggagctgtgtggctcctaattacctgttacgctggcaaattagttgtgtactttggcctcagtttctttatctgcaaatgagaagttagagacagatcaggattccaagcgcaaccctgctgtttatgagggaccttgagtaagttacttaatgtttctgaccaaagttcactcttctgtaaaactagggtgatacctttcaaatttttctgaaaataaaaggaataacagatatgaaggtcctaactcagtgcctatcctagactaggtaattttagaactattttttaaattttttttttttttttgagacgggagtttttgctctgttgcccaggctaga

SEQ ID NO: 133848 - DNA, 1064 bp, Homo sapiens
gtttatggagaaagataatataatccattctgtggatcaaaagagaaacctgagctagagatataagatccctcagtatgtgtgaatggtactgaagccacaaaactgaatgagatcatagaccatgatttataaccaggccatctggcaaggtttacagaaattacaggaaccaaaataagagaattttaaaactctccaaaataagcactttcacacattgttgatagaaatgtgaattgatagactctttatgtaggtcattttatcagcctttactaaatgttaagccattctacttctaggaatctgccctacgaaaatgtttgtagaaatgtacaaaaatctcttacatgggtattcatttgtagtgtataaagtagttaaaaaaattacaaataacccaaatgattatcaatagaagattggttaaatcacaatatattagaggattctggggagatggcagagtaggcagcaccaggaatctatctccctacctcaacaacaattgcattggcagaatctatctgatgtaactattttggaactctggagtctattcaactcttgcagcttctacagtaggggtgtccagtgttttggcttccctgagtcacattggaagaagaactgtcttgggccacacataaaatacactaacactatgatagctgatgagctaaaaaaaaaaaaaaaaaaaaaaaaaaaaaatcataatgttttaagaacgtttacgaattttgtgttgggcctcattcaaagtcatcctgggctgcatgcagcccacaggccatgggttagacaagcttgttctacaggaagactaggtcagtaaattgtggttaattctggtcaatttcagctcttaacaaagtagtagctacccagccccagggcaggcagctgtgcaccagttcctggagtaaactgcagacaatttttggggggccagcactatccttcaaatatcagagatttgtgctctgattgctatttctgatcacagagatacagacaaagaggtaggtgactactgttgtaacttccagaggatgtaaacg

SEQ ID NO: 133849 - DNA, 1008 bp, Homo sapiens
tgattgggtcgtcttgggtcatgtgtccatccttggtctcatcaattattatctgtgggatcaagatcaaattgtacaagcatggctgggtggtggtgatatacactagtatagagttaaacatattcagcagaagaatattcatgtagactaccctataaaaagcctttgtaacaaacagaaaagttagtgtttaatataactttattcagtcaacatgcatttatctttacttcctgaagagaacatcctttgtattgttggactgctttactgtgtaacctagtgcaagctttgtacctattaatctgtcggtatgtattggtttgattattttctgtttcattcacttatagcatatttgtaaatgcttacaggaatcttgtaggttttaactctatctcacaagtatcattcttaaactaatatatgaggttcaaagattatgggtgctttatttcattcttagcatttttttctgaatatgtgcttaaattacagaggagtggggttttttttttcttcttttttggagggtagattaaaaccattagctatacttaggcatagtcctcagtggataagagttgttttgctttcaaaattttcaagcaggctttagtgaaacaaacaatattttcactatgaaatcaccagcatgctagctggaagagctgtgccatcatctgtttatggtggtatgccatttggtatctataattcagaacagcaaaggtaaaatttaaatgtttgcatactgaaaattacttctctatgtctttggaaaagagtattagcaatggttgggcatgtagcaaaaaccaagctttctgtctatgagttgatggctctgcttagttcagtttcttgaaccattacaagccccatgcaagcattgtgctgtctgtcaaatataaccaaaggctgaatgaaaacactgggattagttccacttcctcagaatgtgtcagggacctggccacacctcaccccagccatcccccagtc

SEQ ID NO: 133850 - DNA, 1015 bp, Homo sapiens
ctttacatttttacctgcacttgatattgtctgttttgttgattacagctattttaatgggtgtgaagtgattctcttatgcgtttacgaaagatttcaactaagcattatacagacctattttttatttagagctcttttattttgagcttttaatgatagttcaaattgttgttgaatgcctttttaaactactttatcttacaaagtctagttgtaatttaaattgaagataatcatatgttcatatttcctgactctatcagtttttattcaccctttaattatgatgtttttattatgtttaaaatattgtattcatctgaaaagctcaaactacacagtatcatccctgctcccccacacctacctcccaaaaagaggtttcattgtttcttcgccccactttataacaacatcagtcacattcacatacaaaggatgtggaacagaaaagacccaaagagctttgcaaatgctcctggagggcactggcaggcactggttgagcaagttctctaatggtgtgtcagtggtgaggtacagttcaacaaagagttttcagaggctttaattatattaacacaacaaattgttaactacttgttctaaggtttttttcaaactttaactttagtttcttctcaatgcattctcttgctttataagacactataaaacacatctggttagcattcagcacttatggcacttgtaaataaagaatcctctttctattacaaatgtgtgaataaatgctatgcttaaagatgtttgatttttaaaacagtgtagaattcgtatttgtctgaggccgaagtatgacttttaggaaattggaatctgtcctttggctattttgtctttaagaaagaagctgacagcttgactgtcttggcccacactccctgtttccatttcctcctgcgggccagggctgcataatcaaagttagacagttgttatgcaagcttcctggtctcaggggcccttatccctgtccagcccttaaaca

SEQ ID NO: 133851 - DNA, 1013 bp, Homo sapiens
gggcgtggtggtgggtgcctgtaatcccagctactcgggaggctgaggcaggagaaccccttgaacccaggaggcggaggctgcagtgagccgagatcgtgccactgcactccatccagcctgggcgacaagagtgaaactccatctcaaaaacaaaaacacacacacacaaaaatgtctttttgtctgctcttgtgagaacagattgcagggtcaggggtgacaggagactttcacggtaggctccgcctgagatgtcgagctcctagggctagtctctgagagacgtgctttcctttctgtcctctcacagcgactgatatagaagcctgggggtgctgcttaagtctcatgcaagccctgccatgattaaaaagcactgtggcctccccaggccttagggaaggatagtgaggggacgttttccctgagaagcatctggcctgacagctagtcagaggacacaaggcaagggagcaggctggaactgcagtgacagggccttcctgctgctccagagacttgccggattgaaccagatcagctctgctgaatgaggttgtgtggggacaatggcatgacaaagcttttaaaggaagcagcccctgcatcgctgagctcttgccagtgtgggaggccctcaccctgtgcatgtgggcccagcatggcaagggtgcatcgcagcaccagctgcacctgccagaggctgagaggggcctggcggaagcttacaattactaacttcagcacaacagtttccataagaaaatgtatacctaagtgatttaagtggaaagtgttggttgatttttaagccgcaggctcttccaaattaatcacaactgcatgaggaccgtaagggagagcctgtgaacgtggcagctcagcttccaggctggctcagcggcagcacttgggactcattgggacggctggggcctgggccagctccaacgtggggcccgaggttcagcctccaagcacaagggagcagatggagcagctctctgcct

SEQ ID NO: 133852 - DNA, 1033 bp, Homo sapiens
tggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttg

SEQ ID NO: 133853 - DNA, 1016 bp, Homo sapiens
tgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaaggtcaatgctcgcatgagtggtgtccatcctgacctgagccttgcgctccctgctgccctgtgtggaactgtgggcttcagcacctccacagggaccctgagtctacactgctcagaatcggcatctgcgcgaccacgaggtcacgctgtgcagcagggaaccacctaaaaacctgtgttgatatgtggcttgcactgaaaaagtgaccatgtaactcagctgggggaagttccagtagtatccatgttttcttaaaagtccaaactgtaaaatgtatgt

SEQ ID NO: 133854 - DNA, 1101 bp, Homo sapiens
cgcacagatcacaggtgcacagaacgagtgctctttgtgagctggggtgtgaggccattcacttctcttttaaaagagattgatttatctaactttgcagaagtcaaagaaaaaacataaaaacatactagttgaaagaagaaagggagagagaacgggagggagggaaatgaatggggggcttgtgtatcctgaaatggtactttttacttgcagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgag

SEQ ID NO: 133855 - DNA, 1081 bp, Homo sapiens
gtctgtgtctgttgcttgtctgtaaagtgggacgccggccgtgctgccctgttgggctgctgtgagggtggagcaagttaacacatgcacagcctgtagaagggtggccgtctgccgttgtctctggtggctgtatgatgttccggagggaatgtcgttctaagcgatgccttgctgaacaccccctgcgctctccttgcaggtgtcgagtgatactcacttgatactctgagtgtggccaacatgcggggctcaggtggcttactgcttttccttccaaaggccgactgtggtgaccttgctgaagacagatcatccgtctcagggtctggagtcggggtcccacactgcttgccgtgagaggtcagggggcggtgctggcctctgagcagccccgtggcactgagggctggcccaggtgctctcacagggcgacctcctgacgcccgtgctcaccgtggccctcgctcctaatcccaccctcaggttctgaggcaggaagcagttcccacacttggctactgggaaggaaggttgtgtgggggggcagaggcttcctgtgtgacctggagctgatctttcccgcccctgcaggtgcagcagtaccgcgtcgccatgactgccaaggactgctccatcatgattgcactgtctccctgtctgcaggatgccaggtgaggcccccactgcaaggcatgcagcctgggtctaacggggttttatggacagttggtgaattgttaataggatagttggtttccccatatttagagactccatggcggagtgacataacttccttggcctatgtgacatcatggggcttactaactctcgccctctagaagcttgtaattcagtcaaaagacagatttatggagaataacttaaaaggattgttagtacattgaaagttactgttttctaagaaaatactcccaagagctcagaaacaatgtggacagtgagctgcccattgcattccctcaaagaaagccagcccctgagatgtgtgggtacctgtggcccttgttcctcggtctcccacagtggcagcatggcgcacctgcctttttaccac

SEQ ID NO: 133856 - DNA, 1187 bp, Homo sapiens
tggcaggagatgatctgggacttggtacctcccaagctcacttggcaccctgtacagcacaggtgccaaacaactgtgagtggcaagtggagttttgtttctgcctctgtccctatgatataacaggtccttgtcagtggctttgacccctgtctgtggctctgtgtggctggttctgagctcgtgcctgtcgccagcccaggtcttacctgcctctcagtgtgggctcatggctctggactctgcagacagtgtcccagggttttcctcctttagtggtcttgcagatttaggatgtcagcaggatcttagaaattccttgccttgcagttgcaatgagtcgagatcacgccactgcactccaggctgggccacagagagcaagactctgtctcaaaaaaaaaaaagaaaagaaaaagaagaaattttgtgacctgacttaaaatgaggattatgtctaaacttagatcataaagtgacttccagggctgttgtggtggaatctaaaggacattctgagagttgtgttgggagaggagagccacgaggcaggacatgtgcatttcttgctccctcctttgtgcttggcctggtgcatccagtgtggtccaggcacgctgcagctccagcagctctgtgaggcgggagcgtcatctcgtctgtccttagtgccagtccagggtgcagtccttgcctgtggtgatgcccgtatggcggagcccaggatgagccctgcggtctgcgccggcctgtgtctccctccacgttctttgataatcaacatgctctcgttttcccctgatgttctcggtaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagaggtgaggtcgggcggtccccctgttgggcagccctgagaggagactgtgggagtgggcagggtaagaatgcgcctcccaaggcacagcttcccaggaggatgaagcatgccggccacttcctaccccagtcctccgctcccaggtgcccaggcctgctctggaatgtagtgccttgtaaaggaggaacagggtcacttgtttctagaaaagaaagcacgtctg

SEQ ID NO: 133857 - DNA, 1122 bp, Homo sapiens
caaggctgaggtggtccggaaggggctcagtgccccagacaagtgcatgatccagatctgaagacacctaggagatggaatgacaaaccaaacctaaagtgaccttcataggacaggacactgagccaaaaccaacaagctgaaggcgaaggaggcaggcgcaggcgtcacacaggagagaaatcctgcggcagtgcataaaggggcaacctgtggacttcactaacctgagatgtggccactggcccaagtactgcaccttcaggctgcagcgaggaaactgtgcccagatgggaagttccctcatcaaggagcccccacagggtcagtgtctggagctccagacacacaccagggaacatgccaggctgccgagagcctctcaagcatgccacagggtccacaccacatgaggcagagaacaccatggttacctgtgcctgggaaagttcaggtgcacaaccatcccaaacagaggcagaatgcaaactgacaggcaaaatgagaatcatcctgggccgtctctgagtggaagggccttggggaagctgaccaccttctgtcaggaacacctttaaacgcctctctatggctggcctgctatttaccttcctgcccaccctgggcacaacctcccaccctcctgtagcccacacctagttcctccatccccaggcctcatttcctacaagtcctgcgctgcacagaaggctctctctcatcccatgtttgcatactgcaggaagaacatcactgtgctccttctagtgctgacagccaatgaccatgcagatctccttacctaggccctcggctcctgcaggacgagctcaggctggctgaaggcgcatcatgttctcatggtagaggggatgggggtcagcacaggactcattagggacctttcaattctgagagaagctgatgtcctctcagagaaagcaaccctctccttacctggaaaaacttggcaaaggcctccctctctcttggactgaatgaggtggatctaaggagtacagtagcagggtccacctgctcccacacccggctggaaggaggctgggcgcatgctcagcatccacaagaccacggactcctcctattctacctcacccatct

SEQ ID NO: 133858 - DNA, 1050 bp, Homo sapiens
ctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtat

SEQ ID NO: 133859 - DNA, 2012 bp, Homo sapiens
gttttaggaggttccagcctgcagcataggtacgacctcagaggatggctttgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttg

SEQ ID NO: 133860 - DNA, 1050 bp, Homo sapiens
acttggtaatatttgtgaatgacttaatacaaggttggcagccttctatggatggatgtgtgttgttcttggtgcatctccacacgtacagtcctggcttggggccacctcagacatttgtgctccccttgctgtgtctgctggtcccagcggtgggtgggctgggctgagcatttcattgcattcgcatctcatgccctggaaccttcttagcatccacatctctgagcagaggaagcagtcttggcctggacgggctgccacccttcccaggatggcacctcacctggcgcttcatcttttgcttcatagtggccggagttggtgtgctggtgtgttttcttcatttatggggcctgaaaggagcttccacattgcattgatgcaagagcgttgacttctcttcccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcaggtgagcaggcagtggggccttcggcacgctgtccccactccaggtctgcagggctccccgagcagtgcttacctgacactctgctgatgttaactttcccttttccttacgttgattttatctcctgcatcattacggtaaatggaactccaggagcacacatagaggagtctcagagaagtgg

SEQ ID NO: 133861 - DNA, 1174 bp, Homo sapiens
caagaagttgcatgtagtcagcttcccagagctgctctctgagccctgtcaaggtgtgatcattctggcttttgacaccaaagattatatcttgcctggttttgacttcttatagatggagttgcaccgtactttttttgtgtgttcactcagcatcgtgagactggtcctcattgctgcttgtatttgtaggttattggcactcgttgccacatgggattcatttgtgtggatataccacgccttcctcacccactgtcaggtagaccgaccctggggttgttttcagcttggagctgttagaacgctcatggggtggctgttgcctgtgtctgttggatggactggctagggtgacatagggcaggctttcttctagaggagcacagcagtgtgtggcgagctcctgtcctctccatcctcaccacgggcacttgatgtgttactgatttatgtactagccattctgatcagtatgtcacagtagctctttctggtgtaagttgcattccccatggaccttttcctgtgtttactggccacttggagagcctcttttataaagagccttttcaagaccttcttccaatgttcttcttgggtgtctgtctttttctcatgtacgtgtaggagatctttatatattcaggatatggagccctttgccatcaggcagtagttctgacccagcgatgcagcagaaggacccagcatggagcaggcagagatggctctcttccatctgtgcttctgccctgtcacaattttggccttttggagccttagtttcttcctccataaaatgggaacatgggttctcctgagaactttgagataggcgttaagtgaaataatatacttaaggagacttatagagtggtggctattattgttactaatacttttttaaataaaatggaaagaggctgaacacggtatcttgtgcgtataatcccagcacttttggaggccaaagtgggggctcacttgagcccaggagttcaagactagcatgggcaacatagtgagaccccatctcttaaaaaaaaaaaaaaaaaaaaaagctggcatggtggcacgtgcctgtagtcccagccactcaggaggctgaggcaggaggattgcttgggcccaggaggttaaggctgaagggagctgtgatctcaccactaca

SEQ ID NO: 133862 - DNA, 1050 bp, Homo sapiens
aagtggctgaacctcccgggcctcacttataaaacaggcatcataatagaactgcagcttgtggcaggaatcactagattaaggcacgcaaagggctcagtgcatttgcccaaacctggcctttggttgacgtccatagcttcaattcgtataaggaaaatatgggggctacagaaggtggggtcatagaccgtggggttgcccaagccaggggcgctgttgtccatgtttcagcaaaacagatgtatttttctctgggcgacaaaactcatcctaaatgcgactgagagccctgtaatgtcccaggacagcttgaccgctggggtgggtccccttccactgtcccaggctggggcgctgcgtctgggctgcccttggcaccatccactcctctctcgcccacagtcaagtacgaccttaacaacccggccaagcacgccaagctggacttcctcaacaacctggccacgggcctggtgttcatcatcgtggtagtcaacatcttcatcacggccttcggggtccagaagcccttgatggacatggcaccccagcagtaggacacccaggtgagctgggagatggggcgcgaggcctgcagtcctggggttgctcgctgttggaggctcttgcagtgtggtgagtccctggccggccagccttggacaccttcctaggccatgggcatcctcgtccacacctacaaggccaatgcctggccactgccttgaggccagccctgccactggtgctggccacctggggtcctgtggtcacagtgtttagatggaatgtgtgtaggagccaccatttgaacatcctggagaactcacttaaacgtaagatttctatacattcagaatgtctgtccgataaaaaaaaaaagatttctgggtcaggcgcggtggctcatgccggtaatcccagcactttgggaggctgaggcgggcagatcacttgaggtcaggagttcgagaccagcctcgccaacagggtgaaaccccgtctctactaaaaatacaaaaagtggccaggcatggtggcacatcc

SEQ ID NO: 133863 - DNA, 1019 bp, Homo sapiens
cgcccgcgcttggctgcacggcggagggggcctcggcgcagctcctcgggctaaggactgccggcgcccggctttcccgacctcccccccactctcgcgcgggcctctctaacttcagcctcgccgtgccggctcctccgcgcactttgcccggaggcgggcggaggggagtcacagcctccgggctccagaccagctgcatgcagacagttacgtcaccccacgctgaccacacaatctgatgcgtgccttgatgggggaacttggggcccgctgtggtccctattccactcacctgccttgagaaatagaaacgtcacacagccttcagtgtatgccgccaccggccctccagaacttgccctgcccggcctgggagggctgtgggcagggggcaggccctggtagtggtcccgcttcagaattcttcatcccaggactcagcacttactgagcaccttgtgtttgttgcaaggtcctggcatggccctctggtgacttgtttactttgaacattctttccttttctaaccccctcagggatgggggcagggaacagcagcctgttgggtttttccaggcctctccatggcgtggaccagactggggcaaagacactctgcccactcgctggtgaacagtcctaggccggtgctgtggggacaggacatgttcggggaggcggggccccatgagccacgggataggatggccctggggctgcatggacacttgttcctaggttagagaggagctgtcgcactgcaggacttgaccggtgtgcgggaccccagcgacctggccctgccccagtgtgtgagcactttggagcaataggcagggggctcctccggctgtgtgtccttgggaagttgccacacctcgctgggccttttagacatggtcttataaagagagaacaaagggtctctcctgccttcagggaagtggggaaagcaagtcaggtaataaacaggtcagtggcttggaagcgccttggaaaggaagggatactgctc

SEQ ID NO: 133864 - DNA, 1102 bp, Homo sapiens
gggaaaaacacaagcatgctatgttctgaaattcacttggtggaatgttccgtcagtcactgtgatatggtttggctgtgtccccacccaaatctcatcttgaattgtagctcccataattcccttgtgttgtgggagggacccagtgggagataaatgaatcatgggggcggtttcccccatactgttctcgtggtagtgaataaggatcatgagatctgatggtttaatatggggaaacccctgtctcttcgctgtcattcttctcatgtctgccaccatgtgagacgtgcctttcgccttccatcatgattgtgaggcctccccagccacatggaactgtgagtcggttaaatctctttcttttgtaaattgcccagtctccagtatgtctttatagcagcatgaaaactgactaatacacactacacactgtaaatgttagtcatggaggatgtgtaccaacatggaagagtgtttacaatgtatctttagagaaaagatggactatccaagtatgcatactggaattatcattagattaccatacatctgggtgaggagcagaacagagacataaggtgagtttgtgggcaaggttttctttttaaacttcccaaaagcttgctttacatacatgtaggcttaaataatttttttttgagagatagtttcactcttattgcccaggctggagtgcagtggcacaatctcagctcactgcaacctccgcctcccgggttcaagtgattctcctgcctcagcctcctgaatagctgggattacaggcacccgcctccaagcccagctaactttttgtatttttaatagagatggggtttcatcatgttggccaggctggtcttgaacatctgacctcaagtgatccacctgcctcggcctcccaaagtgctgggattacagacatgagccaccatgcccagccaaataacatttttcttattttaaaaagtaagttcattgtaaaaagtttagaaaacaaaggtaagaaaaaaaataattctgttgcccagaaataaaaactgtccatgttttgatattgtatcctcagtaacagcaaccgtgaacctcagaggcagcc

SEQ ID NO: 133865 - DNA, 1041 bp, Homo sapiens
tggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggtgagggtgccccagcccgcagggggctttccgcagggtctgtccgcgagtgcgtccttgggcctgtccttgctcctgcgcctggccttaagaagccctgggggcggcggggctccatgtgtgtcaccctctgtgtggatggctggcaggatgcataccaggtgtgcggacggcatgtggggcctggctgtgtccgtgcgcaggttgcggtttgtgagtcagctggtggcgagggcaggcctctgttgtgcgtttggtgtaagtgtgcacgctgtgggcgtagagagggtcctggagagtgggcctcggaggctgtgtctcttaggctgctgcttctccagtcccgatgacctactttaatgacccaggga

SEQ ID NO: 133866 - DNA, 1015 bp, Homo sapiens
gccgggcacagaggaggtgcatggcactcacttactggggcaagacaatcagaaggcttgacccgatttggctggtggtcaccccttttaaaaattctctgaagtgcttaattttattgggagagttgtaatttgaaatcagttggatgccagcactgaatttgctttcctgggcgagatgttttctgcaccatgctgaccatggttttggtttagctggcaaaaaaggctggcgctagctccctgaaaggcctgtgcagacggactttccctccctcccaccggggcagaaatgtgggcgccaagctctcagtggtgcttctgccccccgagtggtggtggcgaggtgtgtgtcagcagcgatgacagacagcagcctgtgcaggtcaccgtcatgggggacacattgaggctgaggcaccacagcttgttttctactagaagcaggtgctcctgtggctcagtggtgccgtgtgggcgcctggctgagctgaatcaggaccaggccaccatgggactcgagcgtacctgtgctgctttctgagccccagagggaggaccccagcactggctcagatgtgtggagggccagcccccacatgccatttgccattgcaaatgatttgatttgccattgccaaagcttgtgttttctcattcctcgtcagcatgttaggaggtctgccagggcagctggacatgccctcccgcagcactggaaccttccgtggtggcagaaacatcctgcctctgcatttgtgtccacaggccctgcggagtgcctgggatgtggctggggcagctgagggtcagtgttcttatttttcctcacattaaacgtggacgcaaatgtccacacgtgccctggctgcttcacgggtcacccgcgtctccaggcttgatcttgggccctcctctaggcggctgcttttccagaggatataacagacccaggtgacctagaggtggccactgggacaccagacagacccagatggggacagtctatagacca

SEQ ID NO: 133867 - DNA, 1045 bp, Homo sapiens
ttcctccatccattctggtacagattttccagttgagcatactacctcctcctcaccccttcatttgtagaccaatgttaccggtgactggggaggcttgaggagcactgggctgggactgtgcactttggtagcaccttacccacttcctgagttcagggcatctgtcagcacagatgtgtcagtgagcagacggccactgtgtgggaaggccagcaccagccttcatggggagtgggcagcctatgtgcaggtgggagcccctggaccccccaggtctggagaggccattggccccagtgggtggaggctggcactcaggcttagccctatcctgggcccccttgttcctgggggcccaccctgctggccagcctctgtcatctcccccatcctgctggtcagcccctgtccgtccctgcaccctgtgcctggcccccactctgtccttcggcccgccccgcggccggctgtctggagcctggtctccatagcaacagttgctgctgtggaagctggcgcccgctcagcctcatcccgtggggaggtatttttggcactgctgagggattttattttatctttggtgttgacttttactctttgagtgacacagacgaagctgggggcagcctttgagaagcttctctctgggggacgtggtgttaaaggcctttcttcgtggccccttgagtgcagggtcctccgaatgtcttgctgctggggacactggctctgtgtgacgccagtgccttctggcagcctctgggccagtgggtctcaggctccagacgtactgggggctttggatggcaagaggaaaatcaggggtgggtttgagcctcaggtaaagccaccagtttggtggggacacccctggaggcaattgttgttgagtgctggctgtagcctagaccccgtgcggagcctcggggcacaattttatgggatcctcctgcccacggcccattttatagatgaggaaactgatgctgcagagggtggtgcctgaggggcatgcggggtacagggcatcactgatgtc

SEQ ID NO: 133868 - DNA, 1112 bp, Homo sapiens
aggagccggaggccgaccagcacctcctgccacctacgttgccgaccagcgccacctccctggcctgtgagtgctcaggggtgggatggccatgggcacccctcccacctaccctgcaaaaaccagctattgggcaaagaaaaatgaagtcctctccctttattggaatgctttgtgaggaagggggtccgcatggcatcccctcggaggagacatcgtgtagctctgagctgtcctcacgtagcgtgggtgattgctttagctgtaggtagtttccgggagtcctggctgggcacctatgccccgtgacaggctcgccttctgccagcacctttggtgccagggcatgtcgggaacttcataagagagcaacttccagggtggtggggccagcagacccaagcactgggatgtgcagggcctgattctgtgaccagcctgggccctgtccccccagcccaccatgcagggtgtggaccctaggtatgggtgagccttgtttcagtgaagggattggggctttctcagcatttcccggtgatctgtaaccaggagattaaggctcaatgaagttcatgttctcaggacagatggggacaaatgggccgtgagccagcagggtctggtggagccagttcagtcccactctgtgctatggatctgtggatttagggcaggttccttaacctgtctgagaatgacagttctggccccttggggggaatgtgaaggccaggtgaggtggtggcagtggctgcttggtgggacatctgtcctaggaacagagtgtgctgcttgctggcttggcttgtggtgttgccgtggggacctcccatcccccgtagtatctcccttctaaggcagaacctttgggaccttttgtacattttcagtagggtgttactgatgaattggcaggaatcactttggatcaggtttcatctaagaccatttagggaaaacctagtatcttctgcacatacaggcagaaaagtttctgtctgtgccctcaacatcctaagaattcagcagtgagctgaggactgaggaacatggcattgttcattctgtgaatatgcatgggatagaatgacagagccaagggacctgcc

SEQ ID NO: 133869 - DNA, 1050 bp, Homo sapiens
cctgagggctctaaattctgtgatgggctgtccaggctgcactgcattgtggtcagcattaaaagtggcctgtggtcagtgtccagccacacttcccctggggagacattcaaaagccaggcccagaggaaagccccgtccttgctgtcagctgcggaactgctggccgagtagccctgacattcctgtaaagacctactagataggaaagacaccctattggaaaacagaccccagggcacccagaatttgggaggctatggtagagctgagtggttccccctggggagcgggcacagtgataatggtgacaacccacagccacaatcatgatacccactgacagtgccctgggcctgggacattatcccagactgttccatagatcacagaaaagcatcatttgtacgaaggaaacctgagattcgatctagctgcccagcctcctgaggggctcctggcacttctctcccagatattgtgtagcggttaaagtcagagctatgaaaatagggcggggatgaggggaacactttcagggagcacgtgtggcaaaggagtgatggaacctcgggctgtgacgacacgtgtgggttgattcccacgggaaagactaagatgagtggggtcacatttggcacttatttttttattttgatttttaaaaaacactttagaaagcaaaacaattgctcctcgcagtcccaagtgcccagccacagaggggttgcccatgagccccaggcagtagattggtaccctcagagcgtagtttgtttatttatttgtttatttgagatggagtcttgctctgttgcccaggctggagtgcagtggcgtgatctcagctcactgtaacctctgcctcctgggttcaagcgactcctctgcctcagcctcctgagtagctgggattataggcacgcgccaccacgcccagctaatttttgtgtttttagtagacaccaggtttcaccatgttggccagcctggtctcgaactccggacctcaggtgatcctccctcctcagcctcccaaagtgctgagat

SEQ ID NO: 133870 - DNA, 1013 bp, Homo sapiens
cttcaggtgaatccagaagcccagcttgatcccagatacacttgctccaaccactcacaccatgctgcctttcataaagcacccaccgcgaaagacaagtgaggagggcagttttgggcatgccatcactcacgtgatccagagaaccccacgggagagaacgttcatggcagggtggaagagccatgatcctctgtagccctgcctgctcctcacattctcgttgttttgaaataaatcctagacagcaagacacttcccctgtaaatgattcagcctctggctctgcacaataaggactctcagagaacaaagcccaattccattagtacaccaacaaattaacaaattcgcagcaattcctcaatggcagcaaatacccattctgagagcttagatttcccattcttttgaggtctgtgttcactccgccgctggagtgctcacatgctgttccagggcccgtttctctccatatcgtctgtgagttatgtataagttttcatcttacatggtcacagtcatatggaccgtgagcttccccagtttaatgtcctcgggagcctttctgtatggttctgcagagcctctgtgctggccttttttgtggttgtgtaatgttctgtggggctgatgtgcccgggcacccctgggctgggggctgtgctgttcctggcccttcactgttgtgaatgatgcccagggctccctcactgcttctgctgtcatgttcctgggaagagggaccctggtagggaccaggcacagggatgacatgaggctaccctgcccctgcccaggagggggcctggtggccgagagctgctgctgagtgtggccctggtgctctctgcagcctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagg

SEQ ID NO: 133871 - DNA, 1036 bp, Homo sapiens
gggctccttaggaatctgatttgggtgttgttcccttgtgagtttccacatggggtgtgcaaaggagacacgtgtacatgtgcgggcggccccaacctccccagaggctccatccgctgctgccaccttccccacggcgcataggtctggctcatgccctggcctacccacgagtttcttttgtcacatgagggtctcagctcaggcgaggcccccatgtcagcttgcttggcttttctggttgcctctttacggcaaccctgggaaaagctagtcagaaagagctccctagatggagagcaccggaatagctgcaggtgcagtgggtgacagtttttgagacaccgtgggagcagggctggaacccagccccattgatctgcgctgtgggaccctctcacatcagacgatgggatgagacagggtgctggccttcaggtgctcagagaaggcctggctgcatgagggtgcccggggctgacgcctcttctcttgcccgggtttattgggcatctgtcatagaatgccgtggggccaagacatcatggagtatttttagtttccaaaactgctgtttccaaaactgggaggagcacacacagctggctcctcccagtacccacttccattgtcctgcctgtctggaggcactcccatgggatcactttgggctgcttcgggtcagctgtgagccatctctgcctcttcctcctccttcagccccagtaacgtttctgatgttcccatagcagagtcgtctcccaggagtatgctaggctatgacagagatggaaggcaggtggcctcagactcccatgtggtccccagcgtcccccaggtaagggcgacttgacgaccccctggctggttggcagggtttgctctgtgctgatgttcacatgaaacctcttcatctccgcttgtttcccaaggatgtacctgcttttgtgagacctgcacgtgtggagcccacagacagggatggtggagaagctggagaaagctcggcagagcccccgccgagtgacatgggcac

SEQ ID NO: 133872 - DNA, 2105 bp, Homo sapiens
tcagcccctagatagaaaccctcgagtcccctactcaacacttgccgctgacctcatctgaggcagccatctgagatccagacttggcctccaacctgcaaaacaatgtatctttttgcacttggaaaacctccgatgggcttcggcggccaagcccagctgtgcccagctccattccagagctcccgtggccgactcagcagggtgtcctgcctccatcagtggggctcccagaagcctgatgtttgaaagccaagcggtgtgctttgcttttttcttttttcttttcttttttctttctcttttacttttcttagaatatgcttctagagacaaacacttctccctgaagcttaggggcttggccctggcacctctgccccctcggcgaagctcgtgggagcctgcaccctctctccaggggctgccccgtttcccccggccgggtcggccctctctctgaactgctgcctgtgtctgcccctccctgcacactgacgacttttgcttagtgtggtagcgtgtcccagtgtgtgctgttctgcctaaccctgtggtcttgtgtcgtttctttttcccttgcagggtctgccctgaagcgtctctgcctaggcaaagaacacagcagtagtaattatccgggttttttcccctttgtcctctctcatcgcatgggctttctcgtggctagcgcacatcagggttcccgcggccgggcgggcgtgggcctgccctgtgcctgccccgcgcctgctccatgcctctcggccgggcactgcttcgcttctgcctggcgggatcgctgtcctcggctcccccgtgtgtctcgtggcgcctagagtttgtgcggtctcgccagttcacatctaacgggcttatccttccccggaacacccgcaaattgccgatcattaattggctccttttccaaaaccgtaggaatgagtatttccttgaagtcctaaagatgagtgcctccccacgaggagagatgccaggactgagtgggtattagtctccttgggccactcacctctctctctctctcatctctctctctcgaaaaaatattttttttcttttctggctgaacttttcatgtaggaatagctccatgtgtgtcaaatctcatcactaatttttaattgtctgtgtctgtgctttttcattgctagccactaaagtccactacattttgggacagcttgtttgaagagatggtcattagattgtttctctatgcagaaaatttttgaattggcttattcaaaattgccaacgagaaattacatgtgttgcctggaaagggtatgatttaaaatttttaaagtctcattttagtcccttaaaaaacactttgaatgaagcagccgagtgctctggtgtgctaatggtcagcagagcggctcccagctccctcctgcagcagggcgtttggccgcagcccatggcaggagctggtggggccgcgtcaggcagccccaggcatgggtaccctttatgaataccttcctcgaatgcgaatgcgctggtcaggacaatttctatgtctggaattccaaacaaccagaccattaaaattcatgggaatgcaagtcaggcagccctggcaggcattttcccgtgggccagggggctgcctgcaggccagcccgccgtgtgtgctgagcgctctgcacacggtactccaccgccccgcgtcctcatgttacggctgaggatgcacaggccagagagagcccgaggaacctgactctaggcaccatgactccgaagcccagtgtgtctggctgtgccaggagtttcctgagctctctcacacgtgagtctggggatgggcagcggtgggcacagagtggatgctgagcagaggctgccggctgctgcagagtcctgtcccctggcctggcttctgaggtgggtgatggccacctggcacagcccatggaaatgccccaccatgtctgaccctgggcagccaggccccttaatccgaccgcctcttgaagcaaggtgctgcctggcccaagtgagaccattgtctcagctgtcacgtaagaatgaatgcggccagcccactgggggcctgggtgcgtgtgtggcgt

SEQ ID NO: 133873 - DNA, 1050 bp, Homo sapiens
agtcccccctagaggccgccgcccccgcccgccagcccgcccgcgcgccacggccccaccacccccggccccgccgccccccgcccgcacccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggtgaggccggggatccgggcgggccggggaccggggccgcgccgcacccctatcccccttcccagggcgcagaatgtcgcccggccgtggcggcgctgggggcagcgagttcccccagcccttgcccgggatagcctggccgggccgggctgcaagatggatggccgcgggtgcaggccgcgcgctgcccaagcccgtctccagctgtccctgttcggggtccgcggccgcgtggggacacttgagggctgggagagagccccggaccagaattcggaggcgacagtgtcatcatccccaatatccttagtttttcccatcctatttgaggcgggcaggctatcactcaccttcaactttgacaaaatactcccttttctaatttagcctgttctttcccagcaacaggttcatcttggaagcaggcaggatacagagtaatagagggggtttcgccagag

SEQ ID NO: 133874 - DNA, 1027 bp, Homo sapiens
ttggcagagggcttcgcagctggcactgggccagaggagaacttcaggacccagcagtgactgtgaagataagcacatccatgatcctggacttcacgttctgattgcttgcttttttcattggttttcttgaaaacaaattttgggggcctttttgttgtcttagctcttgacactcggtcttccatcttgtcatttgacatttccttgaaactgctggagctgaaagtttgtgaaattctgtcttcgcggttgcccccactgcccgcgaggagatggtggtagttaagcctaaaatgatagcggaagtcccacccacgatccggttgcaattggtgagatggtgtttaagtcgtgggtggaggcggccggcagagtcccgattggcccctgcgcctggcagacacacagctgccattcctcagggaagttcgggtgagaggaagtgcctgccttttaatttctgaatcggagcctggggcgctcagggaagtaaggtgctgccatttgtctgaagcgatccatctccctaatagagcgtaaaagtgttcatagtttagtcttgttcagagatggaaaagactacttaaaagacaggatgagctgcactgacttgcctttggtaaccgcacagctctctacttaactagtcaagcgactttcaagggaacactgtgaatattacttaggattagaatcagtatgtatgcatatggtcactgtatctttaaagaactgttgagttctttttaattctacagtttctttatctttgcacccctttgaatgcctcgcacacctagtaggtgctcagaattcagaccaatgtgtcagtgttaggaaactagatttaagctccatttaagatcgtctttttcacttaggtttctggacacgggataatgggataattttgtctgtattttgcttttgctaagcttttaattattgacctagggtcatattatagtgcgaattgcacaaaatgaatattgtaataactcaattacttggtggtctcttagct

SEQ ID NO: 133875 - DNA, 1112 bp, Homo sapiens
gtttcactatgttggccaggctggtctcggactcctgacctcgtgatccacccgccctggcctcccaaagtgctgggattacaggcattagccactatgcctggccctatttttgcttatttttatgttttctctagaagtaaatctgatgaagaccttgcctgttatccagctcttagagcgatgcttggtgtgtagtacatgctcagaaaatatttgataaatggatatgaatcaccagttacaggcaaggaagtgtgatggcagaaagatggtaggaagcagaagttttaaagtccccctagagttaattccaaaatcactggtgtcagcttggccacctggtgcagagcttttatctttgagtaaaccttttatgcttcttaacttaggagatgtgttgagggcataaaatgggtgactgcttcaggaaatgggctgcatttagccacctttcctcttgttacacctggctttatcacacattgtttctaggcatcttaggggacagtgtaaaagagttgaacttgacccactgcagtatttgtagaggtgatggtcaatctgcattatggagtttaggatctgtgatttagaaacggtacttttatgcgccagtcatttggcatttctcagttgtctctggaatcaattaactttcttgaaaggatgaatttaccatgttggtgttttactggttagtgcaggaaagtatactagagggtttattgctggagggttgacttcacaggtctgaagtacatcattcatcctctgaggtagagcacatttatgaatagtagtaacaagccagcccagactgttggagggggtcactagactccatggatgaggtgttttaatttcctggacctatgaagagtttgcaagtgttactatcttgaaataaatagtatcaacctgtggttctttttcctaaattatgaaaattgaaattttatgttttagattttggaatggtattttaataagaatgatattactaggatttagctgagtcattagattactagagtaggctaaatagattctgaatacaaataatgtgtgtgtttcttccttttatcattgtatttttttatttttaaagt

SEQ ID NO: 133876 - DNA, 1756 bp, Homo sapiens
tgctccttcgtgtgttgtggaaatccgaggtattgtggatgttacattggggattcagtagaagtaaagagggtgtcttagattttttcatcattgaaaaggcaattgatatagacctagtcttgacatagtgtgtgggacatagaataagcctgtggcagttacattgagggtgaacgtgtgcatccttgtatggtctccacgtgtgggaggccttaggaggataagaactggttgacaggtaggccgagggatcatacttttattttattttttaaattctgatgatttcacctgacacatttgatctactttgaagaaattgttttgatttcattgacagtgggtggcttctttctgtctcctttctcacagaactctttattttcttgtgtctttctccccctctctttcttgaaaatactgtcatggggtcagctggctttgtgtattttcaagcaaggtgatctttgagcttgacaagaattgaaaattgatttacagtctagatgggatcataagttactgacaggagatgatttaaatgcgatttcccacagaaatttcttagtggagcaatgtgttgcaaactttattatggcatttttttgactgtttggctttcacggatagttttcataaatgtgatttttcagcttctgtgcaaacatttctgcttattgagcttgttgctacagtgttaccctacatctgatgaagtttttttctcgtttgccaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggtaggtggagcagtgtgaaaatattttataagggagtgaccatatgataagcacattgatcttttaagtgtttctgtgcttgaatgttttggatatgtatcacacattgaaaagaaccaaggcgtgggctcttccttagcattccttgcttcgtattattttttggcatagctaatgtgctacttttgttcttaagtgtttgttgaggtattgttctatccaggaattgttcagattaattttgtgaaaaaactcatttaaggttttggaaaactaacattctaaatcacagatgtcaacacatggtcactatgtaaattagacatttaaacctttgacataaattatgtttatagtagaagaaaatatgctatggggttagaatggttatgttttcacctcattttcgggatactcactactttaaaagagaaacaaaaataagctatcgtagcttgtttccaacacctacattttaagtaaatgtatacatgtctttaaaaaatttccttggaggaattccttatgctgaatacccagaaaggatgaaatcttgttttaactatgacattagattttaattttctttaattaaaaataattcccccacgcctgtaatcccagcactttgggaggccaaggtgggcagctcacctgaggtcaggagtttgagaccagcctggccaacatggtgaaaccctgtatttactaaaaatacaaaaattagccgggcatggtggtgggcgcctataatcctagctacttgggag

SEQ ID NO: 133877 - DNA, 1451 bp, Homo sapiens
atctgcactgccttaaaaagcaagcaacaatgctaccatcccttgttctcaacacctatatgttaggtaaatgtataaatgtccttgaaaatttcccttaaggaattctttgtgctgtgtacctagatagaaggaaatctttgagctgatgttttatatattaattttcttacttaaaaattttaattttgtctttaggtagtatagttacttgtcacttagagcaacatctttgcatagttgataaatttcataactaattttctacaattataaaatagtttataaagctttttggatgatgagggagactcaaatggaagtgatccatttgtactattttattaaaacttaatattctttttctcccttttgattcccttcctgtttgtgatagtaataaacatcagagatgaggcacttaattctgattttctgcagtggaagtgtctgtgtttgatgtgagcataggagtaatgagtgagatatgcacgaggcactggaaaacttcagcttggacttgttagtgactcctgtgattgtaatgatcatttgtcagttcaagtgcctttcttgacttggggaattaggaagatggggacctagactttgtatctgcttcccaccctgggactgcttccttacagtaaagagtggcggttaaattgggtgttttccgaagggctgtaaaattttgaatgttgtcgtaattaccctccctccataaacaattttaattggtggctagtttcaaatgggagtttttcttcctacattttaatttacctttaactctggtgatacccaaaagctgaagtagaattcctttcctcctttcattttgttccctgctgtttcatctctggcatgctttttctttttcatctctggcatgctataaaatgttctccttttcaccctaatggggtttggtatggactgttttcaacttcttgttcaaaaattagtttttcttctcttgttagaaattacatttctggccatagaatccctcctgtatgttttcatgaatgaagtgatgtgatctgtcattcggactctaagcttctggtgatgccatgattgaaatgtggattggggaaatgcagcgtgtaatcagctggacttaagagcactgcacctgtgctcagtagctctgttaagcattatgcttttgtaagtgagacacaaatgaaagcttgtttcctacaagatttattttgttttgaagagcaggagtgagatactcccaaggtttctggctatatgtgtatgtctaagttaaactagccctgcttcatatgtcacagggttagaagtgaagagctgtttgaagaattattggaaaaccagctcaatctattgccaagtgaataacatcattatatgtgtgtttttcctaaattttgttgagaaaatctttaagtattgaaatgtggaaagaatagaga

SEQ ID NO: 133878 - DNA, 1051 bp, Homo sapiens
acaagagttatgtgttactccctattcctcgggagacctgctgttgggattccttgctgcagtcccggagatgcctggaggctgggctggagtgcgacctctgtctctacccaggcccaggtcctgcagaacagggagcctggcagcagatgatacagagcaggctgggccaggatgggtaaaaccccagggctgcacagacacccaagcctgaggctgcgtttatcttactttgctctaagtaagttactctgtttgattggaaacataagagaatcttttatgtacctggaagagttgagatacactcctggaatgcctcccaaacaatggggaaggcattccaggagtgcatctcatttcctcgctcatttaaactttttccaatggcaatatttcttaaaagggtcatatctttaataaggaaaatacattgaatatcctttcaatgtgtttttggactcagtgttataattaggaagatttgtgattgtatttacagtaatgaaaagtgggctggatgcatattggtctttcgaagaggctcccactgtttgtgttgctctgggccgctgtgctcctttcatggttttagtgtggctggcagtgttgcatgagagaaatggaaggcgtcaggcagcctggtacccagagagctgagcctgcagagcatgggctccagtcccaagcccagcctctgtttcccttcaggtggtgcccccatgcctgcctcctcctgtgccctgggagtggctggccattcggtctgcctggacataaggtttagtgagcctgtgggtgccctgcatagctggtgtggcctgtactcatcagaggcggcctgcggctgtggcagtccaccctgggcagggccccctggctgtagacatgtgctaagtgagcagtttttcaaaatgtgacttttggggttttaaaaattgtatgattttgtgtcctaactggttacgggaattttttattttgggtgggcattttgttgttttaatttttaaaaatgttttatagatgtttgctggctttatttttttaa

SEQ ID NO: 133879 - DNA, 1068 bp, Homo sapiens
cacctcgaatttttcccaggggtatctttaactatattttttatatcttattgtcttcaaccagaagtcattgagtggtacttttaaaacatgtcctttagggccagcagttgggtctggctctgagagagtagtgaggagggtagcatcaggatctccaggagcaacgatggtagggccgtcagtctggccttcttatcgcagggactgtgtcacctccagggttggaacacacagcagaccccacagtgggccagtctagtagactggccctttgagacaaagaggaactgaacagtcctctctcttgggcttcccagatggacacctgggtggctgttgcagctgctgcccagcctgtggtcctagtgaccgctgtgcatggtgcctgtctctggactagggctagaggtcccagtaggtctcatgcagtgcctggagccagcttttgtccgagaagagctgtagcatttcaggcactttgaggcttcattgtgtgtggcatttaccacgtaaccttgctggagctaggtcagtgatcagatgacttgatctttctgaaatctttttttaaaaaattaagttgggtataaactgtaaataaatagaaagatgaacttcgtttatttctgactttcacctatattgtcatagcaggagggggtagttctgaattctgtgaaccctccaaagaaggaatttctccttacatgttagtgttaattgaagttcacttcatatatttttttcttaataagtcgttatattataatagtttagtaagagctaagaaaaacttcctaaaatctaagtacttatttagctttagaaaatataatattaggggcctgaaaggtaagtaaatttaaaacattcttctgtttgtttgttttttttttaaacatagtctattggggaaaaaaagagagacaggcaagatgacgtagtttgactgaaccctctgattttgttaatctttgtagtcttcatatttctgttgcatttttactgttttagatagaagcctatgttatctttttaaaaattcatttttattataaaaataat

SEQ ID NO: 133880 - DNA, 1614 bp, Homo sapiens
actagagtagtgaattctgtccagaaggttttcaatgtgcttagcccagatgcatcagaggagtcattttctatggcagttctagcctgatgaaatgtatttctttaataataagacttgagtgtcaaaattactcctttatccattatgggttgtggaatgaatgttgtgtcaacaggcatgaagacaacattcctttccttgtatgttaacatgcaagggctggtccctctgcaggctctcgggaggatcccagcccgtccagcctcgagcatctgaggccctgtcatgctgcatcactgcctcctttctccacattttgaggaccctgtgattcccttgggcttgtctgggtaatccaggacaggattcttatttggaggtcagctgacaggcagccttcattgaattttgccacgcaatgcagcatattcgcaggttctggagaggaggatgtggacagctttgggaggtcattgtcctgcctaccgcaaagctcttattaggtggctggtcttctttttcaacctgttaacttacgtttttctagtgtcagctgtttttggctaatgagatgttcctactctttatttgatattctttgtcactttcctcaaacatgcccctcaacaggcagtgataccatttttctccagttagagctgaagttggcctttgaaggtggattcaaggacttggtaactgcatttctgcttacagtttcagggagtcctgggctctaatctaaagattctacttgtgcaggccttcatctttgttggttggtgttgaaagaaagggagcgaatggtggctccaggccttctctctgggctgctttgtgcttcgcttgttatgggtgcaggtcctggccttggaattaatcgcaaacaagtcttggacttctcagaagtggtggaagactgtcagatgctcttttcacccaacacagtttaagcagctgagttgtatttcatccactgaaaggaaaatccagttcttgagcttcagaacgtgaacggcttaggaaagtcttagggccaagatcttacaagtggacaatcattgggcactgataagatcttagatggtagctccttgttgaatttctggctcctgcattcagattagcctggtactggttgctcaccatccactgttgacacttacgtttgttttctcaggtccgggcccaccagctggtcttgccaccttgcgacgtagtgatcaaagccgttgctgactatgtacgcaacattcaggacacctctgacttggatgccatagctaaagatgttttccagcattcacaggtaaaaaaaaaaacaaacaaaacaaaaaaacagattcatgggatatgacgttgcatagtggtgtggccaggtttggaagaaggggacttgagggtgcaagctgactggatgggtctgagagctcttgctcaggccactggaagaaagctgcaggttgcaaggccagaggctgaggtagcctggtcatgttccctgccagccaggaagtctcagccacttcacccagcttttccaggctgaataaaagggagattcagttagacggttggtgaggtctcctgctcataagttctcgatcttaa

SEQ ID NO: 133881 - DNA, 1914 bp, Homo sapiens
tcacttgaatgcgggtgctacatgagtctagccttagatttgtattattccaaagttaggtaagtgaggtcagccacaagatattatacactagacattttacattgatttaaattatatggttggagcttgaatagattttataatattctttggaccaaacctgcctatcagaatcacctgtgaacagttttttaaaataatagcgactttgatcgcacacgtggaggtgcagatctagccaacatactgttttaggaacagctccttgtattgtctgtgccatgcgtgtgtgtgcgccatgcatgcacgtgtggggtgtgtttgtgtgcacttctgtgtgtatctacgcctgtgtgtgagtgaccacttgatcatgcacacacatcccttagaggcacggacttgtggacttatcggtcagttaggaatgtgttgtgtgcacgtgtgtctatgtgcgtgttgcatgcaagtgtgaggtgtctgtgactacacacatgccagtctcattattcccagcttctcatactgcagttgtttttgtttggtacaaaggtggaagctctgccaaggttttttcttgatgcgagccaggatcgaagggctatggtgtttaaagcttgcgagctgaaggcccttggaaggcaggaacctcagataaattgtagtctgtaagattcctggtcgttctctggggggagtcaacaatgatctgtgcttcactcccagcgtctgttgaccatgcttggctctcaggaggccggaccaaggacagcgtttgcactcctggtctcaccacgcccagtgttggcttagggaacctcttgtgaatgcagccatggacatttgcttttcagagaacgagagtgaaggtttggggaatgtttctgtccttacctatattggcagtaggcagtgtgagaggtggtggttcttgggttgtgttccccttgcctggtgttttcctctgatttcatactgctataaagaactgcctgagactggataatttatgaaggaaagaggtttaattgactcacagttcagcatggctggggaggcctcaggaaacttagcatcatggcagaagttgaaggggaagcaaggcaccttcttaacaaggcagcggtaagaagtgtcgagtgaagggggaagagccccttatacaaccatcagatcttgtgagaactcattcactatcattagaagaacatgggagaaactgcccctatgatccaattacctccacctagtctctctgcctagacacgtggggattatggggattataattcaagatgagatttgggtggggatgtgcagcctaaccatatcaactggtgttcagatgaagaggttgtagaagcatatctactgcttaaagagggaaattggagtcagcaagctctgggcttggttttcttccacatttaaaacaaacccaaggaagagatggtgcagccgtgcaagcccctggtggatctgttgtgtctcacacaggttttctattttctctgtgtcttcagcagtgtgcatcttacttaaaccgcctcagggctcctttcatccccaggcccagtcctcagcttgacacatcataggccctcagcacctaagtgttctgagagggagtgcagctcctagaggtccatgtcccatgtcctcctgcttcctgcatatcatttgggccccagtcggtccttgttactgcgggtcttgtgctgtctctggaacagccctttatgggcaccatctactcactcattcacttctgttggctgacgtggcccctgagctctcttcctgtgcttagttaggccgcgcgaggccagaggttgagtggggaggcttccagcccctgccttctgtcccagcttcaggctggcctggttccatgtcctgctgtcctgcttc

SEQ ID NO: 133882 - DNA, 1539 bp, Homo sapiens
gggacccatggtggtgtcgatgtctgagccaggtgagggtgagatccctggcgccatgggctggcccccaggatgccctggaaaacgcattctgttcacagctgtgtgattcttttctttctgtgttggtgaagcagccagacccggtccgtttggaatgcctgggatggtgccgccgcatgttcctcctcagatgctcaacattccgcagacctctctgcaagcaaagcccgtggtaaggccttccctgcgttgggtcgggtggcgggtctcagacagggtgcgtgcattgaatttcaacgaatgctaaaataagttcctaacctcttgaattgatacgtgaaatagatgccagtgtttgttgaaataaaaatgagccaggaaacgtcagcctgggcctgagtcgggtcctgctggccacgtgtgcgtgacctgtgcccttcgcttcaggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaagtgagtggtgcgtgggtcgctgggtgcttcctggcgggtagtgacctggggaagctgccttctggcctgccagcccagctggtgttttgctcagagatgtagtttattgcaggtgggtgatggtcagtctgtactcagatgggggctccttggacagagaggagagaggaagagtaggtatgttcttgaagtttccatgatttaaaatctgcactatcccagccccatggcctggagccacaggaaactttctggggaggaatttgacaagaactggtttgtgtgatgaccaaaacatgggggcatttgtccggtgtggtgccactcacacccgtcacagcaaccccctgccgacccccgaaacattaatcttctggctcctggatcaagggagctctgaatttcctctccttctcctaaactcagcaggttacaggacactttggaaataacactgtttgcccaagcaaaaccctagaaagctgcctagacccaggctggaattgtttccttagaggagtattttaaacactgtgtgtccctgaataaatgggttcacaaatacatagttggttaaaatttgatcgaggaaatctttaatttgcactcctccctttctttaaattgtcttatgtttaaaacaaaaaaaacagggaaagaatatttcttttctttaagtcagtgtctccttttccttggtgtgaactctactttacagcgcagataaccagggctggttgatgttacatctgtttctgatgtaggaaatgtaagagacataggtgtcagcttccatgccagt

SEQ ID NO: 133883 - DNA, 1464 bp, Homo sapiens
cttcctggtgcctgtcagatgtttgtaatcttgtttcagttgaattaagaattacagttgaggccgggtgcaatggctcatgcctgtaatttcagcactttgggaagctgaggcaggcagatcacttgaggtcagaagttcaagaccaacatggtgaaaccctttctctaccaaaaaatacaaaaattagctggacgtggttgtgtttgcttgtagtcccagctacttgggaggctgaggtaggagaattgcttgaacctgggaggtggaggttgcaatgagccgagattgtgccactgtactccagcctgggcaacggagtgagatcctgtttaaaaaacaaaacaaaacaaaaattacaattgaatccttgtggaggtgtttattttatgttattttcatagattcatttggacttgcagaatctgaatcaaatctgaggttactgtattacaatttttaattctttgttttatatcttttttctaattatcatcttgatacaaagttatatagaattcaaacactggacaatacagtatagagaattccccatgatcctacttctagagaggtaattatatttgaaagattggtgaatattcaagcaccttattttcctctgcatctgctaaaataagatttttacaataactaggtcctatcttagggagagtaacttgccctttttccttttcttccatcttttatccttaatatacttacgtaactatgtattcttatttgtgcatgtaagtattaatatgtacatgtacttaatacccaatatttaataagatctatatacatccactttattgctttaatatttttgcataaaattactgacatttttaaatggatatgtaaaagtccttattgagagagaagactgagtttttttccaccttgtgaccttgtttgtataaatgggtttcattttcttgagaacttatgtatgtatcttaggagagaaagccctgtggaacaaggacatctccacatttatttttattttgacatgtagtgttatggaggcatcttttgcataagtcttgtatccccctcccctgttaatttttgctaatgacatgtactccctggaccaaatctggactgtgaaagatgaaccacaggaaggcaggctgtttggtgttagcatgctctgtgagcagcactgagacctagctgttggcaggaaccggtttgctcagagtctcttggttggtatttctaggtgatgttgtgacctgaagctcgcagaacctcagagcattcaaatgtgcgtgacaggtttgctgagttgtttgtgtattaaattagctgatgaaaaagctcaatgaatggtagctatcactactttttaaaaattaactcttagtatgctagaaaatcagaacactgatgtggtttttaatgtaaaatagctaaaagaattttatttggctccctttgatctggtat

SEQ ID NO: 133884 - DNA, 1754 bp, Homo sapiens
tttcctaacacttggcctcccctgccccaccatcctaggtgcatgatcctctagatcctcttaccctccaagagccccagacactctagggacagataccctggggatgggtgcttgtgggtctgcgtggttaataagcattccacatgagcctttaagcttaacaacagtttgagaacacttattgttctttacatgctatggaagataagcaagagttgtgccaatgttgccatgtacttctaggccaggatttagtaattttttgccccctgcgtctcccagcttgctgactcatgcatctctatcagcacatgctcatccacctcctgagccgctatccattgtctgctcacaatgcgccctcagtggctgctttctcagtgggacagaccactacactctggggatgcctgcaatggtttttgacgtgtctgagccactgctggggtttcctctagttttgttaagttgcaggcagagattgtgcatgagcagtggtttctccaagctccatgaagaccgggaaacctgaacagggtgggtgaacttttcatggcgtgcatgcagtatccttggctggacagtccattgtgtgacagcagaatctttttgcagctttttttccccctttttttaaaagacagaactataatgaagttgattggaagataggagaattatctggtcttaaaacctctccatctgtcatgtgagtcagttacaaaggcaggccagttgacccatgctggcatgtcctatggccagcactggttttcagaaggtagtttgggcatggaaccttatagtcgaagggtgagtgcacggagcaccacagccatccctgcctcagggtcacactgtgcactgaggttccagtgtggtgctgcatcctgctggccctgctcaagcccctgcacatcctctgctacctgtagacagtgcatttcacattcgcctgaggactatggtaaacccatatactacaagtgaacaaagactttaggaaataatgcttattcacaccatgcattctggtctgtcctgtttcagtttttttaaatgctcattaaacccacgaaattgtattcccagactgttaatgggtaacagcacagttacctctcattctgtaatttgagatgctctttgatcttctcatctctttttccttatccccttttttttttcactactttgttaaataaagccatcctccaaataagttcccatgaactccctgttctgtgaacccaccaagtttgtgccatctcgctttgcctagagtgtaccttccctgtctttcagattttccagttcgagtcacctccagtgttagctctaatgccccctccacatgaataggctggagcgccctgtgtggtgtattgtcgccttacatttatttataacttatgtgtagtattcgatccagataacatttaagtcttctactacctcataattgccaattaaatgctgatctttgtcttgctgtgacgatggaaagatcctccaaggcaaggcttgcctttgtttcctctgcatcctctatagcgctaagcaaatcacagaccatctctgaactgcctggtgactcctctaagttaggtgttcgatagtttcttttccatagtatgtggttatcacctacccttttgaagcaggaagaaatattagtataatagagttatttctcgatgttgtgtttattttaaaagtattgttattatgagcctgaagacttagctgag

SEQ ID NO: 133885 - DNA, 1044 bp, Homo sapiens
aatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcctttaatttattttttagttgtaatgcctccaaatctcatctattatttgatatgggtatgcatttatagtatcacttttcagattatggttgtaaggtgaacattttatttttcaggttcaacataaattataaagggtaagtgaaaagtaattgttgtggggaaaacattttgctaagtttaaggaaccaaagttttgggaagacatctttcaaaataaggtgtgaagaaacaacactcattcctcgtggggctgtttgaaatgtaaggtccccaggagctacctgttatgtccacactgctggatctgatgcgtggatagtcggttagatctatatgagggttgcaaattgtaccgacatgctttcttatttcttatgaatttcaagggcaaatactgataaaatgaccatggttgagaaaattgtcttttcacattttaaaatgctacttaagttttttcagtttatcctataagctgaatggctctggtattaattgcccaggctaagacatttacagtgagatgcatctttatggtaatgaagagaatttgcaaagcatcatattattgagataaatattccctagatgag

SEQ ID NO: 133886 - DNA, 2654 bp, Homo sapiens
gtaaggggaaagaccagtttttaaattaaacttatgtgaatgaaagaaacagcaaatattacaaaattattatttaaagcatatatatcaatgaacttcatagacattgaggtcataaatgcattgttgtgctctgagtataattaaataaaatttgttgcatgatatcttgagatgtatcttgatgctgtaagatccctgagacagattaattttggcaacaatcttagctgccaaaggccacagtcagtcatttgtctcttggcagcacgttcttgagtcagatgcagttcttgccgtattggccctgggacatgaaaaaggtggagtgcttttggtttctgccctagtggctatgcatgtcctagccactgtactgagacacatttcttgagcacctgccacactatggcagaagcctaacacacgaggtggtaatttgccatggaagaacttagcaaagaaaatttgaccattatattttcaggatactcagttctttagtttgcatgtaggtaattgaaaattttcaattatattgcatgtgaccatcccaactctctaaataaaagttgcgagttctcagtcttttctattctgtttcttgtctgatgttatctgtctggattgtttcaaagactttggaacatctacatggttttcttttgttcttggttttggattaaacataaaatgatgtagattttattttgattctttgagcatatgctttggccacagcctgccaaatgaactcttcctaaacatctttatttaggcaagttgttaagcagttgatttggaatggaattgcaatgtcattaactggagataatacagtatatttctgtgagtgtattgtaaattcaacatgaaaaatgtgcaatgttattctgctttcttccatgcaaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaatgtatgtactgtaacaatccattgtttgttttcctcggtacctcgtaatctcttgtgcattttctaaagccttagaagaatcatgactgagttgaccccgagtgcctctgtgtaaaggaggtgggcccatcatcggggcagtaggccagggtaaaggctcttagaaaaggaggagaagccacagactttcttcctcagtaacattccaataatgatgtttattcagtaaaataataaaacaggtttacactttaaagtgaatgttgatctgaaagcagacttgaattgccgccactctctgtaattaccacgtcttggtaatcaggacgagtgagtttctgtgctctggttttcatgaagcacagatctgctctctccagaaggccagggtcctggagaaaacttccagcaggtctctggttggccatgtttgtgctgttggagtgccaccacgcatggctctgcagctgtagcgaaggtcgtgggactcacggatcgtcgcaggattgtgatgatttgtctcggaatcctctgagacctgtgcacttccagctgatcaactctgggagtggggggtgcaggtggaaacactgaaaaggattgtttgaaaagttggtcaaagatgaggtcaaagcatttttctttatcttctagtgggcctgtgtaatacttggagaaaatgatgcctttctgttctaggtaattttatctcctaatgtaaggaatgtaaaagtaactgtatatttagttggaaatacagaaaagaatcctcaaacatacagtctgagaatattatgaattgtggaaattgtaaattactagatcattctttgagccatggataattagttacagactatttgtttgtgtggtgggtcaatgcagtcctcctgagatggtgaagctccttgtcagcactgactgtgtgcagtgctgagctttggaactttaacctaagttcattagatttaaaatatttctgtttgcaattactatgacaaacttgcaatctgtaaggctttaaagtgaagcagttctcactacctttccttggtgatagttgtcctgagagtgattgctgagctgctggtgtgactgtcactggcaggaggtgatgctcgctctgcagggctgtgagcatctccaccctctgtgtcttcagtggttggagataccatgtggaacaatgaacattgtaaatgacattcttctcaaaggttcaggacattcttcaatgtacctgttttcattcttttctcacattgtgtgatccatttgctctcaaaagaatgacatttcttactttgcacatggctggtcacttgtcctggcctgtctctacccttcacttctgcaggctgaccaggccctcagacccccttttttcagttgttcctctctcctgggcttagcctgcttgtgttgcaggctctgtctagtcccaaatcctgtgacatcctgggtgttgcagctcctttgtcctcagtttcagcgcactgcagtggcttcatggtagaaggtattcttttttatttgcttgtgtgttctaaaaacagagttaccttta

SEQ ID NO: 133887 - DNA, 1375 bp, Homo sapiens
gctggaatcagaggtcacaggaatggagccatcctgtggctccttttcttccaaaggaagaaaagacaagaagggttggggaagtgtgaaatgactcaagtgaatgggggtgccattgatgtaggtggaggaggaaagggacacaggagaacacaaaacaggatggtggcagcaggtggcactgggtcttctcttgagacatggctgagatggacaagggaacgccgtatcttcaaagtgagaacttacaggaactcccttccctcctctcctcttctccttctttttaaggatgggagactgaatagtttggttattgttatgttatttttttggccaatggggaggatttagtgggggagaggtgagtttatcagagagaataggaaaaaattagacagtcctgataaagagtttgtattagtagacttaggtgggaaggagaagcagaggcagaagtccatactttggggccatctttgttggtgaaggcaggaaggattgggggtaaggatacctcagatttggtttgggaaagggagtcaactagcactgaggaaaaggacagaggcccagccagctgcacttattagttgatcatggagcatgggtattttctgcactgtagtttagtacttctttgccaatggtagtttagtacttcttcaatggtaaatgagattttaaaaggatttcataaacatttatgtcttttgctattgtgtgtattacccttagagcagtgtgcagcaggcagtgaaagaatgaataattggtttaggtacacacaacttattggagatgaagacccggtttggtgcgtcagaaaattaaactttgttgtgtgagggtgtgcgtaagtgctgagatgctttgaaaggtcagtgctaaacaaattgcagtcttttctgctcaagtgatttatgaactttgattttgatattctgtagagatggggagccattgaaggtttggtacaaatgatgtttctgtttagaaagatgagttggatagcgatgtatggactgaaccaaaacagaaatgaagcctttacgtgtcaaagatagggcaggtgcagatgacctttgcctagacagttaagaccctagaatttaagtgtttagaaaaatgcattgttaatgtgctatgacaaatacatatttatttctgaatggaaaagatgtgtagatttgacctgagtttagaatttgggagaccttactcagtactgtaatttcagtgggtgagatttttgtaagcagctttagaatctaggtctttatagggagctgataaaattgaacttgtttcatgcgttagttacattcaagagggggaaacaagcctataaaaaagttttttatgtcagtgatat

SEQ ID NO: 133888 - DNA, 2288 bp, Homo sapiens
tgtggggtatgtttcagtgtgtgtattgtggtatgtgtgtggtggggggtgtgtgtggtggggtttgttgggggatatgttgtgtgaaatatgtgatgtgtgcatggtatgaaatgtgtgatgtgtgtgtcctatgtgtttgcgaggtgtggttatgtagagtaatctgatagcaacatagcatattggcgaacagctcattctggaagctccccttgcctgttttctcttggggtggagcagccttggtgttggatcacaggagggaaggcaggtcggctcacaggaaggcctgtgcatggtagtggtggttgtggagatgatcctgtatgttccgagtctacttctgggaaagcttctggaagctgagctgtgctggagatccacaggatcggggtgggggcagtgccttagattgtgcgtccaacgacaggatatgcttcgtgatggagaccttattggttttatatctatacctaaaagtattgaataaaaacaaataagcatgtatttatatatacatgtatgtctgttttgacttgatggactttaagcatttggagtgtttgaaatattcctttaacatctaaacactaagatattcaaatgtaaatgaaagacatttgcctaatgagagcagtaacatttttgtaaaaggaaaattttcagtgactgccttaacttgtaccccagctctgcccggcaggcttcacgtaaggggacactatctggagttggctccagaagggcttgtcacagagccctatgaggtcttgactcaacgtgttcctatacgtgacactgttacctgacttgtcaggtattgaaatgtatttaagcattttttttctgttgctgagaaactgtgtatccaagtgtctaactcctggtgtttttcatgacattttaagagattattgtattgcctgactatatttagactcagagtggaactggagatcagccagtaatacatttaactctgtcctgcttttggattcttcagaatgccttaggtattactttagagaagacaaacccagagagattaatgtaatttggatagaatgaatatgttgaagatcaaattagagtttatgatagcatcctggtctccgtacagacactggccttggagtgggtcgtgcactggagtgtgtcagccagggacggtgcctttgctcatgtgtagcagcactgggcaagggacaacaccaggccccgctttggttctggtgtttattcaactaaagtgaaccacttgttacttataaaatgcatacccagatttccctattgggttgttacctcagtgcagttgatgagattttaacattctactgtgcaatatggattgtttttgttttatttccttgtcattgttttttccttaatttattgggaaatcaatcaagtgggaaaatgtgcatgtttatgtatttgtaagaattgattgactaatagtgaaacatctgtggataaaaggtattgtttccatgttacatcaacttagaacttcttgtcttttttgaggcgaaatgttggataactttacactctgtctgaagtcttgctgaatagaattactgtgtgctggcatcatctgggacttcaaaacttggaatatttgcatctacttgtgttttactggccagtcttaaaaatagagtttaacagttacatttgttgaagtgggaggttcagtaaagtggctactgcatgcaaattatttctcaaatctaatttatgagggtatttatccatgtagaaagggattagctatccaaattggattttgcatgttaaaataattagataaccacatacttccgtgaattacactgttataactaaaactatttgtagatataaaatattaaaatggattttgtctaacatcttgatttatgcatactagttatatgagaaaatcaagtcatgatttgattggatgaaacttatttgtggcctaactgaaaatctgaatgagccattaattgcacagaatagagggacaaacaaaatacccacaaggacttgatgattggtagttttgctaaggagagaatgcattgttacctgagaggcgaatctttagaccagttactagagctgcttgtttttgttaagactgaaagcaggtgaatgatgcatgaatgtgtcttctctggcttttttttcctgtagtttcaccagtgatcattaaagaatgggcagcttacaaaggaaagtctcctcaaaccccggaactggttgaagctcttgccttcagggagtggacctgcccc

SEQ ID NO: 133889 - DNA, 3424 bp, Homo sapiens
tattgatggtttaattaaatgaaactttcacatcactcttttatgtatctcatcaaatataaataccatagaaatgtaacatttgctgtttgttctccttgaaattgcatttacatcctacttttgccacattaatttgaccatgacgtatataagctctctgtgcttcagtttccccttctctaaattgggataattattgttcctgtctcagaatttctataacagtagatgagttaaagtgtgtaaggtgcttagaccaatgccttggcacctagtgagcacgtaaactttctactttgggcttcaactgaaaatatatctcaatgagctgtctagaacctcccttacttagtttgtgtacccatggatgaatattaattaatacaagaatgatttagtgctcagcaccaactctaaccctgggttttgttaactcagattttaagcactgagcaaacttactctgcagatgggaatggaaagagctttgttaagcatgtcacggttctctgaactccttttgagttatttgccagagatcacgtcgtaatctatcatcagaagttatttttagtgatcagctggcaacttgattaggttgtccttcaagtttatggaatgcaaagaactgggaacgttagacttcagaaaggtttatgactaagtcattatagttagcccttcactttttcacgcccagacactccttggggttgtgccttgtgcagtactgtagggtgtttgtgattcaggcagtgctgttactgagaagggaaggagactcccaggcagacctgttctagttgaagttgaagatttggagattgattgtcctttagcagccacttcagggtgggcacattttgccgtggctctagtgatggtcctacgcattgcttttcttgagtctgactcccgctcaccttgtggtactggccctatcttcggttatttacctgctccatggacctgcagctgcagagtggccaggcaatggtctttgcttttcatctcgggatttgtctttcttatttatacctagggtctgcctcctggctatcctggcttgaacaaaaaaatgaatgaatcctgaaaattggtacttagaatgtacttccagggtttaaatgtttcacaagagtgaggttgtatcaaaaatcactgactagctagttttcagtatccacaattcagtgtgctatttttaattattctaaagtaaaacattctgacatcctgttttcatttgtaatggtatcatcaaatgaaagtagaaaagtagaaaagctgaataagaaatcacatgggtcttcttagctcacatcatccgggatttacctagaacctcccactggacttgtctatatgacgggcgaccactcagtaatcaccaaccttttgtttctgcccctcaccaggtacatggtgcagtggccgggagcacgcatccttcggcgtcaggagctagatgccttcctggctcaggcgctgtcccccaaactctacgagcctgatcagctccaggagctcaaggtaatttatcagcctcattgcattgtcttggacagtctcactttggattttggtgtaatactgctaactttcaacaggcagaattgctaattctttaaactaattgctttagtccactaaactaataatactaatatgataagaacttgatcaatcgccttcatggcaaaaggaatattcctttctagttatggatttgctatccccagtttggaaatgattagtcccactttgtcagagaatgatttccccttgtttaccattggatgtttattcttatttatcacatcatgaaataaacttgccttttatattttagggggggattccaaaccctgagagggcttgatcttaagaattttctaacatctagcaaggattctttttcttatttcatttcattgttcctaattacaactttagttttctctaaaaaatattctttgcccctcaactattataaaatcccttataaaaaaccacttgaagaacgatgttacatcatcatttctatccctttttaagtcagcatttaacatcatattccttttaattttgccttctagtaattccttttgttctttaattgttttgacaatattgatttttctccaagttgtcacctaatttttcagtgtggatatcttttttggtatactttcattagttaccttgttcacatggttgtaattgctttctaatttccatattaaattttagaaagttcaagacttttcaaagctagttaaattagtagatcagccttttcttttcaatgtatagggttttgtttttttctttgccatcagttcttgttttgttttattttgttttgttttacagagtttgatttgtaatcagttaatctctttccacaaaattgccttcacctttagatctttttggcattctttatgaaggcattctttccatggaggggaattttaggctcacttaatagattttcagtattcaatagttgttgcttaataaatttctagttttccctaaattatcatgttaaattgagtaatttggtgttaagtgaccctcctcaattgtgtggagctcacctgagacttcttgtgacttagaaataagctaagtaaaaaaaacaaaacttaggagaattcacttcaaattgtgttctttactttgtagatcaagcttttctgtttgttagacagaaattattatttttaatgtttttgaatttacgtttctgttttcaatgtttggtcaggtgtccccgtcaggcagtgtggctggtgctaagtcaggtcctttcccgtgtcctcacctggtttgtctcatcaccaccgtcttcgtcacagattgtgcttcagggggttggagatacttttgctagtgtgtggtgccatccctctacctctactcctgtttctcttatatagattattacatcagtattgacatcccagttctgaaaatcagaccgccaggtatcaggtatgcccactaagccttattcaccatcaagttacttttactcaaagttcatcttatatcccatatccttttcatttttggatcaacacataggatataacttttgaaaaacaatcacactctaagctttcattttggttcttttgagatcttagtgctttcatggttttctcctggttcttcatctaaagccagacatttgtagagatatgctcagaaagacatatgtatgtatagtaaacttcagtctgactcatcgatcctctgggtcttgcttgtctggaggtcgacagttccctttaataagagcagcctacacctgtaagtgcttcattttcatgattagtataaattctgagaaagctataaggaaaaatagcatttgttgggggggaaaggcagttatttgcttttttgt

SEQ ID NO: 133890 - DNA, 1076 bp, Homo sapiens
ctcccatttatcgtccactctgtggttggccatcagaggaggaaaagaggaaggaaaaacccagtggtgacagttaggactcttgttagctttttctgatgggaggtttggtgggacaagacattgaaaccattagttacaatgaatttttaagaatttcatctcatccatgctttcttcgtctgccatgtccatgaataattgagagtgttccatgtggctccttaaatacctgtgacagtgattgatgaccctcatttttcctgttatattttttaagcccttctcctaggttaccagcatgaatgtaattaaggtaaaattagcactgacccctgtgttttgaggagggtgggtaaaggatgagaaggaactttgtaccattatagtatttgtccagtttctttctcccttgccttgacattcctataattgccttaaattcttttaacagtttcacatgccaagtgcagaatataaaagatggaaaatgaagagctttaaagacagtattaggggcatgcaacatgtctgtgatacgtgtaagaattattttgcatataggtaaatatgacaaattgaagtaagagtctgttgcccagtaatcagatgttggacaaagtaactttactggaatttggttcttgagctaatcggtcagagagattaacttccatatttgtatttcttataaagtcagaattttttgtctgtatttctctagttgaggaactttggatgatattgaatattttatctcaattgatataagagaatgaagttagaatgtgaatattgcagctattttataatcaagggttcagatttgggttctcccaattaccagctctgtgaccttgaaccctctgtgacccgtctgtacaagggagtactatttagaggtgcctgcattctatgttgtttagagatggcagtgagataatgaaaaaagcagtgcttgatatatatttcttaagttccccataaatattaaatgttattatttatatataacatttagggaaagaaaaacaccacataatgtaagtttaaaaaattttcaaaggaagcaaatt

SEQ ID NO: 133891 - DNA, 1054 bp, Homo sapiens
cataaacattgcattcttgaaaagccaccaaagtcggaagacaaaagccagagcagggctaaactttgatcctggataatccacaaactaggcctttcacatgcagatgatcaagagttgactgtactcgtgttaatgtttctcactctgcttatcagacactagaagcgtgggctctacgtatagaaggtaggcacccagcacttaacactgagggaagtaaaagtctgcacaaattctagtagtatgtatggttcaagaaccatatttttgttgtcttctttcatttataagctatccatttctccaaaagacattttgacagtcttattaataagttgcaattaaaaaccttgacatataaaataatgtgaacataaagtataaatttattttagaatgtaattataccaaataatcttttaatgtaactatttaaaaatgcagaatcttaatagagtgttcagttttgacactctttctgttaatacgttacctgtgtgcagatctgaaatgtgaagtgttattttacgaagagattgtggagccctgggctctaaggagaccacacatcattgctcattttgtcacacgtcagccttaagtacagtgttactctacactgcggaacgctttataaacccaacctgaaatacttgagtatgtttataaaatattctcttaaattcaaatgtgttaaatcacataagtatttctgttcaaatgaggccagtgttaggtcaatataaggtaatggtaggactacttagtggtgctgttttgttgaggaatattctgttaactttggagagttttactaagactttgaaagaatttaatactgtagtactcttattccatagaaattactcttttcaatttaaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagcc

SEQ ID NO: 133892 - DNA, 1742 bp, Homo sapiens
gagcaagtttaatcctggagataggggagagggacctgctgatgcagatgcaaaagctgcaccgtaaaatctgtcaatcaagctgaaaactctgctcacattttaagatatatttgtttctcatgtgtaagggaaaataaacccacccaggtcagagagagccatcttccaggactcatctcccagggcccttcctgagccccatgctagtgccctgttgaatgacccactgcagggagggtggccttacaatactggtccccagggaccatgggcacaggacagtgaggtgacaagaggggccaggagacccctccatggcagctggaggaggcaggggccactctgcctgaatacccagcagggccctgagtcctgtcccttacacttctcccctctctctctaccccgggtcccacaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggtaattatacccaccccttcccagagcttctgcctgccagcacttccttcgctccatcgtctggcgccttccttcctctactgtcctcatgagcccctcctccagcagaacggcctttcttctgggtccccgctctgaccctcattgaccactcctcctgagactctctgctctcaggtctcagcagcggctctgctgtggccagtctctcctttcagggtagaccactgagtgtccacctagaacagaacctttctgtgcacctgggtaacctgaccatcgcctcgtgttcataggatgagctgctaatagtggcgtttctttcccaagcagccatcttttggtaaagattatcatgcttgtatagaaaatgctaatggtcacagaattcctgacataaaaagtctgtcacagtttgtttcgcagaaacatttttaaacaaagatctaatgttgggcatataaacaaggcagtttactgtagattcccagtgcttctctttgcatttgtattaggcttgcaaaagagaaaagggtcttaacatttagcataggaagcaatgtcttgtgatggtgctgtaattggaagtcagtgacctgtatctttgtcctaatcccacattttgggactgcagatctaaatctgcccatcaagtcacataacaggattaactgttcagatgtgattttggagttgcattgaggatgggcaagcctttctctcttgatcaacaatgtttttccaactcagttacatgggatagttagggaggccagcaagggaactgtgcggaaaggtgacttgcagatttggcgacgggtcagcccctctgtctgcaggtcacctctcctttccctggtgcagctgcatgcctctctgcctcctctgtctgcccaccagcctcctgcagtgtgctactctgctctgtgactgctcctcatgcagctcgcagccatgtttcctctctgcttcttgatttgcttcagctccttctagtgccttgaaactgaagctggcctgtagttgggatcaaagatggagggagaggggagattgtactatggatagtgtagggcaagaagtgaattcttacactggaatgataaaaggaacctgcttcctgagtttcttaaaattgtgtctggaactcagatttgcactgcctagtatagtagctgctggc

SEQ ID NO: 133893 - DNA, 1033 bp, Homo sapiens
gttggacagtgctgaattgccacagctaacaccaagatgatagttgtttattatccattctcactgtcagaaaacaagatgcttggggctctggttttgtttgcttatttttttgtttttaaacagaagttttgctgccaattagcaattagagaattttcttaggtcagaaaacttacaatttgcagtaatcaaaagaagttagtaaattctatttgtgactctgcttatggaaattctaatttaaaaacacagtaagaaatacaggctagatttattgattctatgatgttcagttaaggtagtaaacctagaagtattcgcctaaagagaaaaacattcttgagtttgcagattgccatcttggtaatatagaaggcatgccatatgcacctgatgacactttattgtatctgtttctatctaaaaagccttgcacatttgcagttgtaacctaattcagttctcatgggttcttcacagtagtttaaagtcaaacagtgtgcacatagatacactacataataaaaaattgtacaaaacaggagaaagtagcttcatagtaaatataaaccaaaactgaaaagaagtttcttgcttgtatctttttgctattcttaattctgtgattgtaaagattttgtctttttgtatattttttatgcaggagtccaacctataccttctcagggaggcaaactagaaatagctggcactgtggttggccattgggctgggagcaggcggggccgtgggggccgggggcctttccccctgcaggtggtttctgtcggaggaccagctagagggtaagttctgagccacgaaaatgtcttttgtataagtaaagaaaacagcttctaacttgcttttttttggaagtttaagtaggaacatttttatatcattagatacattcttctttaatatcatttgtatttaattatttagtttttatttatttatttatcttaagatggggtctcactgtcacccaggctagagtgcagtggcacaatcacagttcagtgta

SEQ ID NO: 133894 - DNA, 1027 bp, Homo sapiens
atttatagtattatgtaattatttaattaaccattaaataattaacaattattaaataattaaccatacaattttcaattaaccaggtgccttaatatttttaaagtattagttttcaaatcaaatgcattggatatgggagatgtagctcaggggtagagcatttgactgcaaatgcattggatatgaaccaaaaaaataagattgattccttggaataaatcttccctatgatcatacttaacctgtttacgcctagtgttccattattggaacgcaaagcatgtgggagttctttatgtcctactgctcaaggtctgactgcaaaaattcaacaaattgcaacttccggcataaatgggttaattcagtgcttcataaaacgtaagattggatggctttaaaatcatttgatactattttaaatgttgtctgtaacagatttaagtgtttactgttgtcctttttcattcatttaggcgtccaagaggagttatttccaccccagtgattagaacatttggaagaggtggaaggtactatggcagaggttacaaaaaccaggcagcaattcaggtaagaagacaacatgatgtttgtgccagttcaatgccctcagggatgtctcctgtctgagcttgcacttctagtacctgcgctcagacagaagagctgtgagggtaatgctttagctgtcaagtgtctaacacagtaactggcacacagctgctcaccaaatgtccattccctagagcccagatcattttgctgttaagtgcctcttcaggttgtctctcccctttgccatgaccctgtgtctctggtagcttcccgcctggtgtgacacgatgggcttggcttaccttgggcattgcctagccctgacagagctggaacagccacttgtagtttctttttttttctttctttctttttctttttttttttttttttgagatggagtctcgctctattgcccaggctggagtgccgtggcacaatctccgctcactgcaacctccacttc

SEQ ID NO: 133895 - DNA, 2543 bp, Homo sapiens
ggtagagcatctaccgcccaaaagtcaaagcaaagacagggttagaaggacccagctgggcattttctgctcttgaatctgcagagagtgtcattaggccaaaattggcatcctctctcttctgtttatcagaaaccaccttctcatttgttgtccttcattttaaacagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctttagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagtataaagtatggcgtggcttttaaattcacttgtaaaagctaattttatagaggtttaattcaaatcgaaacaactactgaaaagatcagaaaaccaaagttgaaaaatattttaccttttcaaagtaattccaggtttccggcttagagggacattaatatatgattaatttgtttgatagctcagtttcaagcaaccaaggggataaaaaaattctgtttgataaagcagacttacagaagaggtttttttaagccctgaggaagcaataaatttgactccaccacgttttaaaagctggatgttacaagtatagtccgtttttcatgccatccttttgactgaaggctcttctctgcagcctgatatgaggtccccgtacccaggtccgccgagcgcctggagaaagcgccccgtgctgccctctagcgggggatggtgggctaacggcgccggaggcggccaggagagctgcggcgatcccgctccaggga

SEQ ID NO: 133896 - DNA, 1044 bp, Homo sapiens
ctgtgagttgggtaaggggggtttgttgtggctttgccacctcctccctggccttcagttttccccgtttctctcctctccgttcccggcaggaacgccggttttgacatgatcttatgctccctaaggaagatggggaggggggaaggaggtaacgcttggagacactgaaaacccccgccctcttggcccttgccgatggccatgacctggccccatgcctagggcaggtcccttcccaccaagaagtaaatggaggaggaggaagaggaggtgacagtgttgcccaaactgctccaacaggttctcttgcatctgactttgcctgtgggatgtgtttggacccggggctggccagggctgtatgccctctggggctccagtcccaaaccaccggcagcaagcagccgggggaaagagaggggtgtgtggtggtgggtggtccgggattctccttccagagaggagatcctcctgcaggttctaagactgggtcttcaagactggtcagtggtgcttaagagtgggctgtggccccaagtccagtcctgccagtttacatgtggggacctgggtggctgggatgtgacagggcctgctatgtctgtcagccccagtcctgagtcctacctccctgctgttagaagggcctgggactctgtggggtggggatgcccacggaaatctgggctgccttcctgggtatgcccagggctgtggaagccccttagagcaagggagactgagtgtgaacaccgggctctgcccagaacagggctgacatgcacaccctcaactggcagccgttgagaagttcatggccgggccaaagtgagtgagagcctctaaggctcctcatatccagggatgctgagctgctggccctgaaaagccctgaaagtggtggggcctctgccttctcccccatctccaccggagccctgacctggcgagcgcagtcactctgctacagaaccttctgggcacctgtgtcagctcctggctgctgcccacactcggggcccagagtagggagagtgagag

SEQ ID NO: 133897 - DNA, 1026 bp, Homo sapiens
ttggggtcatgcatcctgcattcactggaggggaagtgtggagtagaggtcggggaaacaggccctcctttgaagcccccctctgtccttgggatgtgtgtcccttcaccaagttctcgcaagattcctcctccggccccatcttgaccgtggctcatcactcctggggtggggatcctcgccagcccagcccttcttcactggcaccgactggagtgctgtcccagaatgtgggctttgacctgggagggatggatttttgtggcaggacctggcaggaggccgctggaggccggttgccttcggaggtgtcttgtctgcctcatttggtggggatgtgtcgctctgcaccggcactgaggaggacctgtcctctccttttagggatcctactcttacataaagccacttgggccgtacactgtgttcccttgtgcctgtgccttccaactggaggatggagaccaggccccatgccctccactcctgcctgcaaagtgagctggcatctcactttgtcaccaacttactttgaataatttaaatctctgggaagcaggaatgcttctgttaaagttttaaacatccttaacatgtagctttctggccctctttcagctgcttgttctattggactggaagggtttttggaggtgtaatcagtaaaactgacttgaaagaaattgaaagctgttcaggtcacttaagtgacagacatttcattcatacctcagtaaatatttgttgggcttgtattctgtacggagttcagagctggctgtgagggcccaggggttagccaggcagcttctcagattggtggcagccaccctggagggggagtgtctcagcagaggaggggcgagagtggactgaggttttgactgtcccccgtgttgcatgttgctgtggggagaggttgggagaaggttaggggcagggagccagtgaggaggtgactgtcaccctgcctgtgtacccagggggtggggagtgaggactggggtcggtagaagggtcacattc

SEQ ID NO: 133898 - DNA, 1047 bp, Homo sapiens
cgtggccttgctgcacgggcacctgcctctgcataccatgtgagtaggacgtgtggactgggggcgtctcagggagcaagcctcttttcacaagcgggaaactgaagctgcacagtgagttaggggcagggtggggaccagagtccctgcttcctcccttgacctattctttcccttacactgaatttttttctctgaatgaaatcactgtaacagaattcagcttcgatcctaggaagactccagaccctgggcagggtccatgtgggtggggtgtcctggcctacatgtctgagtgcagggatcccctctgcctctggccttgatgagtgataatctacgtcacagcttccctagcaagggagtcagaggaagaagcccgagagagcatctgtcaagagcccagtgccccacagggacctcaaccccagatgcttggccgttgctcggggacctagctgtgtggcctgctcctagtctggctgctcacctgcagaggccttgaggctctgggctgtgaatacatacctgcccgagggcattgctgggagagccagctccttccccagctgctcagcgcccactctgcttcctgccttctctggtgtttgtgcatttcactctttacccaggggtcattgtaattctgccttaaccagggacaccttggtccccattcttggaggtccccagtcctgccaccttgtgatgggtggcagggccaggggctctcagtgtgcacctcccaggagccctttttcactggggccacacttctgttcctggcctgctgggatctcagggtctttttctcaaactcctgggggatccctgggaagatagttgcctctgcaggggctgctggtccccactgtgggagcagcggggtgatcccaggcagacacaacactcagggcgggcccattctttactcatttggggagcgcagcatcattgcccccatcactgacctgtttaaaattatctgcatcctttgcctagtgatttaagccataggttcttggtgaagttcccctagcaacactt

SEQ ID NO: 133899 - DNA, 1052 bp, Homo sapiens
ttctattccaaagctgacccctgagggctgcaccccctggacccaaggcacctgccaggtcattaattaccctccagggtatggtgggggctgaggacagggccctcacctcccttagtctagagttcctatttctgttaatatgacctcggactacatttgctctctggtcaaatttgtcttgtgtctctgaggcttttatccagattgaaggctgtaattcccagaacttcccaaaggagatatttgctctacatctgcatacaattggtttccttagaaaccactggagtatgctccaaaacctgctttggattttttaaagagaccatgccctttatctgtaatatctgttaaaaatccaccataacaaatttaaaagtatataaagaatgaatattttagatatttatttaatttatcaagaattctacactgttgaatgatgaagttgggatgactaggcaaatgacagtgtcctcttgtaaatcggaaattatgcagtcgtcagcagtgatgtttacagcaaggctttaatgctatggggatatctttatgatgatattaaatgaaacactacacacataatgtgatggctggtgtcaaccaattaaaatggaagacggtctaggagggaatatgccaacatgttaaaggttaagattacgtttttcctaccacttttgtacttttctgtacattccaatttgttttccaagagcttaatacttttataatcagatataaagtaagcaagggagtaagaccatcagggtttagaggtcatattgcctggcctcctgttttacagattttatggactgtgggttttatagacactggggcttgggtagctctctctgctgcacagcaattggccccaggcctccctgaaggagctgtggtgggtgaggacacctcacccttccggagatatctgcccttccggcacaccccctcttctcatgtgaccccccccccctccattaatgcacaatgcacattagcttagtctgcagcctatctgcctgtgttggccagagctacccgag

SEQ ID NO: 133900 - DNA, 1066 bp, Homo sapiens
catctggttatcctgaacttttctttgtcaactacagaaaaggcttttccctttatcagtctgccaattctcagagtaatgaattggtaccctagaaatgcaggggttttgatagcttaatttttaaaatgtaggtatgtctcatgaattacttggaacataacactaaaatgtatttgctgttcatctgaaattcaggcaggccaggcatcctgtgtttttatttgctaatctggccaccgtcgctgaggcctgtgacctggccgcctcacagcatcaccaggtcagaggagtggtcagagttgagccaggggaaaagcaggcaggtgaagctcgacgttggcacctagagcctccgcatccagcccctggcagctcctgctgtgtgtgagggcagccaagagtgtgtgtccactccacacgtcctggcctcagggaggctgtgccgccttcccagggtgctcaagctcctcccaccacctccctagggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccggtgagtgctaccaccctgggggtgtgggggctggggttggggcaggggcgctgtgccgtccttggtagtcgcctgagaagcacaggtcgaaggtatcagagtctggaatactgcacatggcacacactgatttttactgtttctctcttttaaattttttccttttttttttttttttttttttttataagactggcccacagctgactgtttctcttttaaagtatgaaggtgacgtattgagaacaattcaaacaaaaataaggagcaaaaaggcaaagcctcctctggtcttggccctgcccatcccactcctcagagagaaccattggtaacaatgtgtagttttttccagaatgcacacactcatgacacactcagacacatctatgacacacccacttccggacacacaacattcacgcttactcatgga

SEQ ID NO: 133901 - DNA, 1002 bp, Homo sapiens
ggagccagtgctgagccgcccctgggcctgggcagaagggcacacctcagatgttggactggttcgtcccactggggctttcctttcaatcaagggcttctttttcttttaatttttcgggtaaattcagaaccacaggttttcaattttatgtgccgagactgttgtttttttcacgtggaaatcttttgggaatttccacatgtactacagacgggtaactcagggggcagaggtgtagccccctccatggtgcccctgggcccatgtcgggggctgcagctgccatggggagcacagccctcctggtcttcttgacagctgcagattcccattgcacagatggggaaaccgaggctctgagggcttatacttgcacgtgggcacactgctaggaagcagcagaggcaggcccagaatttccatctgcctgattgcagaacctgagcttgggggtcctggggggttgactaatgctgggcagtgatatccgggtgtttgcggctggtcccttgtccagcagtgacttggattgaggaagatggagcctgtgcttgggtcctgctcagttcccaagatgtgcctcagagactctgtggtttccagaatccatgggcaacccagggccatgctgctagctgctccacacagccccaagcttgttcagtgggcaggtggaggcctgcttttagacagatggggggcttgggcaaggtagatgaagggcttgattgaaaagagcttttgctaaatcaattggccgtactttctttcatatattactattttacatgcaatattatgttcatgtaatattgatcagaaagccagctgtaaggtgcttttattttaatgggagtgaagcatgacaggaggcttccatagcgccttaggggacagatttcctgcttggcactaggtggttcctgtccatgttaagccccttgctgcagagatgtgcttgtggctggggttgaagcctggctgtgagctcctcctccc

SEQ ID NO: 133902 - DNA, 1735 bp, Homo sapiens
ggctgccccttagtgtcagcgggaccctcccccccaccggcatgccacgccccttgccatctagcttaccttccctttttgtgtcccctccccgactcccctaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtg

SEQ ID NO: 133903 - DNA, 1069 bp, Homo sapiens
cgtaagcttaagtttttcaacctcaaattcttctgctacgattgctgtctagaatctaatcacattgacaatatttatttaagtgtgagcagagggcctcttacgtcagaatgacctagagtgtgaattgataatacagattattgcactccagattttcatttccacaagcaccctgcgtaatcctggtgcattccagagttagagagctagtgctgtgagagtctgggaaggattataccacttctgacctcccaggcactgcttaatgtagttccccacaaatttgtccagaaaatacacatgtagattttggcagaacaccatgtgtctgagaaatagaaaggaaagtagtgacctaagaattcttcagtccatctcagaacctagtctcttgtgtgaaatgacttttatgaagtaggacattctttgtgttctactgttcttaacagtatgagtaatagtccattcctgcacttacgttttaagtattcagtactaattagtgagtgtgtggctaattataaacagttgagtcatttgagtgcttttagggataaaaggaaactgtaggactgagtgagaaaaatatctgtcattgacaacaggaaatagaaataaataatatgcgattttgcagtgaaatgacagggttattattcaaacccttctctcctgattctacagccaggcatatgatataagttcagttgtgaatgaaaataatgttttttaagtcaaaggagcttagccattactaacattttgtttcttttttgtttttgaggctagagtgcagtgacgcgattacagctcaccgaggttgcagcctcaacctcctaggatcaggtaatcctcccacctcagcctcccaagtagctgggactacagacatgtgctaccatgcctggctaattttttttttaatttgtttgtagagacagggttttgccatcttgcccaaactggttttgaactcctgggctcaaacgatctgcccacctcagcttcccaaagtgctgggattacaggtatgaaccactgcatgcagcccattactaactattaa

SEQ ID NO: 133904 - DNA, 1036 bp, Homo sapiens
catattggattttgcctgttcagatctaagtgggaatcagtagtttctttgtttgtcgccatggaaaccagtcagccaatctgaatggctcttagatcatacagaacgatgcaatgctccctgctctcagtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagtaaaggtctctttcttcttatagattgccatacctatgtatataagtttgaggaatgggaatcagctgtgttgtgtttatacctttttaaatattggcagtttattctatattatactttttgctgtctgttatgctattttagtgaatatataagaggatataaaatgatcaaatgttttgtgtttttttattaaaaatataggtttgaacaaaactcattctcttgtaaaacatctgcttctacagtttcttcctcctaattgccagtatgtgtggagattattatatgtgaaagcttttttacattaagagatatatgtcactttgacagggaaacagttttgttttcttgacaagatgaaggtgattttgcactggcttgtcatctaccatcctgagataaaatggaagctatttcccatgttacaatttcatttggagagtggaattttgaattttcctttccttatatgttctaggaaatttagaacgtccaacaccaaagtacacaaaagtaggggagcgtttacggcatgtcattcctggacacatggcatgttccatggcgtgtggcggtagagcttgcaagtatgagaaccc

SEQ ID NO: 133905 - DNA, 1682 bp, Homo sapiens
ggaggagagaacttttgataaaaattttgttcttcagaattgtgtttcgcctatccaatagttaaatgtattgctttcttccaaaatgaattgttttctttattttctgctccaaactgaaaaagtctttcattcagtcagcaaatatttcctgggcattactgtgtgttaagagttagcaagaaagagagtcttctattttagatgaaaatctcgcacccccactcctgggtcagccccagtgcccatgcaagctctgctgtggtgatgaagcgttcaggacttggtttgggccagaccgtatgtagtgtatatgaaagcattttctggaggtgaacacagacctttaatcaggatagttttgcatttttttccattctagattttattttaggacttttagttatcaaaaaaatcagttgaattctggaaaagaataaaatgaacattatttgaatagtataatgccacccatgcctgtactagaccatttcacatatattatttcatgtgatttttcacagttatcatagaacatatctgtaaggcagatgatactatttctacagtctttgttaatcttgtgaattcagtatcacagatgaggatgctaaaggtcatgaaggttagagggtaagtgacttgctcagggtcacgtggcatgcgtgtggcagagtcagggtacagcacatgtgtttaacactttccattatcccaagattcttggctaacctccctggagagcctcaggaaacatcatgataagatagtcattttgctaagagcatttttgattagtgtcagttctgcccagcttgtctccttcataagattgaatcaagagctactttgttttatacatgatctatgggatatgaaggactgtgaataacaaagtattggtgtattcataagataataaagagaagcccagtaccagagggcccttgtggcataatagaaacagcacagactctggagtaaggcagaactgggtatgaacaccccctttgccattttctagcttttggctcctaggtgagttatttcatctttcttgagccccattatatgtattggtgaggaagctccctgctgggtgccatttgagagttagagataagacatgtattacagtctctgtcccactgtgtgcatgtagtaaatattgggtaggtgaatgaatgagtgaatggtagcaattattacacttaacttctattttgttaaaatgtatttgactcactaaaacataaatctgaaccctgtcagaaattcatgaaaatccttatctcacttttcccttgctctctgtgaggtaaagtattaaaatctcatgcttaaattttctctaggcatttggagtattagaaaaactttccagttatcttccctatgtcaaatttcaggactcggggcttattgttaaatcctacataggatgctaaaaagatatttcaaagaagtacatatgccccatttaccagctttcaagcacctttattttatttttgcagacttcgaagctcaaagcttttccttttccttagaccccaggttaatgtataaatgttcccttatttctactttctcatctaccatctactttattgcaaaaaaatagttctgttttgttcaccagaaggctgaaaaggaagactcttgtgaactgtttctgtggt

SEQ ID NO: 133906 - DNA, 2432 bp, Homo sapiens
ggccttgggggttgggatgaaggagggaaggtaggaagtgcgaggggcggggggacagggcgggaaggcgcgggcggggagggcgggagagtcgtggctggctgcatgcccctgctccccgcggccaagtgcagcctcccttcctgaagcagctgctgcggctggaggtccgctgcggcagccgtccttggcgagggggaggggaacgcgggagcgggaggaaatcgtatcccgggggacggggcttggagatttgcgactcggtgtcaccggaaacagcgctggccttttgagtcgacgctgcaaactcttggaaccgagtgcctctcagaaggcttgctaataaacttcccgggcgggctctagtgtgaggaatgtggtaacctgtatgtccttggccagtaatgcccttcggtctttcaactttttacagtagattctgtgtcagaggtaatggtatgtattcttcaacttaccggtttttaaaaaattgactaacgagagggcgggcagacaggaaaaaggcagggaagacagtgaatgttaaaattttgaggtaaatcaggagactggttgagttttgctttttaacttcattgataatactgctttcttggcatacagttcctaaagttaaagcatcatgtggcattcctttgcatttatttctgttggcctgaagtataagaacattgaatgtcaaattccaaatttatgtgtagtttaggaaataattgtttatatccagaattcttttggtgtttggcggggtctggttttatttactgtatattcgggaagtatgtgtagttagggaagtaaaaacttggaagttactttgggttttgtgagaatgtttgattcattatacatatttgttaaaagtttactttgaaacttcaactttgagaatagacaaatttcttgacgtcctgtaaattcagtggtattatatagcattttaaaatttatcacttaggtgcaattacagtgtgaggggaaaagttaacttttttgaatagttacattgcagtgacagcaagagagtatttttatgtgtagacaggctgtgggttcccctcacttaaattgaagctctgttgaacttgagacacttaagaatcttgcaagtgtgaaaagtggagtgaaacaaaaccatttctaaaacgaaaatgtgtaactgcgttcagttttacacagtgaagaaataagtattaaacaagttagtctcaaacgtttatatcttaaggtcattttattcctgttatcattaactagacatatcttggtttagagagcagcacacaagacattgtgtacttttaatagctaagatagtataataactactcatatgggaattaccgagtgttaagagcgccaaactagtgtttcaaactgtaggtcctgagttatagggtcatgaagtcactttagtgggtggtgatccgaattttttaaaaagtagaaaatattccattgaatacaaaatagcgtgttgattcagctcgacacatgtgtattcctgtaaaataatcctgtgaagctgagtgtcaaaagttgaaaaacaacttctgtagggtgtttttctcgtttatagcattgtgtaaagtattatagtttaatattttttaacgagtattaaatgggctgtttatatttggtggaacatgagccacctactttagtttcacaagttgggaagtaaatttgccatccaggaccagtatgcgttttaatcatagtatttttaatagcctgtgaagcttttctttagaccataagaggtcttttccatcccataatatttattgccaattatttatccatgtctagatgagactagaagaatccgaatccccagtaatgagttgtcagcattgcttaatgtgacctcaggactgatcatcatatgctttttgcctgtgtaggtgttctaagcgttgtataatcacttaagaatggacttcattaaatagacaaaatatgagagccattacactatttttggtattaagtctttgaaatccagactgttttacacttgcaacacatacacttggggctaatcacatttcaggtgctcagtagcaacatgtgactaacagctaccaaatgaacagtgcagttctagtgcactgtttttaaaaaaattagatttttttttaaaattagatttctctagctgaatagttgtagtttcagataaacagccaaaaatgttctgtctctccacagcttcatctcaattgtgaagaaattgcattaggtgatttttttttttttttttttttaaataatagaaacaacgtctcactatgttgcccaggctggtctccaactcctgagctcaagtgatccttcttcctcagcctcccaaagtgctaagattacaggtgtgagccaccgggttcctggccgaatcaggtgat

SEQ ID NO: 133907 - DNA, 1050 bp, Homo sapiens
gtgtagactacatagtggttttttcaacccaggaacataacagtataatggaggataggaaggcagaagatgtttaaagggttgagaaataatggtatatgtataatggtcagtaagcagaacaagccagccaagttggatattcttcaagactatcttaagtgtctgctatgtgtctaagtgaaaggaaataagcaatagtccttttgggaaacctgacctagtacttagctatttcagacttaatgtgatgtttgatagagtaggaaataagatcttaaattagaattaggttaaattgctttagagaaacttatttataaatgtaaagaatttattatctcatgtgttgcacatgctctatcgaagggagcaaaatactattggagagtttgcttattaatgtaatactcagcctgcatcattgtcggataattttgttgataattcaactatttgagattgaaagaaatctgttaaagtagccagtgttgtaattttgatctgtgtttgattacagcgtatgaaacaaaaatgagactggaggaaatagtttacttgtgaactttttgagctactttgttttaggagtatttaaattaatgtaaaagtgtagggaaatgtcttagctcagaaaatttaaacttactagatattaagtgcttaaaaggtagagtatgcttgcatttcaactaaagtttagagtgttttaggaaattagaggctattttaaaaaatattttgaagttaggagtgtgttcctaagtgttttcaccataagaaaataagtctgtggggatagtacatatgttaattaacttgatttagctataatataaacctattttatgtacaccataaaaataacaatttttatgtcaatttgaaacaaattcattacaaaaatgaaattaggaatgtgaatgttaataagttatgaaaacttacttgatgtaaatgtagatatagacaagtctataactaatagatttgcctgctttgtagcatgctttaaattgataatatttttaactatcacaagtatatctg

SEQ ID NO: 133908 - DNA, 4635 bp, Homo sapiens
aggaggcggaggtttcaggagccaagatcacacggttgcactccagcctgggtgacagagcaagacctcgtctctaaaaaaataaaagtaaggacagtgctgattcatgggaaatattttggcttataaagggcctgacgttagggacaagtgtgtctgtgagttcctagtttgcataacctggccttgtagaattgaaatggtctcaaatgtagtatagtttagtgatgcagtactgtctctaatttggggcaagttattaagcttcttaccaccagttttcatctagagatgatgaagtagttggaccttacatattttggatatatggtattaataaatctttccctttttgttacagacgtgttgatactgcagctaggaaagctgagggacttcggctaaatttcttttgcaagatttcaatggcagagaattagtagggccaggatttgaaccctggtttttattgactccaaatgagtaatgctgtgaacattcaaatacacgttttttcaattctcttgccctttttttttgcggggaggggcagggtctcactctcttgctctgactggagtgcagtggtgtggtcatagcttactgcaacctttaactcctaggctcaagcaatcttcctgcctcaacctcctgagtaactcagctgggaccataagcctgcaccaccacacccagccatgttcagttctctagagtatatacctagaaatggaattgctgggtcatatggtgaactgttttttactcatcactaaccagttctgacaccaacaatcaattcttcaactcgacaccaacagagtgtcctacaattaaatttaattctgaaactacctgaagttagtacaaacttcacaggttgagggctcaaacacgtaagactgcccccgcttcagatgcaggtttctacctgaatttttaaccaaccagctataaattagggggtttcacaacctcttccactgggtctataatttgctaggatggcttacagaacacaggaagacactcattatcactggtttattataaaggatttaaatgaatagccagatgaagaggtccttaagctgaagtccaggagggttcctagcacaggagcttctgtatctatggagttagggttacaccagcctcctggcatgaagatgtgtttttcaactcagagctgtccaaaccctgacacttaaggggtttttatggaggtttcatacttaggcatgattgattacattattggcctttgatgattggcttactctctgtcctctctgctttacctggaggttgagggggtgaggctgaaagttccacccctctaatcacaccttggtctttctggtgactatccccctcctgaaactacaggagccaccaatcgactcagtagcattaaacagacattcatcacttaggaaattctgagggttttaggagctgtatgccagccaggatcttcaaatggagacaaagacgaaatacgtgtttctgattccacttaacaactgtttgacttgtctacaagttttgttctccaaagcagctgcaccatttcacattcccaccagcaatctaagggttccaattttctccgcatccttgtcaacacttttattaatcttattagccatcctaatgaataatgtatcttttcatgtgcctgttggccatttgtgcttatgagtcatatctttggtgaaatatctattaaaatattttaccattaaattaggttgttttaagttactttaatgtgtgttttgcacaccagtttacaaagaatgcagatccattttttttgcatgtggctatacagccgtcagcattatttgttgaaaaaacgattcccagttgaattgtcttgtcatggttgaaaatcagttgacccatgtatgggtttatttctagactttaaattctattatattgagccgtatgttttttattacgttttgtaattttaaaaattagtgcttttggttactaaatcactacaaaataaatttagtccctatcttaaaagataatcttcgtagtagctacctcctaaatatgaagtctgtaaattaaagggtaataatacagtttagattacttgggtttattaaagattttggactctgccttcaatccacatattacctttctatctaaaggaaaggatcctgaccctgaatcagatccaggtgattatctttgatttagtcctaataagaccacttagtgtttgctcgcatgggataaatgagtaggttcctttaaaaattagtttctatttgtgtgtgttttttatattatctcgttgtatgttagtgcatttggattatgcatgatgtacaggacttttgggttttgaagtcattggatttttaattagaggctgtcatgtttttctgtaatgattttttgttgtttcttgaaggataagttatttcatgcattttcatttgtaggaactgtaagaaaaccagcagttaataatagtaaaaggtggtggtaagagggtgatttctgaatcttgtaaatacatggttttaggagcggattcagataaccaagcatttaaaatactattaatgaaatacaggaaatgaaaccacagcatagattatgcatgtagccaaaatgttcagttaaacttcattttcaacgtaagtgaatgaaaatggtctaatactatttttcttatcactcacacaggaaaccaggattaccgaggaggaaaaaaagccttcctgtggtgctcaactgtgattccttttcaccattcaccctggatgttctcttcactgtgggatgaggtagtaggttgtatagttttagggtcacacccaccactgggagataactatacaatctactgtctttcctaacgtgatagaaaagtctgcatccaggcggtctgatagaaagtcagttaactaattgtacaatatttaagattaacttgtcttaaagagatgtagtgcagcatttgtttatggcctggaaataaattaatttagagataaagtctgtagcaagtacactggatgggggtggggaaaccttttgcttcttgtcttatttctctgtgtcagaataaatgtatttttttattttgatttatgctgataattttatgttgaaattttctttcgaaagagattgtactttccattccagaagaaaacattgctctatcagagtgaggtagtagattgtatagttgtggggtagtgattttaccctgttcaggagataactatacaatctattgccttccctgaggagtagacttgctgcattattttctttttatttagatgatattaaaactcagaagaattaattttgacattttgtatttacagtttatcagttaattttctctgttcaagtagtacagtaggcacagattaacatttaaatttttcacatatggtatatttcagaaatttgaagttaagcaaaaattttaatgagtagagaaagtaagtagccttcaggaaatcttcatagaggaccaggcccttttggaattgtgaataggtttattgccttacatcctggtacacatgtccaaggtcaggtcctgggtggtaaaggtaaatacaaattggaagggcactgtgtgagccaaaatgagtcagattagtcatgattcatttccagtttgggttttgggtggtcttggagaatgttgtaagcactgcttcattgataggttgattgagccagactttactcagcagcctggaaaaggagagatgggctctgggttctacctttgctcactggtaagttgctaagatttcagctttgccctcaaaccctgaagtagtccttcattcacacagtgggatcactcgaaaatgtcagatggggaagtccataggttgttactttaaagaaaatagaaaaaatgctggaaaaggtttcttcaattttaatacccatgaaggcccatgttttagctttcctccgatgggcaaaccatacactaacttgggccttgtaatcaacaagcaaggctaaaagctctctaagtgcttgctgtttaaactattttgtgttggaagaagagttggaaaagaggcagtgtggaggtgagggagaagttccctccctccaatcatttccaataaatggaaatttaaggagaaatttgtgtttatccttaatatctaagataatcactgtgcagtgccattggtacttttcatgagagtagaaacatcaaacttccttggatgggcccaacccaggtgacttaactctggaccaaatgtatgctttttgttttatccactgtggacagctgcatagataattggtctttgttctaaactgcacataaaaacatgggagaaaatgacatttgttgccttttgatgtgccaaagaagagtgggaatgttctaagaattctttttggcttaatctttgttgaattgaaaatatgtataactcttctgctgaaagtgtagcaagtacagtcatgaaattttgtggtcttcctgacatgttcttccagcataacgttgccaccttcagttggaaacgtatccttatctaataattaagccctggagaaaaattaatttatatattttattaattacataaggacatt

SEQ ID NO: 133909 - DNA, 1893 bp, Homo sapiens
attgtcacctacttttccagttaacaggagagactggagattttatgaaatttgatatttaaatgttggtaactgggttgggcaccatggctcacacctctaatcccagcacttcgggaggctgaggcgggtggagcacctgaggtcaggagttaaagaccatcctgaccagcctggtgaaacacagtctctaataaagatacaaaaattaggccgggtgtggtggctcatgccggtaatcccagcactttggggaggccaaggtgggcggatcacctgagtcaggagtttgagaccagcctgcctaaatggtgaaaacctgtttctactaaaaatacaaaaaagtagctgggcgtggtggtgggcgcctgtaatcccagctactctgggggctgaggcaggagaatcacttaaacccaggaggcagaggttgcagtgagccgagatcacaccactgtactccagcctgggtgacagagcgagactgtccaaaaaaaaaattgataattaaatgttaaaagtcagcgactccagtaatacgtggtgggctgagtattagactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaagaccagcaagaaaaaaaaaatgggttcctaggaagaggtagtaggttgcatagttttagggcagggattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaactagtgctttttaagtcatccttaacccttatccccatccttgcagtagtagatgcatttttcatttgtaattattatgatttgttcttagtttcatttttcattagcaataatttggtgattggatggtcatttacagatgttttaataaagctaacacgagcaatttccagctcttccatttttgtaaacacttgtgtgactttgtacagacaattaactgctcaggatcaccctcctttttgttttgtttttgagatggtctcattccgtcacccatgctggagtgtagtgaaatgatcacagctcactgcagccttgacctcccggactcaagcttcctagtaactgggactac

SEQ ID NO: 133910 - DNA, 1049 bp, Homo sapiens
caatttctccataccccacaaaaatatgtttttcttttttctggtagtagttatcctgtttgtggaacagtattttttatttaatttatttttaagtaaaaaaattttttaaacatctactctgattctggtctatggaacagtattctttttttttttttttttttttttttgagatggagttttgctctgttgcccaggctggagtgtagtggtgtaatctcggctcactgcaacctccgcctcccaggttcaagcaattctctgcctcagcctcccaagtagctgggactacagatgcttgccaccatgcccagctaatttttgtatttttggtagagatggtgttttaccatcttggccaggctggtcttgaactcctgacctcatgatccacccgccttgtcctctcaaagtgctgggattacagatgtgagccattgcatctggccagaacagtattcttaatggtgaaagattaaatgctttccttccatgattgggaacaaaccaacgttatatctgttcttaccactctcattcaacatagcgctggaagttctaaccacagcaataaggcaagaaaaggaaataagagacatacagatcattaacaaagaaatgaaactgttcctatttgcagaggacatgattgtctatgtagaaaatctcaaggaacgaagggaaaaaaagcttttaaagctaagtaaagtttagtcagcttgccgtatagaagaaaaaacagacaaacaattgtatcatatgtcatagcatgaacatatggtcactgaagttaaaatacagtaccattaaaattacttaaaaaaaagaagaaagctgaagaaattcttaggtgtaaatctaacaaaatgtgtagggtctgtttgcagaaaatcacaaaatgttgatgaaagaaatcatagacggtctaaacaaatggagagacatactgtgtttatggatttgaagatccaatatagtaaagatgtaagttctcaccaaattgatatacaggtttaatgggaatcctatcaaaatttcagcaaagg

SEQ ID NO: 133911 - DNA, 1046 bp, Homo sapiens
ccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaagatatatacttaggtgtgtagtagctggttcacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttaggtctttaactggaattaattttatatgaatgctgggagatagaaataaatttttgcctgctttatcttcttacttgtttattttcatggtttcctggcattttatttttgttttattttttgcttttaaatgtaactatatagctggtattacactatgtagcaactgag

SEQ ID NO: 133912 - DNA, 1160 bp, Homo sapiens
tcacactttgagagggcaaagcaggaggatcatttgaggccaggtgtatgagaccagcctaagcaacatagcaaaaacccgtatctacaaaatgtttggggtttttttttgttttgttttgttttgtttttaattttaaggtgattgtggttaagtctcagacagaaatgaggaatgggtaatgggaaactggaatccttgcaaaggacttgcccaaattgcgttctagtgttttgtggagtacagaaattgtgagtgaggcagtgcagaatattcaggtgatatttctacacaaagtgatgcaagtggagtctgttttctccttgctgcttatagtaaaatattagaggagaaagataaattgaaggaactgttaagcaaaaaagaaccagtacttaaagatttggaaaattctcagcctgtccgcattgcaaaaaatgagaaagtatgttcttgaaagaacactagggtgtggctggacaaccatgtgataaagagattagtataggtctgaatggaaccaattaaccatctcaccagaaatgctgccagcttgaactgaatagagaaagagacaggacaaaaatgaaggcaggctgttagacttctgggattctacgggaaggtacaatagagctatccagttgcaaacgcacgttaatcttcaagaaaagggaagaatgtgattctcaaaggttctaatgggcccagagagtacaggtctagagggcaagtgtgtctcctcctcaatttcagtgggccaggagccgctgccaagggccaagggagcgacactgcagctcccgtgagcctaaaaagcagggctgccaatccagttggcccagaaggcagagcactgagccaaaggggattattctcgagacttaaaatctaatggaagttgccttgccaggtttgagacttgcttgggatccatcattcttcatttctttctcatgtctttcctttggaatggggaagtccagcctctgcttgtcccaccattgtagaatattgtggaagcagatatctgtctggtttcacaggatcacacctggagaattttgcctaaggatgaattgtacctaaagtctcattcacacttgatttagatgatatttaaatgagattttggatctagaggtgaagttgaaatgggt

SEQ ID NO: 133913 - DNA, 1036 bp, Homo sapiens
ttggcagccctgctttttaggctcacgggagctgcagtgtcgctcccttggcccttggcagcggctcctggcccactgaaattgaggaggagacacacttgccctctagacctgtactctctgggcccattagaacctttgagaatcacattcttcccttttcttgaagattaacgtgcgtttgcaactggatagctctattgtaccttcccgtagaatcccagaagtctaacagcctgccttcatttttgtcctgtctctttctctattcagttcaagctggcagcatttctggtgagatggttaattggttccattcagacctatactaatctctttatcacatggttgtccagccacaccctagtgttctttcaagaacatactttctcattttttgcaatgcggacaggctgagaattttccaaatctttaagtactggttcttttttgcttaacagttccttcaatttatctttctcctctaatattttactataagcagcaaggagaaaacagactccacttgcatcactttgtgtagaaatatcacctgaatattctgcactgcctcactcacaatttctgtactccacaaaacactagaacgcaatttgggcaagtcctttgcaaggattccagtttcccattacccattcctcatttctgtctgagacttaaccacaatcaccttaaaattaaaaacaaaacaaaacaaaacaaaaaaaaaccccaaacattttgtagatacgggtttttgctatgttgcttaggctggtctcatacacctggcctcaaatgatcctcctgctttgccctctcaaagtgtgagccaccacacccagcccagaaccttttaacatctacattcctaccaacagtgttttaaaggtcatccaggcttttcctaacatgtgcctcagaactcttgtagcttctttctaccgagtacccagttccaagtcacttccacattttaggttacaaagcatcccaatcacagtaccaaaatctgtattaatttgctagggctgac

SEQ ID NO: 133914 - DNA, 1082 bp, Homo sapiens
tgatactttgaggagaaccccaaggcattcaacctcttcggagacatggaggaattactctgcgtatttattctaggctactgtcctatgggacagggatattacggtcttcaacctcacctcttcctaagtcttccattgtctgtgatgagagccactggccacatgctcaccttccctgatgccagattgaagggcatttattcacatccctgtcatgttagctatgcctacgtgccagtgatccagcccttcagccacaaccttccttaaaactccaatcaggagctaaggctctgaagccacccacccttctatccagcccaagacactgcccccttagttatagtccctcctgttccctgatccccagagcccaaatgccccagatcctgacaaatgcctacaccaagaatggccctggccctgttccttcagcaccgaatgtttactgcatggtcagtctccccagtgcttggagccactgctggctcagaggggtttttcaccagaatgaaaagagattttagtttggaagaatttgccttgggaggatagatgaaagaagaatgacagatggaggtcactgaccccagcatctcagctggagacagtctttgggttagctttggtggggatgccctgagaccactggggacagcccttatcaacacattttcactgaagccattttgcctcagcgagttatccagtggccagagctgaagtcacaagggaagcgtgtgtgtgtgtgtgtgcacgtgaacgtgcacacgcatatgtgtggtatggggtcatttcatgccagcagtttaaaaatttctactgagaatataaatagaagtaataaccattccagcatatatattgaccttgtacttgaaagtgtttttccataatggaagtttctatggccattcacccaaaatggacctgataaatgatatataaataaaaaacaggctgggtgcagtggctcacacctgtaatcccagcactttgggaggccaaggtgagtggatcccttgaggtggggagttcgtgaccagcctggcaaacatggcaaaaccccgtctctacta

SEQ ID NO: 133915 - DNA, 1053 bp, Homo sapiens
taggtgcatatctttcaaaataaataaacataagccaggcttttccaactgcgtcctacacattctacaagatattaatcatgtgtcaagaataaaaagtgttgtgttcaagtacgtttgggaaacattgctagtatattattttcttcttagagaaccatagaaaaacttgagaggttggcgggttggcgcaaaccaagaccaaaactgaactgcaatcactaccaaacccccacgagtttgcccctccccgcttgctagcctcagtccagattctccggaaaaagaaatcagtcgtacgggctctcgaaatgacgtacttcccgcgcgccgcgaagtcctgatgccaaggggccagtcgcgaggtaaaggaggggtctctgaagtgggcgtggcgtcgctggaggctactcaggcgcgggactcgttctcgaggcgggagctgaggtgcggggcggggcctcctgcccggcgccggcctgtggggaggcggggcggggcacagtctcttaaccgtgcagcccgcccctgacgccgccggtaactgcgagagtcggggtcggtgcggtttgataagtggtcggttcctggagctgcggtcttctgctagcctgatccgcagcttcagcctccgccgcctcctcagccctcggcgccgccgctggcgccgccgcctgacccgcaggccgccgcgggccgcagagcccatgagggcgcgggcaccgccgccgcctccgcggcgtcgccgtcgtcccggagcgccccgggctggcgcgggcatggccgcggcatgagcgtggagccgccgccggagctggaggagaaggcggcgtcggagcccgaggcgggagccatgccggagaagcgcgcgggcgcgcaggccgcggggagcacctgggtgagcgcgggcgcggggcccggctgcctgaatcccggggaggctgggtggggtcgcacccagggcccgcgagcccgccgctccgggcaggggcttcggctcttggaaagtcggtccttttctggggggggaggcgaattcatcacgaatacagg

SEQ ID NO: 133916 - DNA, 1011 bp, Homo sapiens
tctcgggttcaagtgattctcctgcctcagcctcctgagtagctgggattacaggcgtctgccaccacgcccggctagttttttgtaattttgtatttttagtagagacgaggtttcaccatgttggccagactggtcttgaactcctgacctcaagtgatccacccgcctcggccttccaaagtgctgggattacaggcatgagccaccacgccaggcctaattttatttttttagttgtagtttgtatttaatgtttcaaagtattattctgttttgggggcagtacaatgaattagagctaatgcatttagaaaatatgaattacaggtaattgagggatcagattataaaactaacctttgctttggtttcctctccagggcctgctctcttttttgagtgccccactcattggtgccctgtctgatgtgtgggggaggaagccctttctcctcggcactgtattctttacctgcttcccaatcccactgatgaggatcagcccatggtgagtgacttggcccttcacctcctgactgcttgttttgagtcacatgtaaattatacttatatttgcagagcacttcttaactattacaaagcagttgtgcttgtgttttcatttgatctctctggtaatactgaaaaccagtttggacagttgtcattatatccattttataaatggggtagtgaagacattctagaattaagtctgagataagttacttaggtgaagaagtagaaataaaagatgcctcttcaggcagctgatgttgccatgatgtcaggtatgggagtttaaccctgagaatgggctaacaatcctgtcttcattactgtgacttttagttgactttgtaaatatattatttttgtcagctcatcgctgtggggcactgacacaaacatagtttatatcataataggcgggagtcactttaaaatataccataataaggctgatagcctattttaaataataatgtgaatttgagttcgtttttt

SEQ ID NO: 133917 - DNA, 1047 bp, Homo sapiens
aaaccccactttttgttctataaggtttttctttgttaattttaaactgggtttttaaaaaaagcatctatcacatgatataaatttttagtcttaagtacactaatatttttcattatgacttctgcttttatgtagatcttttcaaatcatttgttgtatgtcttttccttacttacagctaggatatttgagaagttttttttctgtctgttggctacctttaaaaatataacttttacctaatccccttattctttgtttttcctcttcttttgtttttttagggggcatgtactgaccccctttgaacaatgatgaaattagaatgtttctacttcttcctgtcttaacttaaattttttttgatatatttaagtatacatacatatacaagtatacttatttcttggtgcgtaatctttacatgatgtctttggctcaggtaatgaaagtgaacatacactccctttcccttgggtcattaaaataatctttttataggtggtattttgcgatgatttctgtgtctggagtcttctcggtcacgttttctgttatatttgcctatgtagctgatgtcactcaggagcacgagcgaagtacagcttatggatgggtaagataatagactatatatattttttaaccagaatagtaattaacattgtattagaaatttactggaaagtgagtttattagtcctttcttgcactgctgtaaagaaatatctgagactgggtaatttataaagaaaagaggtttaattgtctcacagttctgcaggctataaaggaggcatagaggcttctgcttctggggaggcctcagggagcttttactcatgatgatggaaggcagagccagagcaggcatcttcacatgactggagcaggaggaagagagagtgaagggggaggtgctacacacttttaaacggccagatctcacaagaactcacttactattaacaaccaaggaaggtggtgctaagccattcatgagaaactacccccatgatccaatcacctcccaccaggccccac

SEQ ID NO: 133918 - DNA, 1345 bp, Homo sapiens
ccaccttcctttgtagtgatcaagttatgcatcaaagctcctctgtgaagtagagctactgtggcttacttttccgggcaatcgtggggattactgttaatgtgtgtaaattaactagcctagtgtctgttgcccagcaaagtctcaacaacattagctgcttttgcttattaattacataaaagctatggtctgatgagctagaagctctgtagcactttccactcctttggtattaacttaccattttgttctattcaacaatccaatgtatgtaagaaggatttttcaacaaggttgtaacattcaacaagttcttaccagtttgaccttatggctggagcgtacttatttgtctaccagatataaaagttgaacatgaacactttgaagaatagagtgaatttacctatacggaaacgctctgtactgaatatggctttaaagaagttacattatgaattgagagaagtgattttcttaaaaggttctgtaggaatatatttccaggttctgtttataggaagttcgggatctgttcagggattttaatcagtgtgttaacaaagatgagtaagtgtgttttgtgggtttatttttttgcttttttttttagctatatgatttgaaatatatacctctgaaattaagacttgtaacttcctcagaaagatggtgatagaacttccttttattaaccatttgacttttgttattcatcttaatagatcaaaataatgaagctgatgtcccagaacattggcaacattaatgtgtattggcattttaagtgtgttctttctgcttattctcagtcgttgaagaaagttggaaaagattctactgtcttactaatctgcatcaccgtgtttctttcataccttcctgaagctggacagtattcaagtttttttctctatctcaggcaggtgagtagtgagtggctagtagcctttcaataccaggaaaatcaaagatggagatttgtctaaagatattttgaggaaaccactgcagaggaaaaaacatgtgaacttgcttctagttacaaatgtaggtgctggcatataattagtaaacagggcacctttaatgcaatgatttatagtaagataattactgtggaaatttttttttcttgagaattaaccagaattagcagaaacataatttatctttttttttttttgagacggagttttgctcttgtccaccaggctggagtgcaatggcacgatcttggctcactgcaacctctaccttctgagttcaagcgattctcctgtctcagcctcccgagtagctgggattacaggcgtgcactaccatgcccagccaatttttg

SEQ ID NO: 133919 - DNA, 1224 bp, Homo sapiens
aaaataacgtaacttttaaaaaacttgatatttaagtcttaaaagttgtagacatttcggagatactgttacggtcagaggcttagaaatcattgccaggttactttggctgcttattagaatcaccatgggagcttttaaaacatacctgtgcccgggtcataccgccagagagcctgatttaactggtctccagtggtcttccagcatctcactgctctccttcccttgctctccttatcccttgtcttttgcttacatcatgattttaatgtgcaggcaaagttgagagccactggctttgctaatgagcaatgctgtattggcagcatcaaaagtcagtcattttgtttcattttttattacttgataccatatttatcaacttgtgggttggggatggagagggtatataaaacaacaggtagacatataatagaaaatgtctataaaacatttcacaatttaagttgtgcctgcttataacgatttcttacatcagttttagatataaattactggttatataggttcagctttcagcatgtcttaatttgccactggttttatgaattttcctagacttatcattgtaatagaacataatatttcttattattttataatatctatattactaaagtgttttcatttcatttccataggtcataggttttggatctgttaaaattgcagcattcatagctatggtaggaattctgtctattgtggctcaggtgagtatcattttatctatacttaaaaaatttaaaaaatatcctgataaccatagtttcacaggaagccacatataaaaatgcaggaagatattccctgagctgctacctcagtccctcaccccctgctatggtaaggtcttgcaagctatagtataatatcagatcaagaaactgatgtgaatgtggtccacagaactattccttcttatataatgtgtagaggttattttcttttttgaggttgtaatttaggggaaattttttatgtttttatttaaaacaatgtttttaaaattatatccttgaccaggcagcccagcctggtgactggcatccactcttgtcttcagccttgcctcctcagctcaggggccctggccccgatgccactgcctaagtctcctcggaagccacagtggttccccatcccaggcccctgggggcctctggtgctccccttgcaccagcatcatctgccatttag

SEQ ID NO: 133920 - DNA, 1285 bp, Homo sapiens
tcccaattccaactttgtaaacttccagcagaagctctcatattctgtaaatgttcagcaggagtttgctattcacagatatttaagtgattagtatttctccagagactgaggctgtccctctcagtcatggtaactggtgaacagttgtgatatcctttcaggaagtgccagcagagcaccaggtagacaggcttcttagggaggaggctgaaagcattgagccccaggtcaggctgggagcccccaacactccacccctgtagaaggtcatcagtactgtccagactctgaggttgcaggtcaggcagtgtgcccttagaggtctctggtcatcagggaagggtcttcacacacagagcttgtattttaattctgtgtgttgatgtggtttttcagagttgtctcctttactttgcagacggcctttcttagcatcttgatgagatcattaggaaataagaatactgtcctccttggcttgggcttccagatgctccagttagcctggtacggttttggatcacaggcctggtaagcctcactcttagattctcgtgaactgccagacagatgcctcttagaggagcttggggtggttgggtgtgatgagaaggaagcaagggttattttgctggtttggtgtattcaacattgcagaaaccattaggctttaatttggggaaatgtggagctagataacaggattatttataaagactacctttatgtcattggactttcacggaattgttccttaattgaatgtatctctctcttccctccagcccccaaataaagttttatgtctactttttaaagcatatgccaatttttttttctttccctgagacggagtctcactctgttgcccaggctggagtacagtggcatgatctcagctcactgcaacctctaccacccggattcaagcagttctcctgcctcaggctcctgagtagctaggattacaggcattcaccacacgcccggctaatttttgtatttttagtagagatgggtttcaccatgttggccaggctggtctcaaactcctgaccttgtgatctgcctgcctcggcctcccaaagtgctgggattacaggcgtgagccaccgcacctggccacatatgctaatttttagagacattgaatatagtcaaaagcaaaacaagaagatacaaaaaaaatgactgattatggcaagcttcactatgacttatcattacctatcagtaacataaccttgataaatcatttgagtttgaacactaaaatttcttc

SEQ ID NO: 133921 - DNA, 2045 bp, Homo sapiens
aggaggacaaaggtctaaagaggaaggcaggtctgtttttccagttgggggcacaccatgctctctctgttgaggggtagcaagctgtagctcgagggcagtgtgaaagtgagccttcaagaggtacaaagaaaaaatgaaaggtcagtggagaaaatgtggtatttatagcaacaaaagaaatctccttgcgaacttcattgagcttatgtctaaagatagcagtagggagaccagggagaagaaaagtttgtaaaagaagtaaaatcaagacacaaaggtttcctggcccttctgtccccatcctaggccattcgtttcctccagtgtcacatgtaaccttgtaggttaaaaaaaaaatgcatttttaaagaggaaaaaataaataaaatgtaacaggagaaaacaaggcatttgtacttttgccactgattgcattccgaatagtgagctccttgaggttgacctgctgcctgactgtgcctgtcctgtcattgcaggatgatgtgggcagcagggaccgtggctgccatgtccagcatcacgtttccggcaatcagtgccctcgtctctcggaatgcagagtcagatcagcaaggtgaggtcactgccccccacttgtttttctccttcaacgggagacctccctgctagaagcaggagcagctctgagttctccccatcaacagcaggagccgacagccatatggccccttttatcatacctatttactttggcagataggaacattctattttcctctctgctttgatcttacacttatattttttaaagctagacttagcagttcagattgctaacaattagaaatagaactattcattttcccttttcagttttgatacatcttttcttctttagtgtcacaattaagcagactataatcacattttaacagatgtctattaaataatgaaaaaccagttaaccacgagttacttaattactttattcactaattatttggaataactcaaagtctttgagcttaatttagaaaatagtttgagagtagtaagaaaaagtctgtgtggttgttgatagatgttgagtgagagatgaaattaaaattaagactgctatgtggaaaatagcattctaccatctagatccatatcccatccttcccatgcctctgcttcccttcctgtcctgtcttgtcctccctccatcccttcttccctcttttcccacccttcctccccccaccccccacctcctaccccttacagggtctcactgtcacccaggctggagtgtagtggtacaatcttggctccctgcagcctccgtctcctgggctcaagtgatctcccagtcaccctcccaagtaccagggactagagacgcacactaccatgcccagctaattttttgtatttttagtggagatggggtttcgccatgttgcccagcctggtctcgaactcctgggttcagtctgcctgcctcggcctctcaaagtgctgagattacaggtgtgagcccccatgcctggactgctttcctttcaagcagttcccatggctagatttaatctctttccttctctatctcctaatggctcaccttattgtattcaggaagaagtagacaattttagagggagaaaaattttttaatgcctaagagcccttttttttaaaagttttagtaaaaaactatattggaaaggatggtttattcattgcattttttttttctatatcagaagttaggtatcttactcagattcattgttaaatattgtcccttgaagaccacacattctgtatgtcactcctggctacagtaactcagttggtttgcatccttagggaggtgctgtgtctgaagtgaagatgtgatgacccatccgtggaggactgtcactgccttggcatctgacagacaccgtcctgtcatttggggcatggattttcttttgactttttatacttattcatgtcaatatacatgtttctgaatgtcagcatataaaagttttggaacacattgtattaggctgaattatatactacca

SEQ ID NO: 133922 - DNA, 1430 bp, Homo sapiens
aaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaattttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttacttttatgtcttgtgtcttttttttaaagcaaatagtattgctcttttgggttctctgttgggtggctttcaattaaactgagttgtaatctttcagctgatgcaaaaggtatgtattttcaaaaaaattttatttttaacaaaattccttcaaagtctcccttcaaaaacatcgtaactacagatgctccttgaaaaaaacatcgtaactacagatgctccttgacttaccgatggggttccatcctgataagcccattgtaagttgaaaatatcatacattgcaaatgcatt

SEQ ID NO: 133923 - DNA, 1039 bp, Homo sapiens
gaaaaaataggttggtgagagttgtgaatggtaaggattttgcattttttctttaaaccatggaaattcattcagggcctttttcccccttttgtttttattttattttttatttttttatttttttatttttttgagatggagtcttgctctgtcgcccaggctggagtgcagtggtgcgatctcggctcactgcaagctccgcctcccaggttcacgccattcttctgcttcagccccccgagtagctgggactacaggcgcccgccaccatgcctggctaatttttgtatttttagtagagactgggtttcaccgtgttagccaggatggtctccatctcctgacctcgtcatctgcccgtctcggcctcccaaagtgttgagattacgggtgtgagccactgcacccggccttcccccttcttttttttaaaagcagggacgtgacattaaattagcgcttcaggaatcttactcttagtggtatggttctatagagaggagagacttggacaggttatataagtcagaatagattaagttagtagtaattaaaaacaactccaaaatctttgcggccccccaaaaaagaaggtacgtttcttggtcatgctattccatcacagctgaactggggactctgctcatcacagtcattctgagacccaggctgatagaacaaccaacatgtcacattttgtttacctttagagagcagagaagagcactctagagggttatgcactaatgattaaatgctaggcctggaagggacacgcatacttccatttacaactcagcactagagtgcagtcacatgtcagtaaccagttacaggggttcaagaaaccttctatgtttgtggggaggggctgggtagaaagaactggaagtattcaaaaatagcactgacgaccacacagggagtcttatttagaaggtggttgtgtaatagttgaagtgggtggtcttagctgctgggtcacagttgttgcagtcaatacagagaagagttgtatacaagaatttaaagcagt

SEQ ID NO: 133924 - DNA, 1098 bp, Homo sapiens
catgcacaggattctgttttctatagctccttcctgacatcagtctgccaaatacagaatgagttgacctgcaggcaattctctaaagcttctcttttcaagtttgcatgcccaagcaggtaggctgtgtgtttgctgctttttgcgatatttgaagtgatttaaacatgcttaactctgtatttttagagtggcaagcctgagtaccataagaccaaatggtcctgggcacaaattttgaaaaatatggtggtgatcataacttagcaacaacaagactgcttttatgcttaaaagcaggagaaccgtatattcaaaatttgtggttggttgtcaaataccatttttttcccttccttttagactgtggaagtaaagtctgcccaggtctagatgtttttctggacttattaccattccctggatgagagctgtggaagggggattgtggtctcttccactgccaggtggggtggggaagggaggtgctctgtttttccaaactctggcttcaattgattctgcttgcttggcttgactctgtcgggatcccaacaccttgggctacatgcagctgagtggggtttatgactcagctggctactggggccctgctgctttatttatggtcgagactttgcttgaggttttataaagcaaagctagaacaaaaacgatggttttgtaagtcaacttcataccctaaacaggaatagagaaacctcaaggctaggaggagtcatccaaaaagacctccatactgaaacctgccattgtcttcttagttataatatgctgagagatcaaaggacttcttggtaaattaaatggctctttcccgagtccatattttataaacatgtatgcaagatcgtaaattccatacctctggacttctttagtgattaggtcttaattataatgaataccattttataccatttcagtattcttttttggcaaatgatattaaacattccctcatgaactaaaatgggtaaattattaatcatgttaagcagtttctgagaattttagataatataatgatttcactattttgaatattacgtatcatagtttttattgaataagctt

SEQ ID NO: 133925 - DNA, 1104 bp, Homo sapiens
tccctttgcaaacaccttggcctgaagttagaatgaaactgtagtcagcaccccttatcattcttcagaaagtcttcccagccctgataggatctgttctgattcggaatatcagggaacatttcttggtgaataaacctggcttcttatatactggtgcagtcacttccctgtaacgaggtaatttaagccagttgcctttcatttcaaccatgtcaaagtatcaaataaagctataacttcagaccagccaggaaaatgagaggccggacagagtaacatgtttataatataaatccttcctgttttctcaacccatgctcccctggctgttttccattctgacagaacactctggagatttgcctacagacagtgaccaccaatttaaagatttgttgatgactaagaaaaattccaaagctgcaaatgaacgaatccaatgctgactaaaacaactgaccaaaattactaattcctaggctgctttagcacgaatggtcataacaactgggatagcaggcctgtgtcactcattccctagtaaagcagcttggaggccacaggtgacttcctcttctttccagactgagatgtaccagaaatagtgcagttcaccagtttggggaaggcagttgtctgggagtaatcatacctgcaaatcacttgatctcaaggactgtgcttgctgacttgagaacatctattttcttcaattttagatgtaacacggctaccttgtactcactttgagtctcaccgaattcccgtgcattgagggtccactggaattctttgttcatgggcattttgactgctagtatggatgaggtggtgagaaatggtggcagacacacataatttgtgtgtcccatattttcattttgcaccaagcttctttgctcccatgcatgctccattgctgcatcagatttcacttacaaagcgtaggtccaaagataacattaacaggagtttcaagacagtgacagcagatcattaaaccaagtgtgggatgagtggggccttgtgactacacaggccaatgcagtggaagctccctatgttaccttccctgatttcattcctttccctgcccctctc

SEQ ID NO: 133926 - DNA, 1058 bp, Homo sapiens
gtatatgaataagtgatcctacaagtgaggcgtgtgtttaaaatggatcgatggcagggcgaaccatcacgcactctggcagagatctaaacgggggcagtagtcattcttcagtcgtgtttttcttttggttggttggtttttaaaggtcatctgtctaacccctcattttacagaggcggaaacaggccaagaaaggttgccttacatcgctactcagagaattacatggcaaaaatgggcccaaacccggggctcatgagtgcatgttctcagaacccctaggagggatttcaaaacccaagtcccacatgattctggatcattaactcaacaagcagcagacatgcctctttaaggcaaaagttctatgttccatcagtgagcttctcataccaccgtgtctcctatattcttcagtaaaagactttaatatctaaaactcctttaacctcaaatcctgttatccccaaatgaggcaataacttactcggtgagatgtgtgcaccatcctgctcagtttgtgaatgcttcattacatttatatggatggtatattttccaagagctagataaaatatttcctcttctcaagtagctgcctactcatttggaaagaaaagacgtgaaagatgaacaaacagccattaagtgcaatcattggtgccttaaaactttaaggaaaataaaaatcactggaagtcggggcagtcacgggaggcatccagagagctttctcactcacaagagggttaaggtctttactggcaggttaagtagccaggcaggaagatttgtcaaagaggaacccagagtccaggagaggcaataaggaaaggaaatatatccaggggcagtgaagtataacacaaataaataggttgaggcggatagcagaggagccgatgatccaaagagaaggcaacaaggaaagggtggggaaaggatatgaggggaaaaaaaacagggaggaaaaaactgaaaatgaatcacctaattaatgggtgggaatactggctgatggtttccaggggcattgtttctagtccagttatctg

SEQ ID NO: 133927 - DNA, 1042 bp, Homo sapiens
ttcttaatatatgtgtaggaaagtaattatcttactgagtgcaagtatctgtaagtcagaacactagtctctcccgcatttccccccctcattgtggggtgtgcctctggccactttcaagtgaccgtggtatacgtggaattgatggtagctcctgaactccctgctaaatgagaccctgcaagacgtggggtagattttgggtggaaccaccagccaacagttccatgccccgtggggcaggtggtgggggggcaggtggcaggggagcaggttgagggggagcagtcagcctccagctctgctctttggatgcggcccaacacaggagttggtttgctgccgccgtcgtctgtcctgccccatggtccctgtcccttgtttccctgacacgcctgtggctccctcgtctcctggttctgcattgggctcctgtctcaggccggccttctcacctggctgacccatttccattcatttctctgtcttagggacctgggctcatcccagctggagattgttgttctctccctccctttcagtctatgggcaactctaagggagaaaccttttcctggccagccctagctctgtggaaatcacctggcctggagctcctctccccgtccactctcctctggccctgtgcctcccagagaccattggacagcccaggccccttcgccaaatcaaatgctggccatggcaagcctaggccctgggaagtctgagggtgggatcccagatgcgcggtcagaggaccctgcaggctgggagctctctcagtctggggcagcccccagagcggctgcaggctgggcctgacccagggtcatgggccttggcatctgggggcggtcccgtgtggtgaggcaggccctgtagcctgctggtttctggtttcatggctggttacatgagcttccccttaggagggtctcaatgtcagtgaatgtctgtgaaccatgaaatgaagggacaggaggggctgttctccattaccttttcatccccctcctcacatctttgtccattttcacca

SEQ ID NO: 133928 - DNA, 1042 bp, Homo sapiens
tatctcagtgttaaggtacctctgaaaaatgaaaagtgttccgaataaatcgcccacagtattaggtttccatgctgtactttctctcacctagactttaaattggagtcatctaagaaatagagagagaagaagaaagaagtggattacttttaaaacactaggaggaattttatttactgtaaagcagatgagaaatttgtttgcccaagtttagaatttcagtatgttactttgcagaagtttggactgcctgtcttttgattttgtattaaaacttgatttgtcattgtaatatcatgaaataaggtaagtagcccgttgttttctaagtgacttgcggaaaactcgtaaaagtgaataattttttgacaaatattacagcagataggtttttttgttgcttttgcttaattacatttcactgttttttgattcttgataccagcaagggattaaaatagcggtgtgtttttctgctgctagaatgtatgatgaatcactcttgattctgaagccaaattcttgctgatagcattgctgccaatttctgtgctatgttgccttagtatgggcattgcagcgtccgagaatgtgcacaaagcacatcagaataaaggtgatcccagagctgcagagtgcacgtcaggataccagagggcagcttctgagagagctggaaaaggaaccagcctgcgaatatagttgtttgtagctggactttcagtgtgcatgaaaagggggaccccaccccttttctttttccacagagggtcatatatgtcacttcagttgaagaataatagaaaaagttgtgatttggaacagacttgagttttctgaccatacctcagcatggtatggtaagttgtgtttaatggtttaggtgtttttttaaatgtttgtgaggtgatgaatgagatcataaaatacccaaagaaggaaaagaattatggcttgcttggtattttttaaaaaatgtgtcgttgctgttaattttttttttttttttttgagacggagtcttgctctgtcacccagg

SEQ ID NO: 133929 - DNA, 2072 bp, Homo sapiens
atggacttgagttgatgttctgtctgtgaaaagtaaatagtggctacccagtgagtcttctatgtcccgacagtaaataacctttccctgattccatgtggtaagcaggatctctgcatctactcatggaggactactactggattgaaggaagtggcgctttctgaagtacctcatctagaaaactccatttccatttatcttctcacactcttgcctgtcatgttagttccccactcagaactctgggtttacatgatttcagtttatatgtgcatagagaaacactggaaaaaattaaagtagtctatttttcagataatgaggattgctgaaaacctaagtcagcctgaacaaccagtacattttcttgaatttattgtacataagtcccccacgtaagaggctgctggaaaataccaaagagacatgagaaatgtcatttctggccatggggagatcaaacacacagcatatcaaagatcacttacaaagcatcctgtgataaataaatccacagcagcataacacaaactaaagacatgagtatatgatgcatttttacccgaggctaccctgggctagagtttccatgcctggtctttgttttgataaagcaacactttacacatgtaggctggaaattatggtgggaaattggataattgaattaactgagtccattttagtgcttttacctggtttgtaagcacagataggggtttgattgatgtatatgtaaatagtgttagtgtctttatttgaatatatgcttttaaaaattcatctatgttttgcaagtaaagctggaacctattatagaagtcctgctgacacctgtgaatcaagacgatttggaaacccaaggccagaaatgtaatactgttgattattctgtgcataacacatttcttattaaattctatatttattcaaacaatttacaatttttatttgatgttcacaacgtacaaaaccctgagtcaggagtagagaatactgagatgaatagaatagtttatagttagaagtagaaaactatataggataggagaatttatagatagatgtagaaaactattataggatagaagacaattgaatcacacctgtatcagaggtgcagggaagtgcaggaggtatcggaacagtttggatctctataagggaagtcatcactttgggtattttcattgtccataagccctccttcaggctgatagcaggatacaaatacctgtgcagtttcattcaactcttgttattttgtataatcgaggataccataatttgtattctcaaaatccagattgccttcatgagcacatactcagtatgaaattttttttcttctatttttagtagagacagggttgcaccatgttggccagggtggtctcgaactcctgacctcaagtgatccgcctgccttggcctcccaaagtgctgggattacaggtatgaaccactttgcctggccccggaaattgatcttttatctttggctcataaatgtgaaatcaaagtgccacagcaagtttaggctacctctgaacttggttcagtctattttactctcactcttttttccttttacttgcattaagctttttttttttttccccccacggtaaacctttggttttaaggcaaaataaaatgtttcagaattggggatggtaactttaagttctagagttattcaaagtttccttctcttgtgatttttttttttttttttttgaaacgtattctctatcgcccaggctggagtgcagtggcgcgatcttggcccactgcaacgtcagcctcccgggttcaagccattctccctgcctcagcctcctgagtagctgagattacaggcacccaccaccacgcctggctaatttttgttttttagtagaaatggggtttcatcatgttgaccaggctggtgctgaactcctgacctcaggtaatctacccactttggcctcccaaagtgctgggattacaggtgtgagccaccgcgccaggcccttttgtgatttttgaatgttaggttgtcattcagatagcatcccacacgt

SEQ ID NO: 133930 - DNA, 1041 bp, Homo sapiens
tgtgtagacatatgttttcatttctcttgggtgggtacctaggcattgaatggcttggctatatggcaggtatatgtttaactttttaagaagttgctagactgttttccaaagtacctgtaccattttacatttccaccagcagtgtttaaggtttttagtttctctgcctccttgtcagctcctggtattgtcagacttctttattttagccactccggtgggtgttcaaacgtgcttttttatacttaacattttatttcttgagaggatttgaaagtgtctagataccttaatgctgctcgtgtcttccattttacagaccagaaggcattggcccagtaaatgggaatctaaatgtctcacccgagattcccaaatgagtcactgagcctagaatcttcatgcgtcagttggagttgtagcaacctgcttttgttctgtcaactattgtgactcagaatcctctctgtccttgtagcattgttaggtgtgcctttctttttatcctttcaaaatcatctgttcttatcctctctggaattgtgtctgatgacatgcagcttgttttctgcagaagaatgctagtgttgtggagaggttctctctgcctcttggctgcagcacacaggcgctgggtggtcagacctgcttccgaggctgtctccacagtgactgtgcaaccgcatgtcatcctgtgaaagggcagatacgtgcctcgtcagagccttgtgggagttagtgaggggacttctctaaggcagctagtactcactcaatacttaatgcatcttaaggcacctcttcacagaaggcggtggaaggctgcttacgtgatggcatgtggatagcgatgccatccgtttgtttttttctcctccatgacagagaagcaggaaaacattcctaaatttatttatagacgttaaaaaaaaatcaggcttggttttttcctgtaactgttcttcagccggcagcaagtatagcagcaagtatacagcagcaagtatacagcagcaagtatacagcagcaagtacagc

SEQ ID NO: 133931 - DNA, 1091 bp, Homo sapiens
ctatcatccaggcaggttgttgtttttccccacctgatccctgcttttccttgagaagtttattttaaatggagagtcaggaatgagagagaacgtaggataggaatgaatcatgagaaaaatgccaccagttgttttccatagtccgtgtccttgttggaatatccttacctttgtcaacagagagtagcagttcatccacaagctcgtgagcagccactggcagcactgcctccatgaggcctcgggagcattctcattgttttctccaggctgtgctgttcttcccctcagccttgagagtgaccagggatctcctaggcctagggaaacgccacctggtcattggccagagccgtttctagatatggtatctgacccctgtgtgagtaccgactgcccaagagctggcagtagttttgtactctgagcctgagcgtgtggccccacgttccatgaggcctttggccggtttgtttgccagagtgtctctgagaggagggagaatgttggtatggagaataattttattgctttcttctcaaaataaaggaaatactcaagggaatggtgggaggggaggggataaatatagcgtttccgatttcctgcttcctctactcttccacagcatttcacttttcatacggttagattttcatcctatcgacttcagctaaaaataattccaaccatttctatcagattggccctcttatcatacttgttattattttgctttcctattcaaaacctttttttccccttaggccaatgaactgttttactttattagcttcatatttatttatttgttattgatggataataggtatacatagttttagggtacatgtgatttagtaccatcatataatttataaaaatcaaatcattatatttgggatctcaatcaacttaaatatttgtcttttctttatgctagaaccattctcaatagcttttctacagggaataaaagatggtctacagtgctcacctgctgcacctggtgcatgtgtcatggtcttatggctggggcagtcttggtgtcctggcttttggatggtcagaaattctggcttgtcctt

SEQ ID NO: 133932 - DNA, 2190 bp, Homo sapiens
tcttttgttctacgcctttttctcttgtacttttgttcctctttctagtactaacgtctcctccacctgtttgttctggtgccgtgtgctcagcatgtctctccatgctcctctcttaccccctaaaaccccaagtggtgattccttccttccagcaaaatgtactcattcagtttccctctcctccctccctgttgtgtttctctaccattctttgataggtgatatgatgagccagaattgataggctcatgtgtatgtggttctgtctccatcagtcggtgtgattcttcatgtttagaaaggttccatttagaaccttctttagaaaaggttccatttctaaagaagctacagttccctaactgaagtttcctccttcgtaaaaatgaagtagtaggttaattatatgacgctataattaataataaagcctgtattctacttaatatgtctttcatcaaaaaggccacatgggaaatttttgacatttaaaaattatctctgaattcagtctttgtcagggttcagcaaatcacaatacagtgtttcgtatttactttcttttgtaacattatagaaataagagtatgaaatacataaggattctacatatagaagtcacagaaatcattctgtatattcagaagttaaacatccccaatttcatttgtgagcagttaaatttggggatactgtgaaaataaatttatatcaaattatattatttgattaacccagtggagatttaaaaatcttatatattgttttctccccttgctttgctgtcagctgttagttctgtgaggtcattgatgatgacagaattgctgtctaaatgacgtactgaagacacatccctgccttgtcttccattagaggtttggttctgagtcctgacgttgatactgctttattccagggtacctatttgaaaacaagggagttttcagttatatttgagacatagtgatattattgttttttgcttgaagccaagatgtaggtagcgattgcttccactttatttttactgtacttttatatagtaatttggacaggtgtcttcataaaggagatctttgacaagggaaaatagacccagacacccattaagacgtgttttctcccattttctccttccttgcaatataggtgggtttgatagaatagtattaggaaataccaaagaatctaccaaatgggtaaatgctacttaagtgtctgtacaggtcatttagatgagaggatttgagactatgcttgttataatttgagaattatacatgggtcaggaatgacatgagggctgaggttgaagcaatttgaaaaggagagataatcatgaaactctacttggatattaataatttttcccttgaatcacacacagtggcctgcgaggcctcattttggctcatcagtttttatatgggctgaaggcatttgtttggaagatgtaaatacccttgtgtttttaatagggaaaggttggatcaagtttgctcttaattctgatcaactgacagtctttgactcaacatgaagcacactgagataaagcggatcctggtttgctgatacagatctctcagaagaggagcttgagaagcgggccttgctgggatttcctctaatcgctgcattggattgattgataggattcaggttttgttatgaacttgggagagaagtgggaagacatccaataacacccaacatttcatttaatatttgaaagaaaaccatttctttttcttttttcttttttttttttttatacttttaagttctaggatacatgtgcagccttgttacataggtatacatgtgccatgttggtttgctgcacccatcaacccatcatttacgttaggtatttctcctaatgctatccctccccctgtcccccaccccatgacaggcccccgtgtgtgatgttccccaccctgtttccgtgtgttctcattgttcaattcccacctgtgagtgagaacatgcggtgtttggttgaaagaaaaccatccctacattgatgacataccagttttctcctgaacctggacattaattgttggcatgttggggaagtctgctcctgtgatgtatctcgtaggagcagtcagcagccagacctaacagtttgatgcaatcaagttcagggccagttggaacatcttgaaaaatcta

SEQ ID NO: 133933 - DNA, 1046 bp, Homo sapiens
tttccccagtcatctaagactgtgggtaacatgtgttcctgtctacaaggccattgcaaagtcaactgagataacacgtgcgaagttctctgggagaaaagcaccatctgcatttgcataaagcagagctgccgaggttaagctgtcaacagcttcctagggaaaatgtccctgaaacagataagacatttacctgtaatggttttctttgcctgtgaaattaatggtacaaggcttaaaaaaagtattatcttttaatttgtcttttaaagttgattctattttaacatattttcatcatttagttgctaagaatcactgctaatgggcacaaatggaaacttagatcctgctacaagaaggttacattaattcaaaactggctccgctggatgcaggtgggggtgggagtgaggggggattaaaagtaaagacatcccagacctgcaaggagctcagaaatgggagcatcatgcgcagcagcactccgataattctgttgtatggcagaatagcgtaacagcccacgtgaaaatgaatgagagtaaaacccatgaagcaaattctgcatctggaagggtaagattggtgaagggttcttgaaaaacgtgaccccttgaatagtgatttgagtagagggcattccaggcagagggctgagaaggctgcagaaaggtttgttgaagggctgaggagtggactgggactggaaatgagcatagtgacctgcacacatagggcatacatgtcactgtttcagtccccagccagagagaagtgcagggtgggagtcagggaacccacctggtggtaaggcagggctggtgtgcccctagggcctgcactagagaggcgctggcagtgggggaagggggagagtggagagcttacttggcacctgtagtttacatttgagggttacatttggtaggatcatgggttgcgtcagtccctctcggcacacatctcaggctgtgcagagttggtgttgaaggaacgtggggaagagggtggcccattttatattcatgctcagaaacaggggt

SEQ ID NO: 133934 - DNA, 1029 bp, Homo sapiens
tgaaatcagcagaaaagtggttcttagaaattttaaagtttgtttatccactttactttttgaggatctgtgctcactggtttttcaagctggtttgttttaaaggagtcaagcttcactttggagtaaaggtggagattatagttgctctgttggaactttgatatgttaaagggaaattctgtaaaaatgcgggatgcaagcagtagccacaggagcatttttaaaagtttttctttttcagcttaatttatataagaaaaacaattaaaagcctgtgtttcattttagcctctttttaaaagataaattcttatttctgcagataaatgggaatactgaggggagggacggaaagtatggttttctatagactattttccattaaaatttaaataatcagaaagctcagaaatgttattcctgtaacttcgggaagttataggaaatgttacattttaacatcaaagtaaaattccaataaaatactttttcttataggagcacattttacatatgtaaaggaagatacaaaaatactagaaattctaaaacttaaccatttttgcgaaatttttctaaacaaatttcctgaagtcttgcatacatttgagaatttagattattgctagaaagcacatcttaggttttaatcatgttcatgccaacgcctatgaaaagacctaccaggattttagatccatagttaaccaccacttgtgagtatccattttgcatttttgaagactcgttgattgactatcaagtacttgaaattatgtaagagaatacttttttggcagcaaagtcgcatttcagatcccctgctcccctatcaacttcaggctgctccaggctctgggtccaggctggaactcacagtagaactaagattatgtctaaactcatagcagtaaagtgacgttttgccataaaagaacatttttataacgctatttcagtctacttgtttccttggaaatagtttctgtcgtgatgggcagtatctaaattaatgaattattcagc

SEQ ID NO: 133935 - DNA, 1111 bp, Homo sapiens
ggggaggtggacacaaggatcccacacatctcttgtgaaatacttggaaattttcaatttgagtgtttatgatgcttccaacatatataataacataaaatattaatgtacacgtggttgtaagagatccagttgaccagaggattgcatgtttcatcatttaaataatatgctttgtgttagattgcatatagtgtatgcttttaacaagagttaggggaataatagcacgggaacatttgacacttacaatctggaaacatgagaattatttatgccagtaaattatttcagatagtatttgcgaatgatggtatgtgtctgttttaggttctgtggtgccacttttagaaactccacaagcaaaccatggctcaaagtttgtagtaatctttttgaactgtaactattagaatttcccaaaaatctaataaatatgcttttctttgtataaaatgagctatatgaatatttgctgctacttgaattttctttccaaaatttgtttatagacatactccctaaagatgtttgataatcagaaataactgattctgctagacaaatatgcaccaattgattgattttctttattttgaagaaaatttttttcctcttaattatttggtggcttcctttgctggcaaatccaattttatgccccacaaataatgtgaacagtagagacttctacttgtaagtttcggcaattctttaaaatatgttaagtttttgcttcaacatataaaggtttttcttttctgaattgtgttttcagcagcaattcaaaccaattgtatttttccattatacaaattactaatttagaataaatatatttcatttctgtcatgatatcctagtaggcaggctcttgggcagacacctgatatgtgtatgtattattaagttgtctacttttgtttcttagaaatgtttatcatttaaaaagtaacagatggaagaagaccatttattgaagactgtggcctggctagtgtgtgggcagtaaggggtgactgcacctgggttctgtggctctgaacgttttctgtttctttttggattatgaggagggagaactcttggttttgttttgaggaacttcatt

SEQ ID NO: 133936 - DNA, 2619 bp, Homo sapiens
ccagccaggataaaaggaaatggcatcagggaggaagcatgcttcatttaggcacagatcccagagtgataatggggtaataatagaactcatgccactgtcaatccgtggctgcattagtcccaggcttattctctgtctggggagccgcacagtgactttcttcgtgtgaggctgcagcgcaccagctgggccacgccgggaggtgccctcctttgctttcggaggggtgcaggcaatggggcttggatgttgccatttgctggtctcttgtcacaggccctgcctctgcaaggtcagtcatgggacatgtccgtggcattttctgatgtaggaggtgagctggcctgttctgcatcatgctaatggaagaaatggtggcggaacctcagttgcgtgggtggtcttctgggagcacagagtgagtgatgcccccgtgacagcagtaagaggcttctgcaagagtcaggggtttttcttagttgagctgcctctagtttaggagggtgggtttggaaaattcatattttctttccaggagcatgcataaaaactctcccaaaccattcaaagtcgtacagcttgcgtcgactctgaagttgggaaaaacatgcagtggacttttttctttgtacagttcttagtatttagcaactatgagatcttccatgtttagagtagaacacagacttctaaaatccttaacaagcagcatttgtacttgactgacctcgtttagcattttatttcttgtactcatttcagtaagtttcatagttctgtgaagttctcttgcaagtacccacatcactttggcaccttgtagtcctattttgtgtaaatttccgaggcagatgcattttaaaaataatgagctggtctctgtatggaaaaaataaccccatcatgaatttcttgtttatgcaaaggaaaggacttttgcattcctgtcactgttgaactgtgggtgtgagcactgttgggcccccagaaataaaggcaagttctttttatactgtctgaaggagctgctttcttaggtggtgatgcttggaggtaaggtcctttatttttcacgatcactctgtggtacgaccaaagccttatctctctcccgccagtgctgctgtattaaacacagctggcctttcagtcttaaattcagctgatcttaaaataaataaataaacgcagctggcctagaagtcatgtgaagtttgctttgatttccacgtgggtggaagtggagtggtccacatagcatgtcccactccccctgtgcccgccccgggctcctcgtaccacccggtgctgccttgagcacatctgctgatacgtggtctctttcatttgctttacaaacattttggtttattacatgaccactgctttttcatttgtagggtggctttacggggagcaaatgtttattttacaaagacaaatgtatggaagctgtttaaccacatttttgcttcaatatgctctttttaaggtctattatcttatcctttaaaaatgttgtaatgtgtactttgcgaatgaaagatgctttattagttttattgtctgtgtcccaaaataacgtttgttcactgattttttttccctacttttttcagaaactacatttccccccatgagttagaatagttacaactaaaagccaggtggccgcaggttgtttaccaagtgagagtcatttcaagtctattcagaagaatgggactcacagaaacctgggagcatgaagctggctctggcagcactgtggtcgggggccttgttttagggggagcagatacctgaggggagtgtccatccttgcttcttacctctctcaaattagagtcagtcagtgtgctccctcccttacttccatctcgcggtcttaagtcagggagtttagctttaaatattttcattgtgtaaaatttggagaggacaaaagcttccattgatccttttggttctgtttctgtgtagagttgctgagctttcagcttaaaagaaaactcagatatacaggtatgaatgcaggtatttttgtaggttcacatataggtaattgtttgattttaaactggagctgtatctattggttaaacctagttggggttaagttgaggaccaagctagttgtcttactcagggtttctttgctctgtgtgtctctttagtttagaccaaatcccaaatgagagttctaacagtaggcttctttgtaagcacaagcgtataatatggggagatgcttttctttctactctccccttccctgtaattctgcaatttggcagggctggttccttctgtatttagttagcaaacgaggccccacttctggcaaagggtgtttaggggctggtggtgccgagaatcacttctctgtgaggctgagcccattccccaaagcctgcctgcctttgtctggaggggccttgatgccaggcgcctgttgtcctcggactgtctgtcttgagaaatgctgctcaccagttttgagtgtttgtggggtagagcaggtccccatcctgttgtggcctggcctgggtacccctcgtggagctgctgtttgacagcagcacaacaaagggtagtagtgaggtgaagtgggga

SEQ ID NO: 133937 - DNA, 2473 bp, Homo sapiens
tgctgaaggcgccttgtttctcctgagagaatagccacagcatgtctttcagatgaagcgatgtcatgaagtacagaatatacccaagaaccaagtgattgcattggtgtcttgtctcctttctttctgcctctgtctgtaggcaagtgggggctttcttagaacttagaagagtgaggtgagaaaacagatacctagtggaatggtgcggtgggtgtggtgtttgcagtgcttgctgtctgcccgttgccccccgcataccttttggaaaagtatatgtgtgtgtgaatgagtgagggggtaagggggtagggggtagggagggtcaggcagagtgcacacttgggggcagaaagatgaggagcagggagggaaaccagtactttttaaaaattgttttagaacaccagaaagtggcagttaaaatccaggtgttcttatgaatgtactgttgacttgatatcagcttccagacctgtaattgggattgacaggaatgatctgcacatacacagggatggagagaagctcagcagagagaaccatggaattcataggattaattttaaaatcttgattttagagtaaatatttttcacttcctacaaggcatatctcaaattgattcttcctccagtgcactacagggccgatctcacagggccaccaggcctggccctgctgttgcatagcgagtaacacggatgaagtcttacacatgcttctcttcatttcttgtatttcacatacattgtgttttatttttgtaccatgttaagactatctcctgtctttgcccttaacttgtaacaccacttttgaccattcctgtatgagaactcaggaatatgggtaactttgtgtgtctgtgtgtatagctgcacatatagttgtgtacagccttttgagctttttaatggattataagtatgattttcgtaatggagggaagacacagttctttcagtatgtgctctttatttctcagtgtgcagcaggtatatttgcagagcttatgtggtaaaaagactgaatgccgcatcttagttctgtgaaatttccaggtgtttgcctgtaattggatggctccttgaatctttgtctaggctaaattacattttctggtgtatgcgtgctgtaaaggaagagatccagtaaaccacgataatgttttattaagataagcacagttttgatctgctctaagtatagaactgaaatgattagtcatggaaaacggggccaaagcagaccccagaatgtagtgtctttgggaatacagacaatgtaggccctgaggaattacaaaagtcagccgaacagtctttccatgttgccaatatatgctgaaagcacccaggttaccctgggtatgtggtcttcagtctgaacatttgggtgttgtttctcatcaactgaatggcattttcataggctgtttggttttgtctttagcttcttccagaccagctggtcttgcttctggagcatctcttggagcagaagactctgagcccccgaactctgcaaagcctccagaggacataccacctccaggatcaggatgcagaggtaaccaggaacactctcggagtttaaccagcaggtccccactgttgttgaagaatggtgatcccattgcagtcccaaactattgaaaccaccatttctattagcaaaatctcatgtgtttgctgtatgagtgaagaactaagtgctttaatctgattatgcttatgcttctaatcagagtattttgaggtcttaagtttttccctcttcttaaatcataaagatggacataagtctcctaaaggaatgagtggaatgtttttgagttgtaaacttgggtgggtcattgtgcccactgacggtggtgccattctgttgcacattaaggaaacttggctcagatgtgtcagagcttcttggttgcattcagttagggcaggaaaggagccatgtgtaaagggaatgaaaactaaatctagcagctgtagttggaaaaggcaattggatgcttgcgagaaagcaatgtgatatagtccttaatatcttctaccttattgtgaggaatgcagtgtgaatcctaagacaaattccagggttttaaaaaaatacaaaatagtaaataatgtattcagacatcttaagtaaaaacaagagcttaaacagaaaacctcttttatataagactcccaaaatgcagaaagtaagtttggttttgaacattttaaaactgtgcagtctagtacagcagccattagccatgtgtggctgttaaacacttaaatgcagctattttgagttgagatgtgctgtaagtataaaatgcacaatgaatagtgaagacactggaatgaagaaagacaaaataacttaatgtgtcccaattgattatagtgttagtgatatttgggatatattaggttaaatattattgtaatgaattttataatcattaaaatggagt

SEQ ID NO: 133938 - DNA, 1433 bp, Homo sapiens
atagcaccagtgttattaaataaaagagcctatttggaggaaaataagaagcattccaggttttcaaaagtagttaagatttgtctaagaccacacaggtgaagcaaggttgcctcttttatcatacttgacgtttgtatttgacatcaatatttgatgtttgtcatcacacttgaccctcaccatgatctccatgtgcatgtcgagtgtgatggccctggtagcagttgagcagcacattgctgctgctttagctctaaccagttaaggtgtagacaagagctgtaggaattgactccagcaagggtggtaagagcctccagtgcttcatttgtcctcttaaccctgtgcctaggaatttactaacctggctttgcggtagcaaataaagtaacttttaatttcctttagtttaaaaaataacattcagattgcagcccttcagaaataaggagcagaaaaggtgagagagaaaagaaaagaatgaaaacacaaatgtggacagccctgatgtgatcaccacacagtgaaaggttcttttcctctttccatgggactgagcaggtagacggcctccacctgtccagaagcccctggggcagtcccccactggaatgccgtttgccctgtggctactctgcagaggccccccttaccagccagtcagcccactgtaaagtcaagttaaatctaatttaaggacacaaattgacaaagcaggtttgtttattgcagggtagacttattaacttagaagagccatgagccctggtctttctgtttacagaaataaaatggaactctaaatgaggtttaatgggcttcccagatcatgttccctggacagattttttttttccttcttcaacagtaaatttgaaaatcaaaaggactaaaaataaaggggagtgcttcctgttataaataggactggtggcattcttcaaagcattttatagcctctaactgtgcattataatttcagagtggctgaaaagcattccaagttttcaagtggtacgtttactcagaagcatttatcaagcatgtactatgtgctgggcattgcgacaggcccaaagatggcccagaggcccatgcatgccccagacttgcatgatgctgtaaataaatacatcagactagcggagaaggacacggcagtgcagagagcagtgggagctggaaaggctgcaagcccaactctgagagtggccggtgggggcacactgggagctgatctctgggctgcagaggtgaactaggagatgtggacgcgtcagatcactcaagtgaacctgggtctgctggatgagctgtggccacagcaatgccatctagtgtcacagcagatttccttgtaccctctgtctgctggctccagcatagctttcttgttaaaaggctaaaggctactaggacacacttgagac

SEQ ID NO: 133939 - DNA, 1013 bp, Homo sapiens
aaagtgaatttgacatgaatggctagaatttcatgtacattgggttccgtatttatgtatagtcatctgcttataatttttaaatgtttaaaaataaagcaaggaaagcagctaccaaaaggagccatacgtgcttttctaagcatggtgacgagcatgcaccaaactgaatcctggctccaggattgccgtggaagagacaatgaggccattcctgtctttggtcttgatggtttttggtggtggcaccgcagctcttggaaccaagttgggtatactggctgagttcttaagagctcatctgctctgtctcgtgcctgtagccatgtctgctcaggcccttgtgaatgatgtttatttttcaggcagagtaatttttctgtaagacactggttttcagactctgtctccagtattggggtactctaaagacacagtgcccctttttaatgagtctgattcaagatgaatgccagaccatgtttccttgtacagaggaatttgacctgcagagggaagaataaggcccagggtgtcaggactagcattaaggagcacctctgattttctggtggagtcgtgctaaagctggcccaaacccactcgggccgttgttcaccttttgcctcatctctgtgttcagtgacatcatgttggtggatgttgggggatgaacaccagtacaccactgtgtatgttgtgctctgggagccatagcttgggcacccattctagagcaaggatcagccaaccccagcctgagcctgtgcagcccattgcctgttcttgtaaataacgttttatccaaaggcagccatgccatgcccacgtatttacatgttgtctaaggctgctttgaccaaaaggccaaaagtgctcaatatctggctcttgaaggaaaaaatttgccagcctctcttctggagtttaccaggaatctggttctggacacatgaagatatcttgggttaaaaagagattaggggccaggcttatgtttgtaatcccagcac

SEQ ID NO: 133940 - DNA, 1044 bp, Homo sapiens
gggattacaggcgggagcccccgcgcccggcctgctgggattacaggcgggagccaccgcgccggcctcttctttctttttttaaaatgctgactggtgacctactagatggatttcataacccactgtgtcttgactcccggacagtgtgaaaacctacatacaagctcggcttccagagcctgatgctccaggctggaccctcgtcggctcaggcaagctgctctaaccaggccccactccagctccagctccccaagatgggggttagaagagcgtcaacatgcagggagggccacagacaggctgggctggcatgaggtaggaggtaggaaccacatggctgagcaagagcctgggccaggtcagagactcgcagcaggacagcagagggagcaggggagtcccaggagtagtaagggcctgggaagagctacagcttttcaggccatctcctgggagggagacccagggacaggcacctgggaatcctgcaaaccatttgtaaagatggctcccttagccttgccccagcctcagccccagccagactccacttctgcctttacaggaaacttatcacacactacccaagaggttccatggagctgaactctggaaggctcagaaacacagtggagggggaagcctgctcttctgacttcctgcaatgctagaaaaatggcacatgcctagaagggccatttagaaaccacatcttggatttgggacacaggtcccgtgacaacgggcatgtctatgatataacaataattttaactaggatatggtaaaggggcctcacccttatttgattgctttttttcttggaaataggaaagctgctgaagcttcctcacaacttgaaccactctaatctcttttttaaaataatattttttaagacagagtctcactctgtcgctcagtctggagtgcaatggcatgatcatggcacactgcagcttccaaatcctgggatcaagtgatcctcccacctcagcctccccagtagctgggactacaggtgcatgccactatgcc

SEQ ID NO: 133941 - DNA, 2216 bp, Homo sapiens
ggtggctcccgcctgtaatcccagcaggccgggcgcgggggctcccgcctgtaatcccagaaggctgggcgcagtggctcacacctgtaatcccagcaggccgggcgcggtggctcacacctgtaatgccaccactttgggaggctgaggtgggtggaccatttgaggtcaggagttcaagaccagcctggccaacatggtgaaaccccatctctactaaaaatacaaaaaaattagccaggcgtggtggcacatgtctgtgttgccagctacttgggaggctgaggcaggagaatcgcttgaacctgggaggcagaggttgcagtgagccgagatcgcgtcactgtactccagcctggcaacaaagtgagactcggtctcaaaaaacaaaaaacaaagaataaaaataccagactgcattgcgtgtagtgaaggaaagtgttgggaaataacactttgatttcagtgtgtgtctatatgttctacatatacacatttgtggatacgtatgcacacatagatatgcatacgtgtttgtactgaccatcactctgccccgcaccatttcccagtgcctgtcatgcagttggctgccatgaatgtgcttggaatcagtgagccccatcctcatagccagtgcctgtgtgtgtgcttccttccacgtgctttttggatacccaggttgcatgtctgcttgggcctcctaggtggctcaggcctgtaccacagacataccccgtcctccctgtggcagtctgtcagtggggtagggtccacaatcctggaaccattacttggattccttgaggattttaattctctactgccagatatgtgtctgatgtgaattggcttccacatacctgcccttcattcttcccaccctagattccaagaccctcccacctgcacccagcctcaaagaagcagttgtgtggagcactcttaggagaagctgaaatctttgctgtcattaccctgtattcatggaggctttggaaacccggaaagtgctgaatccctttccaacagtataaattgcgcctctgtgttaccccgacctgtacgctaagtgagggcagcactgtcattgtttctgttgagcatgtcccgtaagcagaacactttgaacagcagatgtccaaagtaatttttattggactaaagcattcaagggtgcacacctgtgtgttgtgcaaaagtcaacttcactgtgatgacatggaaaggatccagagacccagatgccacttcttcttgcgagagctgtgctgatttatttcatatgtgagctctcgcccacttccggcaggtcaggaggccagccaggcccaggccgcacctgctcttccccctcccaggccacctgcttgtctgctgcccagcgtcagcaccggcagcggcagagggaagagatgagcacatccttgataggtgaggtgttgggtgcttgagaggctggatccagggcagaggtgtgggtgctgcaggtgtccaggaccctgtgctcactgccacgggcagctctgttctcacttctccgtgccctgtccctgtttcccttctgccgtcttgttctttctctacttgcccagtctccttccctcccacaccaacttcatcattttcctccctcgcccctttggtcatggtctgcggtctgggtctgtgtagggctgaaatacatgctgactctaggctctcaggtgattcctggcatagatttggagtgacttgatgaattttaatcacagttttaaaggtcattaaatttttcaactatattgacaatagaaatataataaaatgtgaatatttgaagtgtaccatttgattacttttggcatatgtacccatgaaacattaaacatcaatgaagagaactgagaagccagataactgtatgcaattaagaaatacaagcaaaaccgccatgaacaaagtcagacagattgacaaacctggaaaaagctgcagtttcatcaaagatgagctaattttcctagtactcaaaaacactcaacagattaactagaaaaagccagtgatccaataggaaaaacatggtaaagaatatgaatagacagttactagaaaggattttatgcacatgaaaaaaatgctcggacatggtggctcacacctataatcccaacactttcggaagcttaaggtgggaagatggcttgagcccaggagtttgagaccagcctggg

SEQ ID NO: 133942 - DNA, 1084 bp, Homo sapiens
ttggggttttgagtacaaggaggagacagggattgcagactgcagcttccaaaagcacagtcagcccacggcctctgtcttctctggggtctttgcaatttctagaccagcaagtgtgtgtggaacaagcacagactgagctcatgtgtgcgtgtgtgtgggtacccacaccttcgcctgatgccctttggcctctgtgccctgcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcggctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagc

SEQ ID NO: 133943 - DNA, 1036 bp, Homo sapiens
gtgaggtaagtgcacagtctgtgtgccgccagcccgtcctggaggggagccgcgtcaagtctgcagcaggcgtttcgctacgagacgctcagtcccgtttccctttcctggcacacatggttcctgactcttctggaagaatatgatcatgcttctgaaaaactttttatttcttttcattattagagttctttcagataaataagctacttaaacacgttacacagaaatggttttcataagcacaaaacattagaagaaaactcaatgttcaaaactgagtgaagaatatcaacaccaaatattcaatatccatgaaaaattatagagaagctataacacgaaaaatgcttcagatttgataaagtttttttaaagatacaaaattagacatcccctattaatatcatataaaacactgaagaaaaacggagcagacacagaaataatgatgattgttagagaaaaaaaatctcacagctatcctaacaaaaccttgtgtactaccgctaggttgctttaatagtgtagaaacccatactgagcaactaactgctaggaagtaaatctaacaggttaattccaggcacaattaacagaggaagtgatttaaataatctaggactccaatagaagccaggggagaaattccgctccaacacaacaaagcaaaaagtaggacctgccctcaagacacagggtcatggaggccatatgccacgtgtgctgtgtgcgccgcgggtgctgtgtggtgcgtgcactgtgtgtgccacatgtgctctgtgtggtgcgtgcggtgtgtgctgtgtgtgccgcaggtgctctgtgtggtgcacgcgctgtgtgtggtgtgtgtgctgcatgcagtgtgcgcgctacgtgtggtgcatgtgctgtgtgtgctctgtgttgtgcatgcgctgtgtgtggtgtgtgtgccgcgtgtactctgcgtggtgtgtgtgctgtgggtgctccaggtgctctgtgtggtgtgtgtgctgcgtgtgccgcgtgtgctctgtgtggtgcgtgc

SEQ ID NO: 133944 - DNA, 2036 bp, Homo sapiens
ggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcaaaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatgcactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaacagttagagtgggtgcgtgt

SEQ ID NO: 133945 - DNA, 1917 bp, Homo sapiens
ataatgcatggaagcgaaaccaggtacacacacattattttcctactttgctgggtggatggacgaggccattttaccctttgagcagcttcgtctccacttgtgaaagcaaaatgttgatgttgcgtgtccaggcatacaatacaaaaatatttgtacagagtatgcaagcctgtgtggaagggatttgcattgcttaataatttaagaaccaagaaagagagctctgcacgttgcaattttaaagaaaatataacagggagcgacaaatttatcctgttttcacacaaggactgaaatctgatgagttgagatactgctgaagcttatggcacaaaaaaagtgtttctacttttcccttatacagtgcaggttttcatgtttgccggattacttgttaaacgtgttctgatctgactttgcattgttcaggtgtgcactcctggaaaccgatggggccctggaaatcatagccactattcaggtgtttacgcagtgctttgtagaagctctggagaaagcaagcaagcaggtttgttatatcacatatattactcattcatcccagagaataagacgctgttgagagtattttggacaagagcactttattttcaataattttgatggactgttttgctcacaaagaaaggttcctaatgagtgccccaacaaaggttaagccattttaacttaacataaatcaagatctgtctgccccgtgccctgatacccagaagcatctgtctactattatgtctgagaactctgtcatgccagcatgcatggccctggaggacggctcttcttggccctgtgttgtgcactgtctgccgagcaggacactgccccctggctgcatctgagcctcccaggtcagcaggaggcaccctggggtctatatggcatgtgatgaataggaaagggcacttattacaaagcactcctggacattcttaattattagcatcttcattcttatcagagacccaaatgtgaattggcttccaggaaaggaggtggtaagagtgactgggaaaggcttgactaactagaaggggagtgaggaagggcagtgagcgggaggtgtgtgttagacacagtcagtaaaccaaaggccaggcccgcaccctgcagaagattgtgctccacgtccccagcagcagaggctgggcaacagctgccaagagtcaatgaccaattagagggacctcgtgaaacagggacctttgctaccagcgagctttcacctttcagcatatatatttggccttgatttctaacggccacagaagtaatgtttatgggacacattgcctgtcgagagtggtgctggtccagtgcatctcatctgtagagtatgtcacggcccctgtgaagctctccgcagtttgacttccgagaggagaactacaatgcttggctccaccagatcacaccccccgccaacgtcaaatagatctctcaggttttagccgatatttctacttttttttttttttttttttttttttgagacaaggttttactctgtcacccaggctggagtgcagtgatgtgatctcagtttactgcagtctcaaccccccaagctcaggtgatcctcacacttcagcccctgcgtgtagctgggaccacaggtgcatgtcaccactcatggctactttttgtattttttaattaagtacaatttccattttatttttctcaagagaatagtccgtcttcagactttaaggactcaactccttacgtgggctttggtgggggttgtggggcagcatccgcaggtctaaattggagtaggggtgttcagtccttgtgggcttcacaagatcgattcctgactactttgctgtgaattgcacaactcagacagtaatgtagcttcaaatacagcttgggaagcacataggc

SEQ ID NO: 133946 - DNA, 1231 bp, Homo sapiens
gttatgtacccattaccgaataaacaggctgcaggcacgggcctgacctcgaggcacatctagccatttgaggaggtcacacaggcacacttcagtagaactggcagtacaggcaggctccacggcatgcgggcagagggatgtttaaagtttctctaatacttactgattctgtattatggatcgcctgagcttttatagaaaatgtgggacatacaggagtatacagaggaataagctgcctgtaacccctgcccagggagaccaccgtatgcacttgtatgtggggcgttttcagtacagcagtggttcgttcttctaaccaaaaggagtatgccagttttctggacatcagcagttcccagtaactcctttggctgataatagcaagtttctgagaaagtgcttgtgatatttcacattctcatggtcttctccttttacagcctcaagcagcctgccaccctgccatattccgggttgttgatgagatgttcaggtaaacgttacactgtttcttctagtaattgatgtaaaaaaggttccatttccaagcatgaatcagaaaatgttgtggtagtctctggctgtatcatggggaaattagagtttctgattccctcctgttcctctgagctttttggtaattagaggtaaaaactcaaaaatcagtgtaaatttaaaggccagtgcctaagaattaagataactttattttctttagccttttaagattctaataatagaaacacagaattgagttaggcattaatatcatgaaatattcatgtaggatttttctcagctcagaataaagggtagcaatatactcccttcaccatgtgagggctgaccaatatttttaaaagactttaaagctaaagaaagccaagaaaaataaaagtcattcttaacagaactcttctgaaaggcaaaatacaccatgcatgttctcttacaacacattacatttttattttgaaaatatgagtacttcttgggaaatgcattagatttacagacggcaagagacgaggagctcacagccatgaagctgagatgtggctggcagttagtgggagttttaaccatggagtactaagttagtgggagtactaaccatggagtactaagactggacgcccctggggagcttgtcacctgggagtgtcccagcccctcttccaggggagcccatatcagctctctctctagcccctcccacctaaca

SEQ ID NO: 133947 - DNA, 1293 bp, Homo sapiens
gttcatggtgcagagtgacaagttggcctctcccttgcctctcttccaaaacaggcactgagaccatggttattgtgtgttgattccatgttgactttgtcttcccttgtgttttgagggatgaagatgggctttctttctaggtggaggggagataaacaatgcaattctgggtagccatgaggggagatcagagggaaagctcttgttagcccaaggggatgcacacccagcagaacaatcgggtctatacaagagggagggcagaacccagagctctccatcttcgctccctagtcatcctgggcattcagtgaaaagcctgaggggggagataaggagggaaggacaagactcatgttattgaagacctcctgctgacatagctcccctcgagttgaaatgatctgcctgtggaaattgttaggccagatggagaagagagagcttgagaaggaacagattttggtaggatggagaaaaacaaacagatggaaaccacaaaaggtttattttatttccccgcttttatagaaaagataatggccgcagtcatggggcttcagagccctggcttgcagcgtgacctctggtgtgttaccggagtgccccaccttacaaataaaacaggatcagaggttagatgcctgcgtcatcactcatgaagatgctacagagatttaggggggaagatacggcttccaaagaagcgtgtattaaaaccttaattctatttggaagattatcttgataagaaaagcagcttaagattgcttttgtgatttgatgtcgctgggacatatgcctgacctgtagtactctagtcctcatgaggggactcactgaccctgaaattatgtgctcaaaaagtataaagagtgtcattttaaaagccatcggtgaggggtgcagatgagaaggagcagttcacagctgtaggggtagcaagggagactggttttcttttttttcagtgaggtcaggagatcgagaccatcctggccaacacggtgaaaccccatctctactaaaaatacaaaaattagccaggtgtggtggcacgtgcctgtaatcccagctactcaggaggctaaggcaggagaatcttttgaacccaggagttggaggttgcagtgagccaagatcaccactgcactccagcctggcaacagaatgagaccctgtctcaaaaaaaaaaaaaaggagactggttttcaaatcaaaatctctgccgttgctgtttctgcaggttcccctgcctcctggcctcttacctgttttaaaagctaaaat

SEQ ID NO: 133948 - DNA, 1107 bp, Homo sapiens
accatgccaggctaatttaaaaaaaaaatttttttttgtagaagcagggcctcactatttgaccaggctggtcttgaactcctgggctcaagtgatccttctacctcagtctctcaaagtgttgggattataggtgtgagccactgcatctggccttgaaattgttagaaatattttcaactttcaagcaaccgattataattagttattggatatttatgtgccaagcactgtgctaatcactgtacgtgtgttgttgcattacaagaacactgtgaaggagataggcccattttacagatgaataaactgaggttaacttctctgagatcatacagttagtaggcagtggcgctgggaccgaaacccaggtccgcatccctattgtgaggcatgattacgcgtgtttgaacatgcctatttcttcagttagggactgggcatcacgaggccttttccatcccgttttttatcgctccctctttcttccatcactagacatttgcttattctttttgaaagcaatttttttcctgagcatttctgatttcttaaggtgagttgaagtggaagcatattcacattattttgcaaatgagcacttggtaaatattcactgattctataaattattagccactgctgtgaccatgatgagaagtctcacaaattggattagtgattgcattttgaactttttttaatcttcttttttcagtgagccatttctgtttaaaattttgtttatttctttctgaaaggaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctggtacgtactgggttttgatgaagggaaaaatccttgaaggagatgcttggaatcatttcttttagtcagagaatgaaagggggggatgtaaacaaaagagcaattggaacctttatatataatcgtgtatttacattttatttttgaaatcactaacatagggggcttttctgcatccttggagcatgc

SEQ ID NO: 133949 - DNA, 1040 bp, Homo sapiens
gagggcctggaagctcagaactttcccccaggcctggccccatgcatctcttccatgtggctgttcctgaattgtatctttcagaataaattggtaatggcaagtaaagtgtcttcctgagttctgtgagccattctagcaaattatcaaacctgaagagaggatcattggaacctctgattttatagctagttggtcagaagaatgagaggcctagacctgtgattggcatctgaagtgggggcagtcttgtgggactgagcccttaacctgtggggtgtgtgctaatgccagatggtgtcagaattgaatcactggacacccagttggtgtctagagagttgggagcattggtttgtgtggaggaagaaaatccacacagtgagtgtgagaagtgctctgtgagtaaaaacagcttctaagtagtgggagtgactgacatacgagtctctgaccactctaacactcgcagctcggggtggctctgagtgttaaatagggtggccatatgatttaaaatctagaccatgccacttctgagagttaaaagagatcccttttataagtatagtgggataacagaaataaacttacaaactaggacaaatacttacactaagatttaaatgggttgaatgactgtaatattcttagcacagtgcctcgtatccacagtaaataccccgtaaccattagcgtctacagccactccaccctaaatgtgcccagtcttgcctgatctcagaagctgaggggggttgggcctggggattagcgggtgctgtaggctttaaaaaataaaaataaaaagacaggcacagtggcacacacctgtaatcccagctactcaggaggccaaagcaggagaatcacttgaggccaggagttcaagtccagcctgggcaatgtagcaagaccctggctctaaaaaataaaaactgttggtggccgggcacggtggctcacacctgtaatcccagcactttggaaggctgaggcaggtggatcacctgaggtcaggaatttaagaccagcctggc

SEQ ID NO: 133950 - DNA, 1096 bp, Homo sapiens
agtggacagagaacttcagatatgtagtagaaagttatgtggtattatgatacctattttaattgttattattaatgacagcaaaaattatgatggctgcagcgtggttgacagctgttttgcaaaggttatcatggtgtcagagatgttacctgatttcattaaaccggcttctacttgagatagaagaatacacttggcagaatttataattcactggagaactgtggacttgaaaagttttgttctcacacaagcttttaagaatccaagttaaaattttatgaatggtgatcacaaaagcttctaaaagggctcaaaaagcatgttacgcatcaaattgctttttaaattcaatcttctgataggtataaatgaactcagtccaagagattgaattatcttaaaaactatatataagggctcaacacattcagaaaagtacctggacaaatttatctggttgaattataaaattctttaaagaaaagattctaaacatcattcagtagagcaaattaggaatgtatcggatgtgttggtttacagggagcactctgctagcacaggcatctcatattcttagtaaattcagttaagaattttactgattgtatcatagctttgctttgactaggaatatcctgaactgctaactaaattaattccaattttatccttgctactcctgccagctgggatgccagcatggacatccttcagtggacttcgctctgtgccagggaatttgttcatattacttttgaaaaacaagcattcttaacaacaacaacaacaccaaaaaccaattataaactagagaataaacctcttccaaagtggcacaatctggcacaaaggcaaatttttaatctataaaagttgtttcagccttggcacagtggctcactcctgtaatcccagcaatttgggaggccagggtgggaggattgcttgaacccaggagtttgagaccagcctgggcaacatggagaaaccccatatctacaaaaaaaaaaaaaacccaaaaaaagccagatgtggtggcaagcacctgtaatcccagctactagggaggctgaggtgggagcatcgc

SEQ ID NO: 133951 - DNA, 1124 bp, Homo sapiens
atttctggagctcgagtgatcctcctgcctcagcctcctgagtagctgggaccacagatgtgcaccaccatgcccagctaatttttttgtattttttatagaggtgggatttctctgtgttgcccaggctagtctcgaactcctgggctcaagtgatctgcccgtctcggccttccaaagtgctgtgattataggtgtgagccaccgtgcctggcccctttgtaaacattttagtggcttacagtgagccactatataagcatattaatcattctctgctgttagacaatttttactatatgagaaataaccactatagtgaacatcttcgagcatagttcctgtcatcatatttgcatttatttccttaaatgtatgccacatatatcaaaggttctgaatattttgaagacatttaatatatttttttcaagttgctttctataaggcagggcctctgttagcccgtaatcggtctttgttcaggtgacaaacctctaggcagacacacccctggaagtccaagcttcatgatgggttccgggctgtgttgcctctgctcacactttgggcgcctcggtgccattcacaactgcactctgtatggaagaccctatttctattcctccaggagctcacacagagtacatgtttcatagaaccccatacagcttagctattcatgtctgtaaaaaacttgaattcattaagtgaaagtgccatacaggtgttttaccctaccctttttgattatggaggatgaacattcatttatgtgtttcttagctatttgtattttatgaattatctattcatattcattgttatgctcttagtgtttgtcgtatattttgtacattaatttgataatatagaatctgtactgtttgttgttaacattcttcttagtttgtgctcatattatttttctggtaaacacaagattttatttttattgagcacagccaagcctcttccctgatgatttactcccaggattttcagttctcagagttctttctcattcagatacttgaaaaatgttcatgttttcttcttgtgtattatttcatttttacatttatctctttgatttacattaaactggagtatattttgatgaa

SEQ ID NO: 133952 - DNA, 2012 bp, Homo sapiens
caggacatggggggtgtgcgtgtgcaggtgagcttgtaaattggttaaattggttggtggtgagatgagtgagtttcttgctaattgctattttctcaactacatatgagatgagctcctcaccaggacttttggggaaggggtggtggtgtgatgagagaggaagcaggaaataattactcaggaagtggccaagcaaaatgaccaaggatgcataagaagattgtgaggcactgctgagccccttcccttcaagggttgtggtcagaaatccaagccaacgctgtcagctcagttgtctgatattctccagcagtgttcagctgtgtgggcaccaggaagaaaagctgcagcatggattcacaagggccaaggttttacacagcaagtaccactggactttagaaaagggggcaagccagggagatgagggtgttttcaaagggatgattatttaagcctggcagaatatttatcaaatgcatgatctgctcctagtgaatgtatttagtaaagcacacatttccaggtctgtgtatctacatatttctgtatacattcttatagatacggtttaatgccatggtttcattcaggcttattttctaaagccttttggttttggtttttgggaagcctactctatttccccccccggaactaatgagcgagcaagcaagaggttctgtaagcaaaagtaaaagctgcagactttgttatggttggacctgtgtgtggaaattctgtgaattgtgttctgtcagcatcctgctcacggaataggctatgtaaacaacgggcgctgggagggtctgtgaatgagcagccttccttcccactcacagacttaaccactgcaattctccaggtttctgagtgtttatttcatagtaaaaagggctctaaaaataccagggcagttaggtttttattgtagatcatttcacttaaactgcaatgggacatataaattttaaaaagggaaaaaaaaaacattgaaggcaggattttgaagcaaaagctacagaaatgtgtctgcagtaatttgttttggctgtggatgtaaaactgcaaaagggatgggaataaatttgttccatttttttaagttagagcaattggcgtatttaattgatattcacagtatttgaatagcatcccagaatgcacaaataatatgctatcatgagaaaattacatatactgagatgtaaatgaaaggaaattctttttttgaacttaaaatatcatttgtaacttatgtgtaattttttaattaaaaatcatagggcacatcatactgtaagtttgagtatgcagagtgaaatgagaaaaggattcaggcagattaggcttgaggacaggaggcaaagccccaagagtcagtccaggtagggattataaatggcagggttcgggaggagtggacataaaaatgcgagagaacaggaaactgcaggaagtaacagttagtgggaaacaaagagagaagttactgagaaaacagacacaaacactgacgtgtttcggactgccatgtgaccaccactgaaggatgataaggtttactgagtaggaagatttgaaattatggacaggagcaatatgtaccaaggaaagcaaatattttgcttttcactggatggaaatttctcccttctaggaactcctgaccttctttatgggaccaagcagtgtaagttgtaggcttgtggttccttctgacttcttgtgtcttctccctaggggcaatgatggtgctggggtgtgatgttttcagtatgaagttgtgcttggaggcagtggcaagagccagtgggagcttttcatggagcaggctgcattaacccacgcgctgtgtgcctcctgaagctgtggcagtagtggcgtgacacctgccttcctgggagcctgggaagaaccccaggaagagacagtgaagattgcatctcttgtgggagatagaaaagagttcagtttagtattggcagtgataaatgcttgctgtgtag

SEQ ID NO: 133953 - DNA, 1073 bp, Homo sapiens
aatgagcttattaggctgttttttgagtgctgccaaacacctaattgattttttcagttttcttccaagattatagttgtcaagaaccatctgccttatatattacattaaatgggttaaagctgcaaatgcttctttaagcaaaatataagtgtgtatcttatagaaagtaatgcaatatcaccagtctgaggtttggagtgtattaaggtacttggtttctggaaatctttttaagcttggaaacctttaaacctgcgacttaaaaaaggatctacagctatctaagtaggtggccttctgtgtcttggctagttttagagtgtggtgtttgtttcttacgcaaaaaggaacaaatttaaatcactaggtactcaaccaacagatttcagtgtggattagttaagaaataattgtagttcttgtgtggtggcacaaatttttttccctacattttgtttatgcagactgtctttttttccttcatccttttctttttttcactgaaaaaggaaatcgcaattttgttagtggattgctttgaagaaaatacggagggaaagagagaaccagacttgacttgtgattacttttcatgagtgtggataagtgtgggcttcaagacttgccaggccttcaattctttggcttgctttttttcttaacatttccaaaggttttgttagtgactttcaaatggaacttcacgccttggaacagttccattaaaaagttgtgtggtgttagccacagtagcagcatggtttatttttcctgtactagtttcacagaggttaactgagctggaaatgatgagagactagcagtgcaagcgggtgggtgtgtgctatgtgtatgctttttccctcttgatttgtgcaaaaaaaaaaattttttttattggcattaacgtgtacttcaaatgttgtttaaaaaggaagcaagtcaaattatcctaaaatgctttatactacattgttgaaaactttcaaaaatgttctcttttgttaattgtatttttacattgcatagtaccagcccacatttataaaaggcaattcattatagagatt

SEQ ID NO: 133954 - DNA, 1092 bp, Homo sapiens
ggagcaggccagagtggaagtaggttattgcagtaggccaggcaaggggttatgagggcttgaaccagagtgattaccttggaatggagggaagcagatgaattggagattttgtctggaaatataatcaatagatattgatggtgtattttataaagggggccggatgagaaagaacatcaaggagactcccaggattttacatcaagttgccatttactgaaatgagaactgctcccaacagatagacatattttattttgttttaattcatacatgggcttttaaaaagaataaactttattttttaaagcagttttaggtttgcagcaaaattgagtggaaggtacaggtatttcccatatctacccattcctacacatgcacagcctcccctgttatcaacagtcccctccagagggatgcattggtcacaactgatgaacctgtcctgacacatcgttatcattcagagtctgtagttgacattagggctcactctgggtagtgtacattctatgggtttgggcaaatgtgcaatgacacatatccaccattacagtatcatacagcgtagtttcactgccctagaaattattcgtgctctccctgttcattcccctcttctccctaatccctagcagccagtgatctttttactgtatccacattttttccttccccagaatgtcctgtagttggaatcatagattatctagccatttcagattggcttctttcatttagtaatatcatttagtagctcatttttaaagtgcaaaataacattccattgtctggatatattacagcttatccattcacctaccgaaggtcatcttggttgctttcaagttttggaattatgagtaaaacatctgtgtttactaaaacacagatgctaaaaacatctgtgtgcaggtgtttgtggggacacaagttttcaactcttttgggtaaatatcaaggagtatgataggtggagaatatggtaagggtatgcttagttttataagaaactgccaaaatgtcttccaaagtggctgcaccatttttcatccccatcagcagcggatgagagttcctgttgtt

SEQ ID NO: 133955 - DNA, 1034 bp, Homo sapiens
gttttaattttgtttggaagttttgttttattttgtttttttcattttatttacatggagttctgcttattataattctaattgtatcagattgtttcttagtgatttgccagtgctcagatgggccagatcaagacatctattgccaattaggaacaggatgtttatggtatttactgatgttctccggatgacctgttttatgttttcagtttgttttgttttatgatcatgttggcttttccattaaactataactttaactgagttggcttagttagtaaaacattgaccagctccccttctctatcctccaggccccttctgatgcctcttcccctattgtgccccagcctcagtctgaagggaagcgaatttttaggtctctatgttccagatgtaatctatatttccaagacataagctcactgtatttcaacctaaattgcctgagtaatgctccttggaacatttagggataaatccctgtgaaaagtaaatttaaacagtgacgtctgtagtgggaggtatttcttaatgaatagccactagtgaggatgtgtggatgtctgcactacacgtggctgcctgatcgctacatctgttttgaagttcagtgatttcccagaccacatgttcatttctttagggggctgacatccctcccaggatccagtcattgtgagctggtaactgtaactggcttactctttttgacctagagattattatactttgtcttagtttgactattgttcctatcagatctgacaatattggagtttctataaattagcagcatggcagaggaaccaagtgtatttaaacccataaatcatgatttccaggtcttttaaaagctgtgtggtttgaatagtactttactctatggtagacataaagagtggttataaaaattctggctaatcaggaggcttttgtagttcagctgaaactacaaaataacctcagatgcgtcactcctttgggaatcagaccatccagatttgtcctggctctgccagtgagatctt

SEQ ID NO: 133956 - DNA, 1050 bp, Homo sapiens
aattaaaagattaaatcacaaatactggctaccaactgcctataaccattaagttgccttagaaaggtcgaaattactaaccatttgaaatgtgaaaaaactgatcatgaaaaaagcccagttctcttagttctttccatcattctcgtttggctttaaaaattgatactgttacagaaaggaaattgaccacacaagagttaagtgatcccaaggccacaagaaggacaaaaccccacaaagttaagtttagggaattctgaaggacagctaggagagcaaagatagagtgagggaaaatattcccatcagcagaaagagaatgtgcaaagtatgatggcgagaaagcaaatgttatattcagggatacttgttctgtgaacttagtagtttgagattttcctaaatataatgtttacagtgtttttatattaatgattttttctgcttgataaaacttattaagttttcctttttgtagatgaaagccaaaaaattctaatatggtgcttatgttgtctaattaacaaagaaccacagaattctggacaatcaaaacttaactcctggatacaggtaagagagtaaatcttgctctgcacttctttgaattaaattgattatttaaaagtgctgcttaaaaaaattttggggtggggtggaatccagttctatgatgttttagaaactttttcaaacatacccttcactgttacattatcttgctgagtaaaaagtttttcaagagatttcaattttgcttgactgtgaattccaaaagataccagtctttaggatgaagacctaatgttgagtggttttgaaaagtttctttcaggtgattaaaataatgtattccatttcactctagcaattgctatccttcaaaaaattgtttttccctatcaacctggtttaaattcctttccacatgcttccatgcctctctcaaaatctattttgtagtgaaatgaaaattcagcagtgcggcgggagcagcactctttattttgtgtcccgaagttggtgcctgagccagcatatgcacag

SEQ ID NO: 133957 - DNA, 1050 bp, Homo sapiens
cagcaccttccatcccaccttccagcaagggtgctagtttctcactctgtcgtttgtgcctctgtttagcccccaacccttctaagacccaaacctacagtttcattgcctgtttttggaccctagcataggaggggctggctgctcatggttttgtcctcggggtcttgcctctttgtgtttctgtctcgtatcgatttcatagaaatgtttattttgtgtgtgtgcttgcctgtatccttttccttttttctttttatgtttcccctctcattgctgtatgtttggagtaaagagaatccatccaaaagtgaatttaccgtgccatcttaactggaagtcacatgggcagagagtttaaaggaaagaaagatacttggttttacatagtactgaaagctaaccacaagaacgcttcctatgtgagctcagtgacccatagcatatagttacttaaactccgtctgaggcttgcaggccccaaaagatgagtgggattaggcaggtgggatttattagggtgctatggttctctacaaaggtttcaccttctatttttcattttggtggtaattttttaaaaattcataattccacacacctaaatgcctgcaattctaactaagtaatgtcttaaaatttcagtgcctggagttgtgtttgtattggtgccaaggagcactgctttaaatatagggagatattataaaagaacagaggtgaaaatgtaaataacgtgtttgagctaagagattgccgttgcacagtggttctgaagaggaaagtgatgcgtgaattaagctgtctccctgcatgtgttagtattggccagtcaacagaacctgcctgtcggtaccaagccctacatggttagtccaaagtgagtttcaatgactgcatcattgatcacgctgaattaattttgtcaatttaaattttactcattttgtagatttgttggtatttaatttgtatattttttatattgtggttgtgtaagagttacaagcataaaggttttactggtttatgtttgttaatatttaacta

SEQ ID NO: 133958 - DNA, 1059 bp, Homo sapiens
gccggctggccatgtcctgttgcacaggttcatgaggagagagtcgtgcctgttgccgcacatgttgttgatggctgtttttctgctgcaacggcagagttcagtagctgcaacacagactatggtctgcagagactatgatatttactatctggccgtaagacacctgccaatccatctctagacaaggtaacataggccagtgctagtcaagtgtggtccacgaatcagcctgccttggaagcttgctagaaaaaccgaatccaacaccacctaactcagaatcttggagtgaggtccaggaatctgctttaacgatctgtcctggtggttgtgatgcaccagcggaggcgatcccgaaattccagctgagtgtggccaggttctatcatttggcttcggctcctgggccagtgcgggccggatctggaaatggcacagagataccgactccactgtgtggtcctttcacaaaacacatgctcctctgtgggtgagcccaggccaggagcttgactgttacgtctgggagtccagagtgaggaactcccttcttagtgctcaccccacagtgagggaggacctggaaggagagtgtgggcccctttcctagaggggagggggagccacgccgggcccttccacggagagggctccctgtcacccacttgactggcttgggcaagtctcttaaaaccccagagcctgtgtgtcctcatctgtaaattaaagagataaatatcccttgaaaacttctgaagggtggcagcagtgatgctggtgacgaggtctggatctcaggggctggccggagtcgtctgagtgagaattggacagccccatcctgaggaccccactccaaaccccagttcaatcaccagctctgcctcagggttcccatcttgaagatgacaagggctccccatagaaacaatgggcgctgctatgggaatagttcatgtttactgagcccctcttgggaggcatttgaggtagcacagtaaattctgaccaaggaataagatgttcaggtaatacactgtcctccttaatactaca

SEQ ID NO: 133959 - DNA, 4401 bp, Homo sapiens
agagcagcccttccgtgaaagagagaaaggccaaccaaataacctgaattgtcctcctcctaccccccgcgacgacgcccgctgagctgcagtgtgaatctggttttgttcagcaggagcctaaaaataggtacaagctgaacgactttgaagttggtcacggtccttttgattgatgtggccactgtgttgctctgtgctttgtatagagacgcagagaccagattcttaacaatcagatggaacaggctgcccgccacagccctccgcagtgacgaaaatgccctctctgctttccaggatgggagccaccggccacacgtggctgtggagcacttgaaatgtggccggggctaccgaggagctggattttggattttagttcattaaaacttaagcaaccacatgtctggagcggctactgtgtttgacagagtaggcagagacagtcctgccagcgtcctgcactcaggccagccagggccgcacacttagcaacttcgggagaggggcagctcagagcctgcagaacctaacagggtcgggggcaggttgtggggggcagcagcttggatgctctgaccacagcccacatttatgggcagcagcagtacgtgtccagccagccgtgtcagagaaagcctggaaacaggattttcaaacaacacgctcctccgccaggtcctggaggttattagaaggacaggcttttcttttgtgggtggaaggcccccattggctccccagggttgactgagtctttggtgaaacccaaggagggaagtgtgggagctgcggggaccatgcccagcctgggataccacccttctaacccaccctcaccctctgcaggtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgaggtgagtgccactgacaagggcagccaagggacctagagccaggcaaagaggaggacaaggttctcctggggttctcggcatccccgaggggctgtggcgctcgggcacatcccacgctggaccccagtgaccttttatccccagagcaaggctgatgtgtccaagctttgtcatccttggggaaccagtccagctccacactgctctcttcccccactgctaacctgcggagggtcggtgcagcgccacaaggacacaaacagcaccaccttttaccaatatttgccagtctttatggaggtgcatgccacagcgaattggtcacatgggaacgcatccgtgtaaccagcccccagatgaagggagaggtcacaagcagcccccagggacacctcaggcccacaccccactctcgtgatttctaataccaaggttactgctgcctgcttttgtactttataaatacggacttgcacacctcttactctgttcaacttccttttttgcttccttttaaagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaag

SEQ ID NO: 133960 - DNA, 1019 bp, Homo sapiens
cctgtgccgctcttcacttcgatacttaggtgcctccccacttgctggtggttcttcagtaaacatctcagagtcatgtctgttttcctcttcggtgtactggctttgagggctagagggcgggttcggtttggttcctctaaatcaactgattggcagcctgggtcttacagatctttatacagtaaatgaagactttccccttgagatgcataattggacttcacaagagtaaaaagtacacatcctgcctttccagtgtggagcagaggacagttcttctgctccagctgcgggacctgaaggtcctccaggtggtagagaaggggaggttaatacggcacagtgcgcagggccccagggcagggaacagaggcccctgaaaaataccgtgctttgagctttgagtgtggccagcaggtaaatggacaagaacacttttaacatggaatccccttaaataggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtaagtgactctgcagaaccagggggaggggtcttcccaccgtggtagtgggcctggaggtccagcgggggctcctgtctgctgagcagcacatcacacaggcagatgggatgcagagataaggtacagactaggtcaaatcataggaaataaccagtatttaactctttctcaactatacaaatgccatcttcctgtggtttgatctcataaaggataaaaagggcaggggccagtaatgtcactgcacaaagcagtagcatctatcttgttcagggtgaggacagtttgggcttcaaa

SEQ ID NO: 133961 - DNA, 1317 bp, Homo sapiens
acactccctgcaggggtcacacgttcaggccaacagtctgatcttccagaatttactctgcaaagttcccgtttagttatcaacagcatttctggcctaggagagctttaggactgcaggagagacagggatgtgtccacacaatgttcagaagggcttgattcaaatgtacggtcctgtgtatttcttgcaatacactcatagtgcttagatgtactacaaacatagcctgaaacagtgacagaaggtctcacctctgcataatcgtgaggaagtgtgtgtagcacccaattgcttgggacactgagctaagctcttagccatccaatgcattagccagaatcctgtgctgtgggaattggaggtctcacgtgtgagtggtgtgagatcatttaaggaggggggaaacttcggggtgagtatcagtgaaaagaaggggacatttctgtccatttttatatagttttgattttactgtgttcaagatttacgtcaacaccaaatatgacccagtgtcatgaagaggtcatcttagtttaagtctaggtgctgctagttgagctactctgattacacattctagcaactaaaacagtaagatgtgagcagttctgagagcttgtaacatttaggacagagctgagcatttaccaggtgaagtccagcaacctgatcttgtgaacatcctcattgcacaggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtaagcaggcgtgtgcaaggagacatgttttagaaatcattgtgattgggccgggtgcagtggctcacgcctgtaatcccagcactttaggaggccgaggcgggtggatcagaaggtcaaggagttcaagaccagcctggccaagatggtgaaactcatctccactcaaaatacaaaaattagccgggcgtggtggtgggtgcctgtaatcccagctacttgggaggctgaggcagagaattgctcgaacccgggaggcggaggttgcagtgagctgagattgcgccactacactccagcctgggtgacagagcgagattctgtctcaaaaaaaaaaatattgttattagctcaggtgatcttcgttgcttatttccttctgtatctggtagattgcagcacctcgtcatcgtgactctgctttcttttgaacttgttaacgtagagatattcggaggtataaagacaagctctct

SEQ ID NO: 133962 - DNA, 1071 bp, Homo sapiens
acagatttacaaagtacattgttcagagttgttatggagtgtgaaactctgagctcacagcagcaggcagcagaccatcacgtttcccaaggatgcaggcagaggagtctgcctcagagacaccaggaaagtgcccaggcagcagggctgggcgagggaccagggatactgtgggacaaatgggattgggccagacccccagataccatttcctcctcccgggagggagaaaggcgtgctgcatgcacagaggccacgggctgcgctgtttgattccagggatgtgttgaggacatgcagttgttacatatcctgtggattaattgaatccagatccccgaaatccagttctctcactctctccctgctccttcttccttcactccttctctaggagccgctgtcactggtgtttttcattttgtttaaaaaagacccaaagcgaggaatgaggcctgaatctaaaataaacaggaaacggaatttttctatgtatataaaacgtacaaacacatactgagtcccacagagttccccacctcagcaaagcccacaagccctcctgccgagggagcacatttggccacgcagaggacgcggcgtgcggagtactacgacctccgggaataagatcacctggcgaggcttgagggtgtgcactcgtcccttgcactttctggcgctgggcattttttgaatccacaggtcataggaggctagtgttagcaaaatttatacagatgttgttttatttttatagctctcctccatttactgggtggcatttccttcagtgttaacaacagaggttaactgcacacagacgtgcatggggattcttgccaggtttctcccccttcccctcctataaatatgtttctccagattgttcattctctgccttggctgcagacggtcttttagcattcagatttaattggttcagccaattcctgggccatctgcagaactgtgtttgttataaacacgccagtgattgcatcctccgataagtgcacattgaaagaaatcaaaggtgttctgatgggattttcgacactttcaacagta

SEQ ID NO: 133963 - DNA, 1047 bp, Homo sapiens
tcgctcaccctgggctccagaagcagctgagctgctgtttgaagttgggggagtttgaatgtgctttttcccctctgtgtggaatttctggttgtattgaagaactcatgacttagcaccccgagtggcacgaaacggttaatgaccctggtgcgtgtctttccgtcgcactcttgccttcttttgtaattgtcatggggcgaaaggaggagagtggtttttcttaagataaaatatgagtatttgtttcatagaaacagataatctccttccccccttttgagcagtggctggcagcagctgcagttcattcatgaaagatccagtgctttcagtcaaagtggatgtgggacacagagggtgtgtttctgatggacgtctaagagccccctgccctgctcagtctcctcagcccaccccgctaggaccagggtccttctggctgcgagttataatgtgttacaatcatttgccatttctaggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccaggtactccagctgctgggcactgagggcgcttccagggctgcggggccgctgccctggtggaggctgcttgacagcgtgtgaccccaccctgtgctctctggagacctaaggcactgggagctggtagaaagaatattgggtgactctaattcacctcctcccaccagctaattgtgtgacctcaggccagccagtgcacctcactttcctcatctgtcaaatgggacaggcgtgttcctaccaccagaacaattgtcagaataaagtgcagccaagagagtgcaggctctttccaatgttagaaatgcagcggcgtgtgattctttcagttctaggactcggtaccttgttggtcttgatggtattcaagcttggaaagatggatttcttgggtagcagtcatttggatgagcagaatttgg

SEQ ID NO: 133964 - DNA, 1088 bp, Homo sapiens
attgtagatcatctctatacgtttcttcctttatagatgtaaatcagctggagttgagtttttttttttaaggtgcatttgaatcatgttttgattgctgtgtgaacagcatacacctagaccaagtgagatccattggtgctaagcaatcagggtcccaggcagccctgggactccatgactgactcttacagggtccgctagagcactcaacacagaatgaccagacactggagccctttgctgcctacacgtttttcaggcctgttgaatggttgatgtggtgtttgaacattttctacaaggaaacaattatccttgagtcagctttccttgctgacatttttgtgtggcttttaaatggtgggagcctcattggtttttaatggaattcccattaaaactatgtcatctcattggtctttatcgacattacaatagtttgtctttgattttttttactcctaaaactatataatggttaatttcaaaactatcccacatgtcacatcttaaaacatacatgcaaataaggcagagtcagataaaaaccatgcctcgagtcatgtacaaatgtgttcatttttatttcacactggattatgcaaacaaaattttgattaacattttacttctagggtcccatagctgaaggaaaatgggcaattggggttattcctttggcctagaactttacattagaaaataattattgacacaaaatattcataagaggagaacttctagctaagatattaaggtttgctgtaaaataagtaaaaagtcacaattttctagagtgtgcatgcattggaatatgaagcactggctaaagggcagtggaaacccaaccttatcccttgttttgtatccagggtcgtaccttgtacatgtgcttaggccagccccttgttacttgagctttttggtgattagtcagaaaatactgtagtaatggggaaagaacttaactgttccagaaagtcgatgactgtttcgtattcatctttgaacccccagtagagtgaatggcacctaagtgaccagcagtgtggattctgagttgaatcgagtttccagcaaggctg

SEQ ID NO: 133965 - DNA, 1097 bp, Homo sapiens
ggccgaggtgggtggatcacctgaggtcaggagttcaagaccagcctggccaacatggtgaaaccctgtctctactaaaaatacaaaaaaaaatagccaggcgtggtggtgcacacctgtaatcccagctacttgggaggctgaggcacgagaattgcttgaacctgggaggtggaggttacagtgagccgagatggcaccactgcactccagccttggcaacacaagactgtctcaaaaaattatatataaaacaaaacaaaataaaaatgcgattactatgattttatcctttttcctatgggagaacaacccctacaagataaatcagtttaagtgtggtggtgaaaacaaggtattaactagacagcttctctttgtccaggaagagtcagtggtgctccctggggtctgaccttgtgcctcttctgttccaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggtaagacggcgtgggaggctctcgtcctttcggtcttttgcgtgttcagcttcaacaggttcctttgtcatgattatgagagcgttagattagaatgtaacactgacgtgtttcatggacttttaagagttgctcaagattcttacatgaactgtttctgcagcagcctcccagatctggcttttacctataaaatgatgcagataattcagatgagcttctgtgagaatgtacaagtgcacgtcaggaaaaggggagcatgttgtaacaggtggagccgaggcttctggtgctctttcctcttggatagacggtggctagtttggtgaccacataaaatcaaagtgcgg

SEQ ID NO: 133966 - DNA, 1042 bp, Homo sapiens
ctttgatggtggtttggttttgtttggaattgtgctttgaaggattcatcatcatggaacttgcttttgaaagccaaatttaggatcagtcctccatgtggcctcctcagactgacttttatctagttcaccaggcgatgaaccaggtgatgttatcaaccaggcgatgtttctggaattcagcaatgtgatgtttctctcctaagtcagagctgtgtaaaatgggtattctccgtacacagtgaaaaatggcagaatgaaagcaccatttccctgtttcagcataacattgcaacatgtttcccctcctttcagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtaatctgccacaacttaaggctcttcctgtcttcaaaaaaataacagaacctttggagttcatcagattgcttctacttttcttctttttccttaaaaaaaaaaaaatttcgtttaagtatgatacatttcagtcctccaaaagtcaatgcttttagagcatagggccattttaatgaggtcatcttccatgggagtgaacctctatgcagcaagtctttttatgaatgaggttgtttaaaaatgtgattattgccacttgcggtggctcatgcctgttaacccagcgctttgggaggctgaggtaggaggattgtttgagcc

SEQ ID NO: 133967 - DNA, 1062 bp, Homo sapiens
gtgcctgaagcgcacaggagccagcgtggccctcacgtccatcagcaatgtcacagccttcttcatggccgcgttaatcccaattcccgctctgcgggcgttctccctccaggtgagcttctggtgatgaaggctgtggtgatcctgaacggggcactgacttccagcatcccatgtctgcggtctctgctaaggcacttcagttacttatgaagtgaaatagaaatgcctgtgtttgaggctctgtttaactgggtggatgctgctttaagcttataaccctgacactccctctaaaaaactaagcccttctggagtttttccttcctttctagccctatgaagcccagacgtctgttgccttatagagtggccatgtcctttatgcatggctttcggggctactccatgttgccctctggggtcaccagcgctgcagccagcttctgggccatcccctgcttccaaacaccactcccagtacctgcacttaccccctctcccgctgcccacttgatcccaaacaggctaccttttctttcgcttttgccaaagcacccccaacccaagacagtattaagctgaggtcgcatgtcagacggcactgcaggaccgcgaactggcgaggctctgtggagaatttcctgcagggtccgcctcggtgggccctttctttccacctccctttcctaagttggccgccacaatctttcctgtcccctcttctctttccttttggtcccctgctcccctctcaggctgcccaagcagactcatgatccctctcaccttcccatgcagagcacgtgggcccctcgtgacttgtcctctccttccagaccaggccccgtcacccccagaggccgtcagggtattttctaatccagactcagcttctgtgaattgtaagcatggacagttccctgggatggggatagagctgtagtccgttctgcgcctggagtaaattactgacgttgcccttgagctacctgaaattcataggaatcctaaaattagttactgcagccagtaaagcagagacttcaccagtttgtgcca

SEQ ID NO: 133968 - DNA, 1051 bp, Homo sapiens
gagacacttggctgataggaatgtatgtcattgaccagggttgtggctcttcagctctggtgggcatttgcatggcttgcagggcttgtgaaagctccgattgccaggccccacccccagagtttctcagtaagtctggggccggggctgagaatgtgcacttcagggcaattcccagtgatgctggtccatgggccacactctgccaatcattgcttaaatgagttggattccttctcatttactagcttaaaaaatgatagtacactgactttcgaagtagaaacgtgcaggatctcctgtgagctgaaatggctaggctttgggacgtcaagtgaattcttcaccatgaggttacggaagccctgcttcaggagctgttaggtgctggtggcagagtcctaactagctttagaatcatctgaattgcatctcgcatgtctaatgccaccatcctctgtttttgctgtaggttttgccatttctcgctcttggtgttggtgtggatgatgtttttcttctggcccacgccttcagtgaaacaggacagaataaaagaatcccttttgaggtaatgcaaaaacaaaagaagagagctttggggacatcacagcttcctctgttcctaagtatttgtcctttaattttcctcagtctgacccagtaaagatttcagtcccatgtcagatgatgtgtcactggctgccagtcaatgaaataagctggaagactctcaggacatgtatttgctatgagaagtcccaagagctgcatctcgggtgcctttaggaatacgggtgtttgttttaatgtgacactttatccctaactgccatacattcccagagcctgcatttgcttctctggagatgtctgtcacttagccatcacctccctccactcccttttaaaattatacttaagcgttaagtcattatcttgcagctttcttctctggatggtaataaccatgaagaattgatgactctgtagatggtactgaataatgctggtgttagggggtaaggcaggtggctctgtttccctaatg

SEQ ID NO: 133969 - DNA, 1805 bp, Homo sapiens
tggactctggtcagtcaggtgtctggcgtttcgtgtaagatttctcccttgggaacgccaccgtctgggatttctgcacagcaagtatgcgtcactgagcccggtgtatctgttcaagctatctgctcctctccccttcctgtttcatggaatggaaactgtgaaaggaaattgcctattaatttaattttggggtatatctgtaaaaggtttgtaaggttatacctttaatatggtacatcaatctattaaataaaataaccatcctggtcccattttaatggaaacatgtgctcacagagaaggaaaagaattgcagccagtgagttgggggagctggctggggatttgaggcagtggaaactgcttcctgggaatactgatgatgtgccttcccttggactgtgctgcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtaaacccaccttcgaatcggcgtgcagactcgctggttatgcaattcttcattttcaccattatttaaaacatttctttccattcgctttattttcaaaacattgcaattctgggaacttgatgggatgaaaacttttttcctcttctttgatattgaaaatcctgggataatatctaaaagactagttctaattggggtgccctgagacatgtttagtaaccagttgtgaattccagaactaaagcacataacagtgtttaaaaaaacacttggttagcaaaggtgtctggaaaacattagcaaggcatagaatctgttcacagctgcaggccccttggtcaggtcatgtgacaggagctggcctttgtttcccaagcagtgacctctactgagctgcatgtgaccttttaaaagtggccagcaaatgaacagggggaggagggccataagaatgagttgttttggattagtggggagccgatgggaccgcaagtcaattgtgaagttaacggagaagagacgagcagtctcagccctggagtaaatacagcactcagagtgaactccagcgacaccagccctcagcagcacccactgccactgattagccatggcccttgtcctaaaacagggttctttaatgttagcccaacttcagcttctctccctgccctggaatcacgtagaacttttttaaaaaatgcatcagaaaaaaagaagggctgcgctgtgtcacctgagatctgtgctgtcgaggcttgtggaagtgttcattgcatttgggcatttcgcattctgttgtgaccacaggtggttcatcagagtgtcgcacagaactccactcaaaaggtgctttccttcaccaccacgaccctggacgacatcctgaaatccttctctgacgtcagtgtcatccgcgtggccagcggctacttactcatggtaacgctcgatgccatgctcctgggggctggagtttggtttggttgttttagtctttacttttccatgactgctcctgcttcttaactgctcttaacatcgatgtgcatccaggacagagagagcgtggcttcacagtggtttaaaagtggtcgtgtaaagcatttttcccatttgccgtttgcctacctttgactcctgtcattttatgtgacgcccttgatgtaaagttttgttgttgttggataagttctgccttttgatttggggtgatgggtggagggaaacattagaatcac

SEQ ID NO: 133970 - DNA, 1039 bp, Homo sapiens
catttgttttgatgccagagtcccagaactgcagcattgccaggaacctcctacaaggtggatgcagtgggcgcagccgtgttactttacgatgcgtttagaaggctcttttcatggtctcgtctcctaatttcttttgcagaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaagtgagtaccagcagtgagcgctctcagaagggtggagagcaaaacacttttttgtgtccattcatcgttcactttattattttcatttttaacatttcattctccatgatcgtctttgtctatggaactaagtttatttatagagctaaattttgctgtaagatttgccatacacctcccattagccttgctattaatgttctctctgaaacacacaagcccttaatgcactggattttaacaaggcatgtgacctgcctactaattcccataattatgtggctgtctttttattttagcctcttgatatggcccttgttttgaatggtggatgtcatggcttatccagaaagtatatgcactggcaggaggagttgattgtgggtggcacagtcaagaacagcactggaaaactcgtcaggtaagccagctcccgaggacaatctatgccctgtagtcttcttcctttcctcaaaagccacttccctcctgacatcggcaagtgtatttgtattaatacttaaaccgttatcctcgctagccaggtggcgtcatagaatattaagaaatagtagcagactgcaacagcttgaaaaagcaccttgtggggaatttttcaagaatggatttgtagttttcatcaggaccatagttcctgactatagggtttaaggagatctgcccattaggtagagaat

SEQ ID NO: 133971 - DNA, 1033 bp, Homo sapiens
atgttgttgtttataatattaatggttaagagcaggagagttcattttgaatactacctattaaggacatgatctgccagtaaaacatctccgcacctgagtatgtgtcaatactttgcaaacctaatttaatccccgcctattttgaatttatgataattcagctgggctgccctgaagttgtttaatgtatgtagaaaagcagattaatggtgtaaacaagattattgggagaacacttaagaaaacaagacttttcaagtactttggtagcattcatttacataaacaccctacatgttaattacgattgagtattatctattcattaaagcaagcttgctgggtctctacttggcaaaagctctgctcgttttgacagatgcttaaaagtgatcgaaattgcagttctttttatatgttctatcatttcgaatttgcactaattttcttattacagtgagaaatttttgtctctgcttttcattttattaggcagtggaaattggaacatttgtgttacaaatcaggagagcttatcacagaaacaggttacatggatcaggtatattttcttcttgttggcaaaaatttctcaggaacaccccagtagtgtgccttaacctaacgcatggcctcttctttttaactttgacagataatagaatatctttacccttgtttgattattacacctttggactgcttctgggaaggggcgaaattacagtctgggacagcatacctcctgtaagtgtgtgatcatgctttctgatgtctgtgacttctctaggactcagtgtttctaatgttgcttatcattgtttgttccatttcagttttgaacaagaaataaaaacattgaaattccatgtgcattttttgagtgaatagtcgggggagaggggatttcagcagaatgttttttctcttttcaaaaaacaattctgtaggcgtcattaaatttcattcacttttaccaacctatttatatgcaaataaaatgcaaattattgcagagtacgtgtgattt

SEQ ID NO: 133972 - DNA, 1638 bp, Homo sapiens
tagactgttggttactacagggcaggggccacctcttgtctgttttcaccccagcattgagaacagagtgggcattcagtttgttgattgcttttgaggttggcatcactaaaccccatttccaggggacctctgagttgatgtcacccaaccccatcacctcccctaggctttcagcacctcttcactgaggcctttgttagtactgtttatttttcctggaagaggtgaggaagtagcagtataggcatattcagcagccagggagaaccaaagaagagaataaaattaagatttttcttgtcccttctctaacctctgcttacattccagctcgacaggatcctagggacaagcacagccagggtcgagtcacatgtctttggcacattcttgtttgtttatctgtaacctgggcttatggtcatgtgtgctcgtatccttcatggttcccagaacaagaccagatacatgaatgcaagggccttagaaaatgtaaaatcatgtttctgccaggcaaacttgccctgttggtctgtaacaagtattgtagggaagcaactacctggtacagttttgcagaatgtgaagtggcatccctgtggggagccaggttgtcctggggccactgcaagcatggccaatgcattcttagtgtttgtcacctacatgcttcaggagaagatgtgagggtctgtgccattaaattacactcttaagctgagatgggtccagagtaattttatgcattggaatgaactttaagaacatgtagttcaacccatcccatgttttaggtgagaaaactgggaattagactaattagagcatttgtccaagttcatgcagttatgaaatgagagagccaggtttcaaagcctttttctggcttcaagcccattcatttttctaatgcacaatgatgtccttctcaagtgtaaatgagagttgatcaagtaatataaagtgagaacctactcatgccggatagtctatgttgatgctgtatagaattaaaatataaatatgtccatggatgtgtggctaggtggaggatggcggagatatgggtaagttaggcacagctctcaaagagaggaaagacatcagtatagatagacatggacaaaggaaacgtgggcggtccccatgacagctgcgccaggtttcagcaggagatctgcccagccagggctctagagttcaggagaagggggtcattttcaacaagcttaacatgggggtgacatttcaacagggcgctgagagacaggaaggcacagggaagaggacacagtaagctccttgggtgaagacaggcctcccttaggaggccaagaatagagcagttgggagggaagtttttactgtgtttctttcttttttttttttttttttccttcccttggacttttccatccccactcttccagattttcttttttttttcgttagactgatctccctaacacacctggaaagatatgggcttatataacacttttctagagacaataaaactcccgattaattcttttttttttgagagatagggtcttgcttatctaggctggagtgcagtggagcaatcacagcttactgcagcctcgaactcctgggctcaagtgatcctccacc

SEQ ID NO: 133973 - DNA, 1022 bp, Homo sapiens
caggtagtcagataacagataaaacatgagtttgcagtgattttgctattctaattaaacctgtacatatttgtcagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggtaaggcccgccgcgtccacctactaatgagcagcaggtaaggcggtgggagaaggctgctggtttaggccccgttattttagtaaatgaagttgccctggaaatgcacctggagtattagttcaaatagctttgcaatgaaaggatttttttcatcttgatttatcgtttctcgagtttggtaacaaagcaagtgcattacttgataatgtattgccagtaagtatcttggcactgtccccaaaagaggatgacgctgagccacttggggactatacacccaggctgtaagatgtttcattgcttaagagatttttggagagtgatattttgaattgcccttgctgaacttaaaaacaatgcgaaaaagaagagctgcttcttgtgactttgtactcttagttgttttgtgtcacacagcacgttgggggctgagccaccatgggaattgttgctgacacctttttatttatttttttgagacagagcctcactctgttgcccaggctggagtgcagtgatgtaatctcggctcactgcaacctctgcctcccgggtttaagcgattctcatgcctcagcttcccaaggagctggggctagaggcgcccaccaccacacctggctaatttttgtattttcagtagagatggggtttcaccattttggccaggctagtctcgaactcctgacctcaagtgatccgcctgcctcagcctcccaaagtgctggggttacaagcgtgagccaccatgc

SEQ ID NO: 133974 - DNA, 1020 bp, Homo sapiens
tgatatattcctccctccttcccgaccccacacgcagtatgttaaacctcacctcacggagctcctggccttggcatccgcgtggacctgcacagagggtcctgccaggcggtgaatttgtactggttttcctaatgagggcattatttgctttttagcctgcccccttgtttataaaatatgccaagagaactaaacaacccgctgttcccagtccttatttacttgtccaaaccaaatgtttatgtccttgaatactaaacttgaagaaaaaggattcctcctcgtgggaaagctatgatcactgagtttttttctaaactgtcgctgcaggcctgcttttcagtcaacatgcaacttatcaatgactttaggaacaattcagacccgcttcctttgccctagactgtggagtgggggagctctaggttcctgggtctgtaactattagtatctccctgagacacctcccagcccaggtgcagcattcggagcttggcttggcccagaaccgttcattgaacataaccttgggcctaaggatgtaaaaaggagaggaagagaaaaggcatttggcagtcacagtgttgatggttttctttggtcacctgctcctgcgctggctttgggcataccccgtgctggccagcttgctggaaagctgggttggtgtgaggcaggacttctcggcctgggcagcaggttcagggtcacctggggtgcttccggaaaacaggctgctcacccccagctgactgagaacctggcacctgtgttttctggatgctgaccaggtgcgtctgatggaaccaggttccagggactgcccatgatggctgtggctgatacagtttgttcctctcaattgggatttccccatgggcatctgacttgaatcactttatttatcttctcctggcaagttttgtgctgaacacacactggccacctttccttgtttctttttccacagaggagaaacatttccttgttacctttgccagtttacttaggagaaga

SEQ ID NO: 133975 - DNA, 1021 bp, Homo sapiens
ctctcactgggctcacttcatgaaggcacattctctttgggctgattgtagcgtttttcccatggcaacacgcaggggcacaatctcataaggaaaaaaacggcccagaaacttggacagcggttggctcctcctgaataaaagagatgggtgggagaggactaaaattcacagcccgtgaattttcagccaattgctcacattactgaattttcttttttttttgtttttcgattataaaaaagaggcagtgctaataattttgcagttacacccgcttagagatttgtactttttcggcctcacagtaagtaaatgcaacattgaaaggaggacctgagcaactaaaagaaaaagaaaatctctctagaggctgttagataattcatgggattaatcaaatgcaaatgcaacgcttgcatatacacagaccctattttcctaattggactctgagtgggtacttttcaggctgaaagggtcatttgttttgactgattgactttttgaggctttggggggaattaataacttatacagatgactgcctgttcccaaggctctgtattgagactgcgcattcatttattcattcagcacacttggtgtgccatgcccctggtgcccctctgcgtccctcacatacggaggtgcatgggcaggacttgaattttgtggaaaataacttcggttggtccctcagatcatctttatgtggatcacaataagcttttgctaaaaggtttttgtgtgaatgacacagaagtttcttaagctctgtgcagaaggctgtgctgaggaggggcacagcagggaagcgtgatgagggaaacatctcttgtctacagtggattggaatcatattggcctagaagtatgggcctctgggtcagctggcatcccacctgagctagctagcctttcttcactttggaaagttaagcctggcttgatttggggatgagaggatcagcagagcttgatcaaaaacttatttgcagaagtgatgcttcttttgcct

SEQ ID NO: 133976 - DNA, 1059 bp, Homo sapiens
ttgttgaaatacctgcgccaatattctcctgattaagaaatttattctacagagtgatctgagaaaacggctttaagaaatagtgatgataaaaacaggaattttgagatgaaggaaaatgtaggcttcttgactccctctttctcctcccaccgctgttttttttccttttgtgaattcttccacattcccacccccactccctgatttcctctgctcctttactgggaaaccagcaaccttcacaaaatagactcaaacatcacacagcctctttttaaatagaggctttctaagagaaaataacaaaagaatttttcctagctgcctaagaaattctttcttcttactttattttcctcatgagatttacacattgttgtaataagtaaaaaatgataaatatgataccatcattttggtctacacatgatccagaaaaaaaaattgcacatgtttaataccttgcttaattgcaaacaaagcttgcaatttgagagaattgggattagggctaaatatctattaactgctctttctagagatttggggactaggatgacccttttttttttcttttttttttttaataggctacagtttcacatggctcccaaaagaaatctctctccctttttgtttcccacaccaattgatttatcattttgcttgcaagcagatccagaatgttagggcaagaacacactcacttttttctcgtaacttttttgttgcggaccgaaaccagttgacttgaataaatttttctgaggcctgaatgtagccagcaacgtggaaaaatcttgccattcagggccgtctgaatgtacatttcagccacacagtaagctgcattgggaggcgctggactgctaaatgcaaccatttttcgcagcagcgagttagacaggtgattagcataattagcaccgagcagctatacatatggtaatgctgagtgtgtaaatgccagctgcggtgtaaaatttatgtcaggggtcggcagggctgtgcgaaagtattgtgttccagctgcaggtcagggccgccaaagcttac

SEQ ID NO: 133977 - DNA, 1047 bp, Homo sapiens
gtgacaaaggtttcaatttttttcccccgctggtttcttatttatctttttggcaagttccaaatcctgctatttggaaacactttaaccctaaacaccactttgggcatcccttaccttacaagagggtagtaggggagggtagaggtgactaggtagataattcaaaccaaaatacctggagcattcctccggacagcatgtggaagctgaagagttatgcgcataatcgcttcagtgatccctttcaggatgctgttggagaccttgaagaatatttccttaatctctccttgtttgtgaagattcagcttgcagagttttgcaagcctggggtggagttggagtatttagttgagaagtgacaattaaaataatagtctacataattaagacaaaacattcctgccttaagtagtttggtaattaatacaaaagcgttctttggattgaatccatggagtaatttacctcagttcagcgattcagtatcactggtagataaaagaagggttttatcgagcagctattatgctcctagcaacaagtttcttgagcacctatgatgtccctagcactgtgttaagcaccataagagactcaagtgtgtgcgacactgcacaatttaaaactattagaattcgatgcatttggactacatttgggttcacagctgaaatgggctgtgaaagttacaagagggtggtagggggtggggggagagaactggagacggtaggggaaggagggcattttaggcatgggcgggacaccagcaggggccccagctgaggagtttggaagtgatgtgattggctagactgtaggggcgctgccgtagattctaggacagaatagggcatgaggacagggagggccgctgccgtagattcttggacagaatagggcatgagcacagggagggccggctcatccaccacttgatccaacctgtatttgttgccatcggatgaggatgacaaaacgtgattttgtggtgttcttagcaagagttttcagtggacctttgacatgttgaaggagata

SEQ ID NO: 133978 - DNA, 1930 bp, Homo sapiens
ggctgtctgaggtccgcagggggtggaggtgtgtgtgtgtgcgtgtgtgtgtgtgtatacacacgccctccctggtgtgccttttccggagcactggaaagccgtccacggcggaccacctcaagggcggccgcggcactgtcctgccccgtgccccctgccctgaacttcttcctcctgcgcccctgcccctatttgcagcctaaactcctgtacggctgccacatttcttaacatcttggagggggaggcggagtggagagaggcggagagaggaaggggggagggagccgaaataaaggtggtttccttttttggcagccagttttggttttgttgagcatgaaatctctgctcccttaaaaaattattctcggaaaaagatatcccccccgttttccaggttttgagccgcctctccttagggcctggtcgggggaggaaaagttgtaaacaaattgccaccttaaattcgcggtgcgagtctgcggagctgccgggttcattgtgtttacgaggctcgctgaaatgtgtggaatccagggaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgtaagttgcagctggctgccccacttcctaattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggtgaatattgtctgtgtcgagtggtttctctcctctctacctcggcttcctcttctgtattgcagccccagtgccccaagtcgctcagggatcccgcgggtgggggcgccctgatgtccccgaggtgcagctcccacgctgcggcccggctttatgaccgagccccccatgacgctcagatccgccggggctgcagtctcgagggcgagtccgtgtgccgcggccacccgcgcccccacggctgttgggggctcaccgggcgggtgcgcgcaagcgggcgtgggcgcgcgggccgcgactccccggcgctcactcctcccttctgcttcgtccccaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaaggtaagagcgcccgccgcggcgcccgcgcccccggcccggtccctcctcgcggttgatagagatattcgccagcgcacacctagagcctggctgcggccggcgaaaccccctgcccgcacccgggggattgtttattgtttgggcgcctggccgggagccaggcccgcccgacaaaggccgcgctgtaatctactcggggcgctgcgccggccgaggtgtggtgggagagagcggcgggggcgggacgggggcgcggggcccctccgggacggaccactctgcgcgccgggggccccgggcccgccgccgctgccgctgtccgcctgggccgcgccccgagaggcgccccggggctggcctctcccggccccgctc

SEQ ID NO: 133979 - DNA, 1122 bp, Homo sapiens
ataaaagcattcatgagaagtatgagcagaagttttcattattccttaagcccttgattcagagagacaaaaaattccaccctccactgcagccccacaatgccaagttgccaagcaacggatcttttatggtgaatcgccacggagactgatgtaaacaaaatcataaatcccattaccctgctaaatactaggtctgggttagaaagggagcaaaagagctgcttttcaggttaaaagagatcatatgaaacggtgagtggcaagatcttagtcagagtaaattgtcatgggtgagactgtaattaatgtcgcgcttttattctttcaatggccaacagcccccagttttcttgtatcaaggaaagcagtcatcgttggaagagtcatttccagctaaaaacttacctccagtaccccccaggcccaggcccgccatggaaggagcagttccttgtggttcttccctgcacttcccaactggactttggccagggcccacccagagccagggtatggtcattcagaaaacagctccaagaaggagaccctcgggaacaacattttgtactttattccccctttcagacaaagggaaagaaaagggacattcatggagcccgtctctatggcagactgtggcagatgacccagttgtggtacctcatttcattctcgcacagttccaggagctccaggctaccattcccatcaaacagacagaaagctggaggcctgaggatgaagacatcttttctaaggtcacacagttaactagcagaaaaagggagattccaccttcaaagttgaattacagactcaacgtggcccccactgagttggacctcaggccttctgcgggtaaaagcctctgcctcaaagtgagcaacaaatcccacgttgggacattgacccctgcagagggaacagctcacgttgtggctcccgtaataatgacacagggcctcttcagtggtgtgccaggagtgtttaacaaccagctctctggagcgaggggatgagttctggtttctgtgatgcgaatatttctccctggccaatttcaagctatcagcaagagaacattggccctcctgagctgcacaagtcagctccaacaca

SEQ ID NO: 133980 - DNA, 1051 bp, Homo sapiens
tggttgtctgaaaatctttacccttcattcttgaatatcatccgtaggtataaaaatataggttgcttttattatcactttgaaaatattctgttgtatagtatcttccattctttttcctgcaaggtcagctacttgtctatttgtttttttgtttgtttgtttgtttgttttttgattttttttttttgattttttttttttattttgagacagggtcttgctgtgtggcccaggctggagtgcagtggtgcagtcacggcccactgcagcctcattctcctaggctcaagcagtcctcctacttcagctttccaggtagctagtgatacaggcatgagccaccctgtgcccagctaatttttctaatttttgtagagatggggttttgccatgttgcccacgctggtctcaaattcctgggctaaaatgatcctcccgtcttagcctcccaaagtgctgggattacatgggtgagccactgtggccagaccagttgttgcttttttgtaggtgatctgttgttatttcttctggctgcttttaacaaacattttgctgtctcaagcacctgcttgtggttttttgtttgtttttggttttcattttgttttggttttggttctggttcttggaagaagatcttgaatctgtggcttgatttttaaaatcagttaagttttcagcttttatttcttcagatacttctgtatcatttcttttcttctatcatttgggattcagattataggtatccacacccttgttaagtatacttttttctataatttttctaattctcacatagttttttgttttatatagtttttcttcttatttatttttgtaaggtaatgatcagttattttcttccatatggatacctcatatacctttcttcccaatctttaaaacaaccttgccaaaattattttttgccatttttacagatattattcagagaggttaacgcccttgcctaacttcacagagcagccaagcaatcagagctaacatttgaatcaaagtcaaatcaatttagtatttcttg

SEQ ID NO: 133981 - DNA, 1376 bp, Homo sapiens
agaacacgtggcctgcttgtgtatgtacattacccacttggcctttgaagctattactgggatccagattttattcttttctctcttttggaaagttacttctctctcatttctcagtgcctttttggtagggggaaataaaaaacacgtgtttctttgagcaaggttaggtgtctgtcttgtcctgataaaaagctaattaaacagcaaattattttttgagaatcttcaatgtccagatatagctaatcactcagttgtatttattgttactaactagatgtcaaaattaaggaagaggactattgatattgatattgtggatttcactttgggattctttttcagtttttaaaaaacagcaaaatttttttattcttgttttagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacaggtaatgggaataataggaataggaatgattgtattaatagtctacttacatccctttatattaagagtttttttttttttttttttgagacagagtcttgcttttgtgtttttagtaaagacggagtttcgccacgttgcccaggctggtctcgaactcctgagctcaggcaatccacccacctcagccttccaaagtgctaggattataggtgtgagccaccgtgccaagcctatattgtgattttttaaaaaggaataatgatgattcctttgcttgatttaatttcattttagaattattgaaatatttagttcataataacttactctctgagaaggaaaaacctgcatcaggttttctagaacttcttattctatttcttacattgaatacaggatacttcttcaaacactgattgttaaagaatgataagacttgtcctaaatctcatgtacagccttttatgcagacactgcctctgaactaggtcagtaattttcatgaattatttcaattatgggagtctgttgtgaatatagaggggcaaaaactacacacacacacacacacacacacacacacccccacacccacacacccactgtagcatagagtgtgagggagaagtggccaagaggtaacaccagtgagataagcagggaaaagattatagagagtattggaaggtactttgaggattttgatctttatcctgagagcaatagagtgccccctacagtgttgtcagcagattaccgataggataaaaatgatcagatttgcactttgtaa

SEQ ID NO: 133982 - DNA, 1111 bp, Homo sapiens
ttgcattgtattccatttcatcaatattcacattttgttacccattcatttgaggatggatttttgggtttttccagttttggattattatagataaaacttcaaggcatatttgtatgtaagccttttttggacatatgttttcatttctcttggagtagaattactgtattatatggttaactgtaggtttagctttagaagaaactcccaaaccattttccacagtggttttactccagctagcaatgtgtgagagttcagttgcttcgtattctcagcaacgtttggtattgtcagtctttttgttttagctgttttagtagatgtgtagtagtatcttgtagtgtaatttgcatttttctgatccatgtgcacttggaaaacaatgttctatagttattggatgtagtgtttataaatatcaataagactagattggccaagatgttgcttaggtgttttctatctttgctgatttccttttcgattggcttacagtatctgagagaggagagttgaaatcttcagttgtaattgtagatatgtttatttctcctttcacctctgtcagcatttaatttagtattttgaagctcttttatgaggtgcacatgcatttatgattgttattttttcctgatgaattgatccttttatctttaaaaaatatacctatttatttctaataatatctcttatcttgatgttttatctgatatgagcatagccatattgtggtacatttcagtagtttgttcctttttattgccgatggtactattatatagctatcccatattttgtccattcaccagttgatggacatttgaattgtttccagtttttgactgtatgactaatgctgctgtcttatgctgagtcttatgcttactgcatgtaaatagcttttcctgtttttattgcagtatatctgttcttaatatttggagtgagtctccaaatattgctttttcatccattcggataatctttgcctcttatttgggtatttagaccattcactttgaatataattattggtaaaattggatatggagctaccacttttgtcaggtctgggatttaattttataaatcaaacttacaa

SEQ ID NO: 133983 - DNA, 1040 bp, Homo sapiens
aaactgcagttcactgtccgccaattacctttacctcaactcttactgatcttcatagtctttacttccttattgctaaagaacatgtttatgctgcaacttttcaatttttctttagttttcagcatcatctattgatttctttttaaggaaaattaggatttttgcccttctcttgcccgctttaggatgacctggcccatctactttgtgcagtgggaggattcttaaacagactattgaacatttacatgactccaatttccagaggcatctggagccaccaattcttaacttttcaagaatgtgtaaataatatgaattagattgcttcttggctttttccactattggcataggacactagtctctgcttttgtcagccatcttgtccatgttctttttagcttctagaatttttgctatttttctcctgtctttgttcttgaggcttctagcttttttcagctttatattaagaaaatgatgaaacctatagaaaagttaaaataacagtacatgagcatctagattccaacagttttgtgtgtgtgtgtgtatgtatgtatatacattcaaatgttggcaaaatgtaagttaatgtatgtaaatgtgtgtgtctatgtctatgtctttgtgtacggtggtggtaatgagtcatttcagcaagttgcataaaacatgacatccttatccctaagtattttagcatggatttcctaaaactagtgatacttcttgtcataccacattatcattgtcacacacaagaatattaatagcaattaaaatttcctcagttattctcaaaacatctttaatatcttatgtttataaagcaggattcaataaaggttcaggtgatgaatttggttgtctgtttattcttctaatctacatcatttttccaacttgtattttttaattatatgactttttgagaggaccaggccagtcagttgttttaggatatctcacatattagatttgtctgattactttctcaagatatattcatctgtcatctgtattttagtaaa

SEQ ID NO: 133984 - DNA, 1020 bp, Homo sapiens
gagaaaccctaagtgaatatttatctagtttgatatttatttggtctcatttattttgctgtttttaactacttcccttttttgtaatagcccagtttcctaggagccttggagcataaatgagaaggggtctgcatagcactgccactgcacttagattttgttaccaggcacctcgtaacagcaacatttccatcactgtgtgtcatgaggataaatactttctgtaataaggattttctccctttatgaaaaatatagttgtattatgatttaccaaaagtatgcttccacattagctatttgtggatattttgtgcaatagttgaccatcattttcttggaatttattgtgccaaagtaacccgataataaatgttattgtaagtgatacattttatgatgtaagcaggtgcatagctatgctggtcctttttattttctatatttttctggttacagaccaattctcatggtgaaacagtgaaaaccttgtatctcagttaccttacagtccttcagaaggtagctaaccatgtcgcgctactgcaagctgctagtacttccaaacaacaggtttggttagcattttacatttctttgtgatgctattgttgtgaatattttataaagttttaaaatagttattaaataaagtttttgtggatgaaatttaagaggaaactgatttgcttatttttaaatgtagatatcaaggagtatgtgcacttaagtttttaatcaaagtgaacaaatttaagcttaatttaaaataagaactatcttttatgcctttaataatgttcatatctttatttttcaaaacagtctttggtataattactaaataacatatttgatgggtcagttctattcctctaataatgtctgtaatggtatttaatctactgggtaaaatgaggatttataataatttgtatattaaatattagggctgtttaccaaactggcaaaaatcagtaatttcaaagtttactttggttgtttccttttattcta

SEQ ID NO: 133985 - DNA, 1047 bp, Homo sapiens
taagatctccagtctaaaaacatttacttttcctgtgacttgtttttgtttttactgtaaaatacttgaaaacacttaaagttgcaatagttatgataccaccccaaataatgagaatggatttctatacaatatatccttggtttaaaatgttaatatcttaagaatgaaaaacaaaccacagactgggagaaaatattagcaaaacaataaaggactggtttacaaatatacaggtaactcttaaagctcaacaatgggaaagcaaacaatccaattgaaaaatgggcaaaggatctgaacaggtacttccccaaagaagataatagagatggcaaataagcatgtgaaaagatgctcaacaacatatgtcattaaagaattgcaaattaaaacagcaaggagataccactagatacctattagaacggccaaaatccagaacactgtcaagcccaaatgttggtgaggatgtggagtaacaagaacccccatctgctgctggtgggaatgcaaaatggtatagtcactttggaagacagttcagtggtttctcacaaagctcttaactaaaaaatattaccttaaatagtcttactatatgatcccgcaattgtgccccttggtatttacccaaatgagttataatgaattaaattttattgagttttaatgagttagaaacttacatcccgacaagaacctatgagtttatttataattgccaaagcttggaaacaactaagatgtccttcagtaggtaaatggattaaaaaagctgtggtacagccatactgtggagtactatttagcaataaaaagaaatgagctatcaagctaccaaaagacatggaagaaccttagatgcatattgctgagtgaaggaaaccagtctgaaaaggctacatactgtataattccaactatataatactatcaaaaggcaaaactatggagacagtaaaaagaacagtggttgctatgggttctgggggaggaaagaatgagtaggtgaagcacaaggaatttttagggcaatgaaacaat

SEQ ID NO: 133986 - DNA, 1375 bp, Homo sapiens
agaaagtgtggaggaggttggaagtagggaaagaggagttttgtgcattttctactcagttctgtaaaacagaaaaaataatatctaccaatttaaaaagtcttatgtgaaattcaaattacatacttcatatagaatcagttattttattaaaaaatgaactaaatgcaaataaaacttcatatgttctccaaatgtgaaagtaatgtttacccgatccataacatttttatttaccatttgataaataaatttggttatctgagtagaagttttttttaactccatagctttttttgagggactagggggaggtagaggtcaaagttagcacaatagcttctcttgattgagtaagtgttatattgagtattttttttatttaaaagcttaaatgtttatcattaaataaattgttttagtgtttgtttcatctttcagaagaatttagactttgtatagaaaatttctttttcccctctgtggattgcttttccacattgttctggagctgtcattgccagatgtggaaataaaagtaacagtgtgactgttatacacaaggctttggactgtttgtttcctccctgaaagcactgtgtgtgggggcagattactggcattttgaggtcaaaatcaaatctggaagtcagagcttactgtaaatagagaaacaaaggggagaaaatgagaagaggtgtgtatctgactgattattctaagaaaataaatatcaagacttttagaacctagatgtaattgaacacatttcattacatccatctagggacaatttaaatacttcctaaaaggaatgctgctctataatttagtttcttagcatattgtaggtataaagaaagtgtattttggaaattaaattaatccatttaaatgcatcccataatccaaaatgcttcctttttattaaaaccagatgagatgaaataaaagtctttgggaactttacctccttattgacaatatgatgatgaataacatttgatgtaatagctaatactttatttctctaacttggaaaaaatgaaaggaattagaaaaaatgaatgaggttagtattgtatgaaaataattttaaagaaattctcaagtgatgtttatatgtataaagtgtacttttagttggaactggttcactgattttctgtggttcattttcaggtccttcagcagcttttaaatcattgcaggaaaaacagagataaagttcttctcttttctttttccaccaaggtgagttcatctaaagtatatccttgattggccagcctcaacttttgaggcataaagaataaagcatatgcctacatgacaccttacagccacattttctcttatctacacagtaggaaat

SEQ ID NO: 133987 - DNA, 1200 bp, Homo sapiens
cttaacaagtctcaactttgtaatggtctgaaacttacttaaccaagattcatgtttgcccatcttcatacctctcgtctagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatgtaagaaaattaaatttaataactagatttttatccaattgtttttgagatttagcataatttttaaaactattactggattaatttttaatggctatgcttatttagaagcagcaaaaatactattatgaccgaaatttcaatgtcttaagttttagctaagcttttctctcatttcctttatcaacattgaattcctcttagaagtctgggtttataaaggtaacaataaaaaaattgatacttcctcctatgaattttccatggtagtgttttgacccaagtctcctggtgagaataatcagacttcttattaactggataactgagactcactgtagcagcagttttcccactgtgtcagggagcccttgagagcccactggggctaggggctcacgtttccctcctctgcctctacctcatctcaactggagcagctctgcagttagagtttttatgaaaggtaaattggttctaacccctatgtatgaatatccctttaagaccttttagagaatatacacacttctgaaaagatttaaatcaacataaacacctaagtaagattaatcccattttaggaaggaacagatcaataacttttgacatcctgtgtaataagaattttatagattcactcccactgtctttcagaatttcaatggactttaaaaataaacatatataaaatgcacaaagtaaaaattaaatcagaatagaaattaacttaaaatgaggaataaaatatacttatgaatgagccaacattgttgagcactttaattattcttgaattcctaccactaaggcaaatggggaaaagctttggattcccattttcctataaaggaatgcaagaagtaatttttttcatgcgtccttacatacagagcactaaatgacatagaatactgtggtcaattaaatttcataaaacatataagcattctaactttaaagtgtttccag

SEQ ID NO: 133988 - DNA, 1351 bp, Homo sapiens
aacaataaatatagtaacaatataggctagaatatcaagttcccaatattcaacattgtggtgtttgaaatgttaatatgtccttaccataattattgtatgggaatggttgttatggatatcatactgggtaaatatttcacatttcttcactctccctcttcccactagtacttttaatgaagttggctggaaagtattagttttctgtgtatgtaaaagtaaactttaacacaagaattaagagtatttttagaatgttatataaatgtttatatatgagtttcttaattagcaagttgaaaaataacattaagaatgctaaagcaagctgcatgcaatttttctttcttagctccaagaatagcatgcattgctgttgtttatctggttgttgctaccccctgtgttgcatagctatttgcattctttcttactgacattatagagagaaggccaagtagaagcagggatcatgacagccacaacatggttgaaagagggacctccagcacacaaactggaaatggtatgtaatatttgaacctgtagactacaacacctagaaaacatgtactgtgacaattttgtttcttttcctttttccttaattttataacctgtaaaaaaaaaaattaagagtcaaggacacaaagtcagaggactatggataaaattaataattaaggctgatttaacattcatattataagaacaaattcaggagcagttcaggcatttacagctaaactgaattttaactacaccaaactgtaaatccagtaccacctagataactaacccatcccaaataaataatttttgactaaatggtaagttaaatggaaaaatcaccatcaatgtgtatttaaaattattgaacccaaatatcaaaattattctctaacctgaaagtagatatttgattccttaattttgtgatctttttagtagcttgtcatctcatgtaccaccaaatctttatttcatcataaggccatcttaaaggtaaaaaacatgtgtggaaggtttttttgttattgttgctggttttttcttgtttgtttttagagtcttaactatcaatttataccagtccaatgagtttaaattggggatgaaatttctataaatttagagaaatatatgaatctcaaatattggcaaaagtattatcagataatactttccgcaatattttactagtagagcctcagttttagaaaactaggttatatttaactctgattaatgtgcaaaggttacatattgaatttaaatttgtagcaaattttacttcaaaattctttatttctggtgatcaagatcctatcggcctttttaatcaatt

SEQ ID NO: 133989 - DNA, 1032 bp, Homo sapiens
aatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttaggtaactaaagacacattctcaaaactttaaaaagtatatttgttttatcaaatagttctgtgagacgctttgaattaacttgtaaaacagccctaaaatcaagatgctgcattgaggcacaaataaggaacggttgggtagcaggataaatgggagaccacatataggtcaagatagagaatgttgccatctaccccaggaccccctccatgtgcccatctaaatcacagttcctctgcccccataaataccaattattctagcctctatagtaattacttatttacatttatatggttttatcaccaaatgtgcatccccaggtgaattaatctgttttcatgctgctgataaagacatacttgagactgaagaaaaaggggtttaatggattcacagttccacatggctagggaggcctcacaatcatggcggaaggcagtgaggagcaagtcatgtcttacatggatggtggcaggaaaagagagagagcttgcagaggggaactcctctttataacaccatcagatctcatgagacttattcgctatcatgagaacagcatgggaaagacctgcccccatcattcagttacctcccaccaggtccctcccatgacacatggggattgtgggagctacaattcaggatgagatttgagtggggacacagccaaaccatatcactaggtattatggttcagtctcatccattttgtaaaaatattatatagtcttttttaatctacaggaatcctcatccctttcattgccttacaatgt

SEQ ID NO: 133990 - DNA, 1051 bp, Homo sapiens
caagatgtacagtaggaggagatgagaggccagtggtaatggatgacagaagtgaacagggatgggaggcatggttggactggtcctgctggcttctgggggcagtgggaaatgtctctgggttcaaagtacttcctgcaggggtttggcgactcccaggcagctggttcctcagctgcccagggaagagctggccccgcagctctttggagtgctggcgtggctggttggagtatggctctcagctctctgcagttgcagagaaaggtgaccaccttccacactgccacacagtgtacctacccacagaacagatcggcaacaaggatttttgcagagtgtgccttttcactttgggcaaatattttgccaggagactgaccatatacctttttttccctaagtttgcatgcgttctctgttctcgatcgcctccaagagccatgttgggacactggtttgttctgttctgggcttcaatgtcagtgcaactttaatatcttccctagatatattgtatgctgcttatagtcctttttcatcttctttgctcaccagtgccttcttaaaaggtggttttgaagctgcctcttcaacctcatgatcagtaagtttggagggggactcctttgttgactggtagtctctgagtgaattatctagctttcttttccatgtatttgtgaccttacagagattagggaactttgcaggtgttaattctttgtgccctctgagtcagaagactaagaaatggaagttcttccccatgtttctcaatgagtcgtccttcaatgctcatgaatttcattatgtcacaacctgcaccagggagcagtgaggcatgattgaatccttcctcaatgaaacttcacattataacatatgaggtcatttcagaaaaggttgtgatgagcttaaactgacttatgaaggcacacccagtgaccccaaggttagggtcggtaccaagttgaaagagtaatcgtgttatcttgatgtcaagacccttgctagctagtcatgctgcggcttcgttgaagtcacatgc

SEQ ID NO: 133991 - DNA, 1063 bp, Homo sapiens
gtttctttttttccccctttccctaagtgggttatggaagtctactctagttaactaacttttcttcacaaactggctggcttatgccccctgtttgtaccctgcagttccttaaattcttagagaaaattctgaaggcccagaattaggaaagccagttaaaaggcagaaataaagtgaatgataattatagcttatcctgtaagcagcaaccatgtggcatagtgtacttgcagactactcagataaaatgaggttagaagcagctctcctcccagaggtgacagctcacagggtcacgggtgaggtcgtggtttcagcacagcagaggtgaagttactttggcagttgctgagacaccaccaagccttggataaataaaagacatcagcttgtaaccttgccaatcacttaatctttacaaacacaaatatttaatagaagggccatgaaaatggatttgaagatgaaaaatagacagaataatatctcattacttcatgtgaagtgaaaactggaacctcttaagaacatgcttgttactttccaacaagaacattggcaatttccaggacagaaagttggagtcatgtgtatgtgttactaaatattctgttggagatgaaagtggctgttgatcaagcatgtatagtatctggatttcgggaagttaacaagacagtgtagtgaggactagaagccacaggcccatctgaagccacaaaagaaagttgtgagtgtgctttatggtctgcccctaaaagcaaaggaaacacaaactatgtaacctggtctacgtggcagaaagaaaagtggcattgaagctcctactaacatacattaaaagtaatttttttaatgctaaggattctctgttttgcataggataaaattcaaacttctaaacttggcctacggaccccctatgatttttagcctcttccttgcagtttctcctgcccctctgtgaaccaggtcatcttggacctgagcctgtacatgcaccctctccccctgggagacttcctcactcatcattacctgactgacttgtcaggaagag

SEQ ID NO: 133992 - DNA, 1026 bp, Homo sapiens
tcatttagggaaaggagcagggctcattgcccaggtccctaaatctttctgcctctatcttaccaaggttcttgaaggcccatttcctcatacatgcatacaacagcttttattagtatcttacactaagaatacaacacatttcttctaatagcatctcactccttagcttaggtgtccatgccaactggggaaaaaatagtctaggtttatcagtttagaactttcctttgggctcatcaaaaagtcttgtgcgatttctatgttgtatttgtaaaagaaggggaaaaggagagggaagggaaaaaaatgtctttcttaatttttcagaatttgctcttttcgttaagattctttgacaatttcatttcatgagacttgaatacaatatagattttcaagtacagagtctataaatcatgatcctcatgtcagtcataaattggctcaaaggaggagtagcatgctgggcctccataattcccaggaaatacctaatataatagcataaatcaaaataacttacaaagctggtgattttgtgagctaaaatacttttctcagtagcataagggtagaggcctcactctactaggataaaatgcgttttcattgtggaattcagcagacgtatgctaaaggaacaagattaccttctgtggactctacatttcctcttactggtgatgagttctttcaaaataaaatgtaatgaaaataaccactagttttgttcatttaatctttagaaaacaatttgaagaaatggcctcttattttaactcgtcttctgtaaacgaatttgctaaacatataaccaatgccacatcagaagaacgacagaaaatgctaagagacttttatgcttctcaatatccagaggtaaaagaattttttgtggattctgtgtcacaattcaacaattcttcctttgagaaaggagagcagcgcacccggaagaaatctgataaaagagaatctcttataaaaccaaggctgtcagattctgaaaccttgtcatttaaa

SEQ ID NO: 133993 - DNA, 1043 bp, Homo sapiens
cccccttgctcatccacctgcctttaatggatgggtggtctgagtttctggagatgggcaagatggagcagtctccacacttggctcttcagccccggcgccccccacagccgcctctgctttcctggagataccgcaggctcctaacctcaggccggcttgtgctgctccaccctctccctcccccacagacacaggccacttagcgcgctctcccgtccctcacccctgccaacagcagccacttctggccacttcctttacatgtgaatgagtccaggtctgggctgcctttgtccggggaggccggtgggatttccatcaataattgttggttggtgagtcaggggtcagcagtggtctcctttccaggacccagaaatgacaccacaagggtaactggccactatttcctgcctaggaactagcagcatcccacccccaccactccatggcctagataagacaggccaagaccccagagacaacaggactctggaacagggaagggatttatgattagcataggctctagttaaattcctttttttatttctgtgcattgacctattatgtaatatgcttttttcttcctggaatacagatcctaccagtggttttattccttttttatataatgtttaattcatctgtctctgtaaatccatcacatgaaattgaaagggtctcaaagagcagactgtttcccccctaactcttccactattcaacccaggggcaagcactgtcatccctcactgctaccagcttctggtcagtctttctggccacacgtatgtagacatgcttcattcttttaactgtgtttttgatgttttctatattaacaccaaaaaaaagtacactaagaaatcagtgctatttccgaatggagcccggagtttctcagcactgcgctcctccagtgccagaagcaccctacttctcttcctcagttgcttcatcaatcacatggggctggggcagtgaggaggatgtatttgcctcacatagagacttaaaggttttcctgatctcctctg

SEQ ID NO: 133994 - DNA, 1051 bp, Homo sapiens
gaggaaggcaagtatcaaacaagtaaagaaacaagcaaatgtcagatggccataagtgttatcaggaaaataaaacggtgtaacaggatggttacagaaaaggcaacactgggtggagccgtctgggagggtttggtggagacatgatattgagcagaaacccgattaatggaaatctagaggacaacattccagagagaagaacaaacataagggccccaagactgaaagaggtctgatacatgtgagaaaggaagagaagtgccttatgactagggtgatgtgcacaaggggaggtcaccatgggcttagtgaggtcggtgggggcaggccattttggattttatttaagggcaatgggagaaagggggatcccagtccatacaggggctttctgtgatttagaaaaaggaatccctctcttaagtaaaaaaaataatcacatgaatgactagttcagtgcatgacttgaacaaccattcacagtgtccctgcaggggatagtgggaactgcaaaaggctgagcactcagcagagaatgtaagcaggagaggggaggggagtgaggagatagaagagtgtcagctctggggttcaatcagcagtgtccagcctagtttgccgaaacaatcattccataatccaaactgctgtttaaatcgatggccagacacatgcatcctattaggaattaggcaaagctgctgctgggaggaggcactccttgactcagcctggctttctcagcctggtcactggtcacccctcagcatggggtgcacatgcatcaacagtgtgcctctgcctcccacagaccctccaacctgtacatgccccaagttgtctagcacagctgagaggcctgtgtttctttggatggttagctccatatctctaaataataagctccatgtcttatattagatagaaattatgttcagctgccagcacagagagccagcaaaagttgcttaaacaagataaagatttgtttctctctcacataagagaatccatacgtgaggagcagaaagatggaaggaaattggac

SEQ ID NO: 133995 - DNA, 1146 bp, Homo sapiens
acatggtgaaaccccatctctactaaaagatcaagatcagcctggtcaacattgtgaaacccgtctctactaaaaatacaaaaaaattagccaggcccgtggtggtgggtgcctgtaatcccagctactctggaggctgaggcagaaaaatcacttgaacctgggaggtggaggttgcagtgagctgagatcgtgccactgcactccaacccgggcaacagtgcaagactccatctcaaaaaaaaaaaaaataataataataataataatgataagttagagccatgcattgaagtcaagaatagggcaggaaactggaaaaagaaattgtctagtcataagcatgacttttaaagcaagacagctctctttttatctgcctttaggacaatatattcctctgagattaatgaggggaagggaggggaagtgtgagatcggacagggaatggctgggaagttgctccagtgagctgcctcttccctttgggctatgtccagaagcaggattggcgtgagaggtgggcaccgagagaggggcttgggaagccagggccagaggagccgaggtgtgaacacttggaggatgcagacaagctgcggaaacttgagatctctcagggtggcaaagacaatcccaggggtggctgggaagagataggaggataactggaagaggccacaaaacatgtgtgaggcactttgaaagcagcatccaagggtcaatctggatttaccaaggtgattagagtgaaaaagaagtgagaggggagggagggagaaaaacagtaggagatagagggaaggagagaggagggagggtactgcttggtcaggacagtctaggtaatgctttagtaacagataaatcctgcacatctgtggttaaacagccaaggtttgctttttgctcccttgcacgtcagcctcccagttactcagaggcccagctgagggcatgccaacttgagatatgttatcaccattgaaaaagcaggacaagaactggcagttctggttttcaaagcacgcactggtcctcaaagcttcctccaggaaatggtgcacgtctttcccactcacatttcactgcaagaacaaatcacatgtgcgatgatttcaaaggcgtggagaaggtcaagccta

SEQ ID NO: 133996 - DNA, 1124 bp, Homo sapiens
agagcaatatgtctctggtataagaaaacaacagagcaaatacaatcataaacagcaactgatactcagcctttggtatcagagagccagaggaaagggagggcctgcccaggcatttgttgccaggagggaatggaagcctaccatctccagacgaccttccagtttccaaaagaaggctgaagtataaatttccatgtgaaatctgcttttcccaatgtaagcccaacctttaaaatcattttgcatgggacaaattgacccgtgagcttctagttttcaacacctgcttcacactattcctgggatggctcatcttttatgtgaaacacctgttggcaagatagtcatgggcaactcattcatcagagaacggcactgcttcatggttggtaagagagggaggaaagaagaacaagttaattatcgggggctggggagtcaccaggggaaaaggcatttctgtcatttatttactagtatttactcacagagcaataaatcaaagtcactggcccgccaggagcagcgggagtgtcggcagcccagccgtgccagtcagaatgctctttcttatgtgatgcgcatctggggagggctggcttccaattatctcatgcagctcttatcagattccagagaagagaagacaaaaggaggggaggacagccacagtcacttgagagatgcgctgctatctggaacaggatggaaggaacagggcaggcaagggaagcccctgctggaggagcccccagaatcagcccacctgagggctgatccatccacttgggcaggaggctgttccacccctgcccagcccaactcccgaggccaaggccttttctcaccatgggaaccaaacagcattcagttcagcaatggtagaaaaaaaaaatccttcttgtagtataatgaagagatactcacgttgcagagctccagaaacagaccttggctgtggtgggtgatggagacagcgtgttgaagtccgcacctcggccacgctgtacacacccagcgattccctgagtgtgaggccccaggcgactgctgccttttgatgggtggcccgagggggcaaaagccgtcctgggaaccacacccctccaaggctctgctca

SEQ ID NO: 133997 - DNA, 1176 bp, Homo sapiens
agccaaaactagaacgacggcctccggagagacacccaagctggcgaagtgaagaaactcaggaacgggaacggtcgaggacaggaagtgagtcatcacagactgggacctccaccacatctggcagaagtaagtcagcccaggatgcacgaaggagagagaatgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcaatcccctacaagtggtgagggaaaagtagctccagctcaaccatctgaggaaggaccagcaaggaaagatgaaaacaaagtagatgggatgaatgtcccaaaaggccaaactgggaactctagccgtggtccaggagatggagggaacaaagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaattcaccatctcctgaaaaaaaaaaaatttcagtaatacggaggaaaataatcactagattatactataattctaatatttgatgaattatttgaatgggtgcattgataatattaacttaaacaaactttaagatctacatttaattttcagttccttaatttcacataggccattagtctttcaagaaaatattctgcttagatcaagcttttccaacccacagccagcaggttgcatgtggcccaggacggctttgaaagtggtgcaacacaaattcgtaaactttcttaaaacattatgagatttgtttacgattttttaagctcatcagctatcattagtgttagagtattttatatgtggcccaagacaattctccttccaatgtggcccaaggaagacaaaag

SEQ ID NO: 133998 - DNA, 1210 bp, Homo sapiens
taattcctatagtcccagcactttgggaggccagagagggaggattgcttgagccccagagttccagatcagcctgggcaagatagcaagactctgtatctagaaaaaatttaaaaattagccaagtttagtgatgtgtacctgtagtcccagcttcttgagaggctgaggtgggaggattgcttgagcctgggaggtggaggctgcagtgaaccatgatcacaccactgcgctccagcctgggcgaaagagtgagaccccatctttaaaaaaaaaaaaaagaaaaagaaaaagaaaaaagaagtgcagcccttctatctagccgccatctgttgctaaggaggatggctgctcactgaggctcactccagaatgttagggagggattctcctcccttggctcagcccagctggtgagtgatgtcctagtcacccacactcatgatggatgggtgctgggatcttagatccatgatgtcttctgattctgaatgcaggctgaggtggtttcactaagatggagctgggtgtgacgacacacatctgtagtcccagctacttggaagacaggcgggaggatcacttgaacccaggcattcatgtcccgcctgggtaatatagccagatcttgtcaagagatgaggttccccccaacccttttttaagaaaagaaaaatggaggatggagaaaatgttgcatgattggaaccctggagttggaattttaaagcaaaagtggaaataaagaacatccatgctgtccttggtttaaggctgtgctggtgcataggcggcctgcaggaagctcctctctgcccctgcgttgggctgggccctgtgctgtgctcccgctgctgtgcagctctctcctctgatctgggtctgagtggctccggggcaggtgctgtggatgggatggtcccctctgacagccagggcctggcagagcaggcactcagtggcatcagtttgagttttttaattttttcattgtatggataaataggattatttatagctcctgggaatctaaattaatgttagatttattaaaattataacaatttgagaaacttggattttcttttttttttttttttgagacagagtctcgctctgttgcccaggctaaagtgcagtggtgcgatcccggctcactgcaacctccgcctctcaggctcaagcaattctcctgcctcagcgcctccga

SEQ ID NO: 133999 - DNA, 1048 bp, Homo sapiens
tatttttagtagagatgggatttctccatgttggtcaggctggtttcgaactcccgacctcaggtgatccacccaccttggcctcccaaagtgctgggattacaggcaggagccaccacgcctggccaaaaatccttttttttttttttttaaattgtgactgagggagaattctgacttatgatgactaaaattaatttcccttctcacaaatatatttgtagataataatgtgtggaggcgtcaagcaaaaatccaatttaatttgcattcagattttggtagaatttttgctctgtgtttcattctctttggttagaaataatcttattttgacattgaagaagattcagggtatgccactgcaaactgtgccactgtgagatcaggattattttgagccgagaaagattgagaatcaacagatcaggaagtttgctgccttctcctttctgcctaaaaaccagggaatcaatttcccattgtgaagaggaccgcttctcccatcccaggaagaggagagcaattcctatcactggacggagggtcggccctgagatgcatctgcataaacaaaccctaaaagaacccttctcgttcatcatttccaccataggtttcctagttactttctaacaattacacaatttatttgttccttgaagcccaaatcctctttcctttttaaaacgtaagtccccaagtctaactgtttctttgagtttcacttcttttctgtgaacttcagggaacatattaataagattcgtattctctttctcctgttaatctgtcttttatcagttaaattagcaggcccccagacactgaatctaagagggtacaggaaaaggttttcctccctggcaatgtgtatttctgaattatgacatggcctagcactgtctgcaacgatcaagtgcaggtgggtgggccacatcatggctcagctattgctcttcctcttgttcctgtcatagatccccaaacgtatttatgctggtgctatttataatggaaatggaagagaagctgtttcaaaagaatg

SEQ ID NO: 134000 - DNA, 1033 bp, Homo sapiens
acgggtgaggcggggcccggggccggggggtctgcgggagtgcggggctgcccctgtcctccgtgcgcttcagcggcgcccgggacagggcgggtggggacagggaccctcgagtctcagctgggcacattggtcgagtttcccaggcgccctccagaactcgctcagctttctacactcaggccacaacctgagaaagtcgttctcttcctgagcgcgcctgccctgctgcgaggcgccctgtcctaggtgggctggtagagctcagacagattctttcatacacccagcgagctgaaaacagggattcaaatgcctgcttcaaaggacgcaattccttacacagatctccatgttcaacggtcaggtactcctgagccagtaagtctgtattgattgactgttcattctcagatgaccagcgtgttcatggaaaactcgggaaaacaattggaagttcatatggagtacttttttggattagtgtgaagtaaacgcaaatttgtgctgccttgaacctatttgtaaggactagaaaatcctgcttaattctgctaccattgtagcggcactgagaaaattgtggatttagacccagctccaccggttaacacctgtctttttggaccagtctcacagtcagcaatttttttcagatgcaaaaaacctgaatgattacaatcgtgttaattaccctccagggctctgcacgagctgttatatgtgaaggctctttgtaaactctactatgttacaagaatatgccatcaacattttagagcccaaagagacctagagtgtcttagttagagagtatcttagagtatcagctttctttttttatatatacatacagattcagcttatgtgggtctcacttttctcgaatataaaatacgaaagctgaggctggctgaggtggtttgcacctgtaatcacagcatttgggaggccaaggcaggcatatatatatatatatatatagtgtgtgtgtgtgtgtgtgtgtgtgtgtgtataatatttttttgagaca

SEQ ID NO: 134001 - DNA, 3938 bp, Homo sapiens
agcctggtcaacatggtaaaatcccgtcattacactctagcctgggcaagaagagtgaaactctgtctccaaaaaaaaaaaaaaaaaaaaaaaaattagccaggcatggtggtgggcgcctataattccagctactcaggaggctgaggcacgagaatagtttgaacccaggaggcgaaggttgcagtgagccaagattgtgccactgccctccagcctgggtgacaaagtgagactctgtctcgaaaaataaaataaaaataaataaaaacagctttgttggtatataagtagcatataagaaattatgatacatttaaagtgtacagtttaatacattttaaagtatacaatttgatacatttttgacatgtatatactgtgacaccatctccacaatcaagatggtgaacatatccatcatttccaagtttcttcgtgccccctttgtgaactgaactacacattcctccctgtcccccttccccccatacaacactgatctgctgtcactataaaatagtagttttatacaaatgtagtttgtttattctctcgatgggcatttgggttatttttggctattacatataaagctactatgaacattaatatacaaggctttgtatggacagttttgtatgatctgttactgtcatttaaaatgcatttttcttttttttttttttcttgaaacggagtctcgctctgtcaccctggatggagtgcagcggcccgacttcagcttgctgcaacctccgcctcccaggttcaagtcattctcctgcctcagcctctggagtagctgggattacaggtgcctgccaccatgcccggcaaatttttttgtatttttagtacagaggggttttcaccatgttagccaggctggttttgaactcttgacctcaagtgatctgcctgccttgcctcccaaagtgctaggattacaggcgtgagccactgcgcccagcctaaatactcatttctttagttaccaaagagttgagcatttgcattttctcttgtaaattatcagttggccatgtaacagaataagggtagtgtttttaagtttttgaataaactctgtgtcacagatgttaatcactttttcatagtttgtgggtttaatatttacagcgttaacgctgtcagaagttaccatccctctgtagataggataaataagtttctaaagactgttttttctactatttctgtattttactcaagtccatttcacacaggctctttaaggcggtgatagtttaatggcaaaaacgtgatttgagagtgagtagaagatctagaactgccaggtttattgtggaaacctgagcacgtctcttaacctcgttgaacttcagtttctttcctctataaataggaaatttatgttaaatcactttataactttataaactgaaccacataaaagtaatattgtggtatggaactttttaaaagaaaagtaaacatttggaaatttcatgtctgccatgtaactaatgttgctgcatttcacataggtattgggaaatgagagagcagcgcacccccactttgaaaggcaagctggttcagaaggctgatcaggagcagcaggaccctctggaataccttcagtctgatgaagaggacgacgagaagagaggggcccagcgccggctgcaggagcagcgggagcgcctgcatggagccctcgcgctcatagagcttgccaacctgactggggcgccactccgacagtagcttggacactgactcttccactgtacaaaagtactgcccagcatacttaaaaagtagatccttgggcataagctaagcaccttatttgcttatcataggctgctattctgtagaaatttatgaagaatgttattgccccagaatatggggtgagagagaactgcacttttttaatatggaaatgaattcatcgtaaagtttaaaatattttgtaaatatggactgcacagtacagggtagaaaactacatattgtgggaagctagattttgcaagtttaatgcattcattggaagcagttctcacaggaagcactttctgaataagacacttgtttgaaaaacagaatggtacaaatagccaaagaagattaaaacagattatttataagatcatttttaacaatatatattagtatgtttaacaatactgtaaacactgaagcaagcaagaaagtataaaatatgtaagatagataattttaattgcaaaatactgtgcccactaaggctagagaaatgggaggctattttggaagatgttctaagtaatggacttagaagaaaatagatatttgaggctcttggtaagatgcacaatagttcagaatttttgaaattggagcaaaatcagtcttattctatctggggctttacaactcagtataatgtttaagtttgaaaagcacttgtcatccctagcatgttaacttgggaacttttgcacatttcatatttctcatttgctgaaattgagtgattaatcttgcaaagtctaggtaacatagtaattggtaattttaaaaatacatattaagggccctgtaatgagatttggcacttggatttttactaaagggacacctgcagggttgttttgtagtgaaatgttttagatcttttgttagcaaacactacattttaattgtactgcttgtttagaattattagcaaatggaagcctccatatttatattttcagtgcataaagccaccttcttgctttacttcagagtaacatgccaagctattttgtgttcactaaatttagctatcagttaaacactgcagaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagccacggggaaggggaggcatgtaaatgtcttgaagaggagaaaaagtatgaaagaagatacgatagttacgaataatgtgtatgatgaggacatactttaaaaatgtaattcctctgtacagtaaattacaaatctttagggatttttttgtaataagagaatttatatttgtaatggtctaagaatttttttgtaatgtggtatatagaattttaatttggagcacttataagctggtaagagagactatagcatctgaattatcttggtttatgtttcagcatttcctctagaatttttgctctcaaatatgtgatttaatgaactaaaaacaacactcatcagtcttgggaaatttgaactttgatcaacttaactaaagaaggaagggtagtaagaatttttcaaatacaaatatttgccaattcacagatgataacatttaaggccttcaaaagtaagggtttttccttgtttctccagtcagcttttgtcaactctaatagttttttcataaacattttttatttgtataattgcaacagtttaagaaattatcacaactatttagaaacatttaaaatgttctttttgatataagctatatacttggaaaaatacattggtatctaaaatttgaggtgtgttaagactgctttttgttttaaaaaatggtttacattcaaatttttga

SEQ ID NO: 134002 - DNA, 1413 bp, Homo sapiens
aatggaattctcgggtctgaggttttgaactccacccgacccctgcgatggagtctggctctgtcgccaggctggagtgcaatggcgtgatctcggctcacggcaacctctgcctcctgggttcaagctattctcctgtctcagcctcctgagtagctgggattacaggcagagaccaccacacccggctaattttcgtatttttagtagagatggcattttgccgtgttggccaggttggtctctagctcctgatctcaagtgattcgcctgcctcggcctcccaaagtgctgggattacaggcgtgagccaccacgccctgccattttgaacattttgaactcatgctaataaatcactttccaatggtgttggacacacatggccacgaccaaaatgtgactgtcttcctgtccccgctctagcactgatgagactgtgctggtttgattgttttctcctccaaattatagatcctaaatttcaccatattaatttacttttctggataccagtgaaactgaatgttttccacatgtctatgtgctggatgtccagatcctgacaggtgttaaccttgtgttttgaaggctgcctgagcagattcacccatgcaaaccgccactgtccgaagcacccctacgccaggctgaagagagaggagcccacggacacactcagcaaacatcaggctgccgacaacaaggccgcggccgagtggctggcgaggtcaggaatgctgcctttagtccaccgtgaagatgcacagcgcgggctggggctatgtcagggacctggacatgcctctcattttaaataagctgcatttatacacattttataacataattagaaatgacccctgattttctataaaattgttgtgagtggtattaggatcttaggatctgtgtgtgatagaaaattacaatataattagagtgcccagactacagtttattttaaaaggaagagttttcctattttgaaaaaatgttttatatgtattgtatttcattcgtcatgaatgcaacctttttcattttctttatgttagccttagctacgtgccaattaaaacagggatagacagccgaggtgggtggatcgcctgaggtcaggagtttgagaacagtctggtcaacttagtgaaaccccatctttactaaaaatacaaaaattacctgggcagtagtggcacgtgcctataatcccagttattcgggagattgaggcagaagaatcgcttgagcctgggagacggaggttgcagtgagccaagatggccccactgcactcttgtactccagcctgggtgacagagtgagaccctgtctcaaaacaaagcaaaacaaaacaaaaaaacaccagggatagatgttagtggttcttcttaggtgaggttccaaaaa

SEQ ID NO: 134003 - DNA, 1845 bp, Homo sapiens
gttgccagtgtgggtaagattcaagactatgtggcagaatgaagaaagggctgagtgccgtcctgatcaccactacctcactgtgtcacctgataccccaggcatcagcctagatgtctgtacatcaaggaactgaaaggaggatccctaagggatagttgagccctattagcatattttgtaaaaagcttttcccttactattttaaacaatccccctatatctgtgttttattttaacttgtattcaactatcacaaccatttattatgtctctaaataatgagaaatttagggaggacttgttattctttgagttatactggaaaatgcaaactaatgtacaattgttgattaaataatgtttttttcaataaataatgtttaattatcattaacaaatttttcagcacttgagcctggcactgtgttgtctataggaatttaagtgaagtataaggtactaggaatctttgcaggagactaccatgacacataaacaacacaggaccccaggttaatgaaggtatacaaagttcaattatttggaggtagataggaagaattcagttatttggggagataggaagaatctcactgagagcctacaggattgggaagatttgaatgggcagagaaaataggattttcaaggattagaacaagatgaggaactgcctcctggctggaatgattctccaggagggaagtaaggataaactctgccccttaaccccagtagctaatgaggttggtgagattgcctagagtgccgatcttagaggaccatttaagtcagcagataatttttagttgtccaaggtgtgtaataggatttgggggtggttcaggagctagttggtatgacaaaagcagatttctatgccagctactctgggattgctgtgcagggggagaaacaagaggccggccaggaggctgtcggagggttcatcctagtgggagggctgcccgtctgaccaggggaagctgagtgggaaggcaggagtgggtggaagacatagtgaagaatcagcaagatctagtgatttggagtatgagggagaaaaaatatgggataagctcaagatgataacctcaaggcctaaagaatagattgtgttccccagcagatagtcattgatgccacccaagtgctgccattagcatttccacctgcagctcagtaggggccatgacatgttttattgttattgggagtcatgacctatataaaggctgattctctccccatccccctcctcttctggccttattatctcagatataatatctaacatctgtctacttaggtgagaggccctatctgtgtgactatccagactgtggaaaagcctttgttcaaagtggacagctcaaaacacatcagcgtcttcacaccggagagaaaccttttgtttgttcagaaaatggtacggtgttagaagttaagtttatggaataactagttgtgacttaacagttaaaatatcctttccttgaatttttttgaggggaaagattttttaatataaattttataaaactttataagctttcttctttgataattgtgatacatgctgaatttctcagaaatgattgattttaaaaatttgttggttttgatttttgtgggtacacagtacgtatacatatttacagggtacatgagatacttgatacagacatgcaatgcataataatcacatggtaaatgggctatccatcctctcaagcatgggtcctttgtgttacaaataatcccgttatactcttaacttattttagaatgtacagttaaattattattgactatagtcaccgtgtgctataaaatactagg

SEQ ID NO: 134004 - DNA, 1441 bp, Homo sapiens
tctactgtttcaagttgcttttttattcagtttgctgagttgctataaatgtattttctggagttgtgacaaagctgatctgacagtttttgcttgattttttagtcatctgtggagggatgggccattggagttacctgcctcaccatttttactgatgtcccttaagaaaggcttttgctttgtttttagagacaaaacaaaaatgttttgtgctatgttgcttcgaactcctggcctcaagtgatcctcctacctcagcctcctaaatagctgggactataagtgtgtgccgctgcgcccagctcccaagaaagatttttgaaagttatattatgatacgttgctttaatgagtagcgttaaataaattatattaatgtttataaaaattatcaacaggatggaatccgacgtggtaggcccagagcagatactgtccgcgatttaataaatgaaggagagcattcatccagcagaatccgttgtaacatctgtaatagggtgtttccacgggagaaatcgctccaggctcacaaaaggactcatacaggtaagttgagcaaattttatagagactgccagaagtaacactttttttttttttttttttttttttttttttttttgagatagtctcgctctgttgcccaggctggagtgcagtggcgcgatcttggcttactgcaagctccgcctcctgggttcaagcaattctcttgcctcagcctcctgagtagctgggattacaggtgtgtgccaccacgcccagctaatttttgtatttttagtagagatggggtttcaccatgttggtcaggctggtctcgaactcctgaccttgtgatccgcctgcctcggcctcccaaagtgctgggattacaggcgtgagccaccgcgcctggccagaagtaacacttaactgaatgctgatttgatattgagtaataaattaactttttagttgctttatattttcttattaccactattagttgtgaagttttttaaaaaggcagtatagtcagtttctttttggtggagagtggtggttttatgaatactggttacatgtgatttctaaagttatcatggtaattaacctagatgtcatagtcatgttattggcaaatttagttttaccccctacttgcccaaattgtacttgatatacttttatctatgtaattgttaaaattcatctgtaggccaaaaacattaattgtcaagtttttaatagaatgtttagagtcctcactgtgctatcaggacatttgacctaagcattaaatctgtggtgaactatggtaggcagccatctcaagattatggtacatctttatttgcatatggaaattatatttgcattttaaatatcatttagagagccaaaaaaaaaaagtatagagggcccttgttctcgctataaagttggccccaaa

SEQ ID NO: 134005 - DNA, 2055 bp, Homo sapiens
ttctttaaagtacttgtagttccttatctccatgtgcatcatcagggaattgtgctgagtctgctcatttttggggaagagaggagacaagtctgcaatatagccagtgccaataacattctcccaatatgccacatagaggcactaacagctgtgggtttgagaacaatatttgcgttcatttactgtctattctttgccacttctcccaggggaggtgtcagcgtctgagtcctgcacaccctgtgtcagctttctcttgctcttttgattgttcctgcccaacactgcctccctcgcctgtgggaacacctactagcttattttggctgctcatcacacgagtgcttagcactgttggcatataattatatattatcttcttctggattgtagaattctgagagggaagaaagcaggtctaactgccttctgccacaagttgttccaaggctccccaccttgtccctgtgccctctactaagactgcatttgaagttacttcttcactggggctggtggggtctggcttctcagatactattcaccctacaggatctaccggctgccgtatcctacttcccctttctgtgtcacctgaacacttcaaaacctagactgtacatactgttacgaatagctgatttttaaatactttatacataatacataaattcatagtatttatgaatagtaatgtttgagcaccatgttaaacctaacatcatgttaacatagtaggcactatttattgcctggcacagagtaagcatttcataatgttagcagcaaactgctgggctctgtgttgagcattttgaattctttaattcattttatcctgtttacctgatgaggaatgagaaattagagtccccaagacaaaatctagttaagattgtatggtaagtggcagaactgatcggaaccttctagagtccctgttcttagtccctatactgcactgctcctgggactatcacatgtaaatagacttcaggggtttatttttgttttttaaatattaagctgagataagtagacataagaaatacatactattggccgggcatgctggctgatgcctgtaatcccagcactttgagaggccaaggtggatggatcacttgaggccaggagtttgagaccaacctggccaacatggtgaaaccctgtctctactaaaaatacaaaaaaattagctgggcatggtggtgcacacctatagtcccggctactcgggaggctgaggcatgagaatcacatgaacccgggaggcagaggttgcaatgagctgagattgtgccactgcactccagcctgggcgactaagcgagattctgtctcaaaaaaaaaaaaaaaagaaaagaaaaagaaaaaagaaatacatactatgtatagcttatctatgtctcaattgagatgctttataaaagtgcactcaattcaataaactggaattaaaacttgagaagttgtgaagataggtcaggatgggaagtaggtagttacaagttaggaagcatgtatgcaagtcatgggaagtttgtatctaaatctgaatgtgaaaaggttcacacgcctccctctgagacctatttttgttttccttctaggttgtgcttgttccctttatttgaattctacttataaaaatgtgtcaaggacttttaggttttttagttatcacatgactaaacactttcaaaatcactaatcaaccttctagaggtatggagattgtttttaaaattataattactaaggtatgcaaaagtttttggcaatttaataattttgtgttgcgaatcgtcaacagtcttgacaagatctgtccttagcctccaggtgcacttggctgctgagtgtaacactctgtaattgtccgaagatgcctagaaacatggttttctcattgttaaggccaaaaggaagagggtcctctttaagtaacattgcttattttaatatgtattgttaaaagatggtctttattcatttatttagggcattatatgattatttgttttgtcttattttctgagctaaaataat

SEQ ID NO: 134006 - DNA, 2314 bp, Homo sapiens
cgcccgctgcttcccacccctgcagcctgcgctgcggagtacaaagagcggagggcgcgcttgacctggggctggggtccagccctgcccgccggtgccgtctgctcaactagttaggtggctgctgcgcaggattccgggaaacgtcagtctgccatgagccggcaggactgagcctgcgactcggagcagagcgagtgaggggcagagcggtgctcaggagtgcggcccggggccgccggagctgggggtcgggccgggcgatgatccggggcttcgaggcgcccatggcggagaacccgccgccgccgccgccgcccgtcatcttctgccacgactccccgaagcgggtgctggtgtcggtcatcaggacgaccccgatcaagccaacgtgcggcggtggaggggagccggagccgccgccgccgctcatccccaccagccccggcttcagcgacttcatggtgtacccgtggcgctggggcgagaacgcacacaacgtgacgctcagccctggggccgcgggggccgccgcctcggccgccctgcctgcagccgcagccgccgagcactcggggcttcgtggccggggcgcgcccccgcccgccgcctcggcctccgccgccgcctcgggaggtgaggacgaggaggaagcgagcagcccagacagcggccacctcaaggtgagcggcgcgggcgggcgggcgggcgggacgtggggcagccggggcccgttaacggtgcggcgggcggggcggagttgaaaacgcgaggtcgatccggctacggcgggggctgcggctgacaggatgctgacgtcactgccgcgcgccaaaaaccggccccagtcggggggggcctgtcacgtgacaggcgggagcggcgcgggagaccgtccttgcggcaggtgcagtgggcgggagcgcggcccggggtcgctggggaggccgggtcaacggccactgacatcctcccggcgggctgccgagtcctcagttccgagaggaaacgagagggatgagggccttgagttgttccaccgactgcgagagggcagggagcgcacagtgtttgctccattactgcagatcgccctcgccctgttaaaagatgccctgcagagacagccgaagagcaagaaaggacttctgggcctgttctgcggctgaagttgtgccttcgctgcctttcatttatccagcatactacttgctaggtgttgagagcacatagtggaatgggacgctaaaattgcttgcagtctccgactgcttaaagctgggaaggtcgttaccactggttcaaacctattttacagatcaggcagctggggcttacagtgattagtgaggcgaccttcccacgatggcacagctcagtagtggaagagcggggactaggtcgaggttttgtggcttttagtcctgcatgtgtttggggtgactttctgctgacttatactgaactctgtagactgtaagctccaggtgagccaggagtatttctatctagaagactatatgactttactaccttacattctgtaaatgctcaataaaggtgctcaaaaaatatttgtgtaatgaatgaatggtgctaacagaagggtaatatccaggttccatttgttaagtggctgtataagataagcaatttgcaagagataacaagtaaatcacatagtggataactgcatctgtatcagcacataatgtataagttgaaacgagtttgatcattttacatgcagtcacaaggatgttgaaactacattgtttgggttttgaggaaattgatatattttatgtggcattattattaaataattataaggttataaaactataggtttttatacacttcagctcttgaaactgcacctcagtaaacatttgaaagaacagaacctgggccgggtgcggtggctcacgcctgtaatcccagaactttgcgaggcagaggcgggcggatcacgaggtcaggagatcaagaccatcctggctaacacggtgaaaccccgtctttactcaaaatacaaaaaattagccgggcttggtggtgggcgcctgtagtcccagctactcgggaggctgaggtaggagaatggcgtgaagcgggaggcggagcttgcagggaactgaaatcaggccactgcgctccagcctgtgcaaaagagcgagaatccgtctcaaaaaaaaaaaaaaaaaacaacaaaaaaaaaaaccataacagagcctggtgaggtggctcatgcctgtgatcccttcaggaggctgaggctggggaatcacttgagaccaggagttcaagacca

SEQ ID NO: 134007 - DNA, 1035 bp, Homo sapiens
attctttccagtatactataaccatgattttcttttagaatttttttctggagagaccttagacctttaatttaccagtttttattatatccactccttcctagaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatgtaagtttctttgtaaatgctattttcactttaagatggtgtcagcacgtggtatgaatctattatgtgttaatatttagttaactttatagtactgtgctgttattcttgtgagaagctgatcctgggacttttatgaaccactctttctgatttggagattgactggagactagcttctggtttaagggactattctttctttccgtagagcagtcagaactgaagacaacatgggtggatgtggagttcgaacctggggatcgggtaaagataccaggtacggtgtaagtgtgtgccctctgagaacctgcaattaagtggaaatctctggatctttgcttttcttgaaaatgatgtcttctgtattgtgctttatacttgtgtgcccctaagtagagattgattttaggcttttgtttcgtgagataagtttttaaaacaggtttgctatgttgcagttagatttaaactgcttttaaaattctattactttagccaaacaaatttgtgacagatgaccatgtatttgctgatgcctcaaacatatggcactgtacatttgcacatgcctcaaaatgctttttgttggctgcacacggtgactcacgcctgtaatcccagtactttggaagccaaggtggacggatcacttgaggtcgggagtttgagaccagcctgtccaacatggtgaaaccccgtttctactaaaaatacaaaacctagcagagcatggtggcaggcacctgtagtcccagctacccaggag

SEQ ID NO: 134008 - DNA, 1026 bp, Homo sapiens
tgccttctctctgcctgttcccacaagctgagcactacaagtcacatcgtgggcctggttggaaccccagtaaattcccggtcactgatattctgaaaccaggccttggcgatccccggttcttgggttcactctttctctcaccttctctaatgactgttttaatttctcctcaaaaccctgacactgcctcccactgtacccttccgccatcgtcctctttcattttctggatgcaacatttccttctatatcacagagtaattatgatccattaggtggcaacttcatcatcctcccactgccaaagatacaagactgctacacctgcacgcctcctgggctccttccctcgtgctaaccatcgggctgccatcccccccgacctcttcacgcttcagatctttcctactgacttcatgaaaacttcatactgttagttagctccttccttttttggtatattcatctccttcctcccaaccctagtcttccagtcagcatttaaacatgctcagtctctcctgcgtaagtgtcctctggaccccacattctccgtcagctgcctctttcagagttgcatgtggccttcttcacttcctcccctccacttattcctccctttagtccaggcctggcttctgtcctcactgtccttctgaaacagtcaccatgtctccagatctaatggatgctgcagtctgcgtctttcttgacctctcagaagcatttgactttattgatttcttcgtaaacgtgctctcctgttggtttctgtgatcactctgctcttcttttccttctgcctctcagcatctcctttgcaggctcatccttgtctttcgggtcttttaaaatgttaagttcttcagggccctgccttaggccttctctttctgtagagtttctttataggatcttatgcacttctgtgacttaaattgtcgtttacacactaactctggaatatgtatctctggctcttaacttcaatgtgggctccaggcctgtggctccatctgccta

SEQ ID NO: 134009 - DNA, 1023 bp, Homo sapiens
aatacacttagatataaaacatgtatattgtttgctattattagtcatgccaaatcttatatcttaacctgctcagctgatagaaatttggtcccacttgaaatcataataagttcaaagatgtttggattaagattgtaattgcaagaatgtgggactctagaacatacagaactcactgtcttagaatcagaacagcagtgctgtcttcctttgtccagctctgcagcccagggccagagacaaatccagagaatggctctgactagcccctgatggtgttttagctcctgtgtagcacactgcagccactaagccagatgagtgtggggatggctgtggacttgtgcgtgtttgatgctgtaattgtgtttcagatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtggtaggtgtctgtattgacggtttggcgaaagaagttaataaggacagtgccctgggcccaggatggtctaatttcagagggtcatgagtttctgcagtcacttctttctgtagctagtgtgggactgatgttggggcatttggacggtgttgtagcatcatggacatcttgcctagagaccgttctgtagccctggcttccagggtctgctgtgaaggcactcccgggatcagagagaaactcactgtcacccgcattagacaagatccccaggcttgggattgaactggagcacctgacgttttgcttactgtggcctgattgtgtgccttgggctcaggtgatgctgtcagagtggacagaatcctccctaagatctcaagccctttgtgaggggaccttcctcaacccctccccggctcacctgcctcacaccgtcctcagccaaggctgcctgatt

SEQ ID NO: 134010 - DNA, 1055 bp, Homo sapiens
ccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacttaaccaatcatttaaaaatcgctattgtgtagccactggccaccactctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctgactttgtgtagagaaaacagtcctttggttactccaggccacagcagtcggtcatgattttgttgaataatcaaagttgaatccatacacgttagggtcagttaaggatgtt

SEQ ID NO: 134011 - DNA, 1710 bp, Homo sapiens
agggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaacagcctttttgtttattgtgttacttaccaagcattttgaattctggtaggca

SEQ ID NO: 134012 - DNA, 2324 bp, Homo sapiens
agccctccagattggaagtggtttttctgactcttattttggttttgtttgctttctgaaagttgttactgacctgaaagtgtagcgtcgtgaactggggaaggagagaagagaggcaggatgagaatcgtggagtgcggaggcaggtagcccgtggggtgcctcctgtgctcggtggagctggaagccgcttaggtgccagagctttttctgtgaccaaattctggcttttgaaataacccagtaacagttctctatcttttcattctgcccgctcctcccacagcctggtccctcagaggaaaggaaggacaaggagtgctttgcagcacgtgcccctggcggcgtcatggtactttcctggccctgctgcccctgcccgtccgtcttttatgatttttatttactcgtattggtttttttaaatttctattttttgcagaactgagcctttttctgccctgcctttctcctgtttgtctttcctttgtggttgatattgtgttgtcttctccaaagtatttgtcattagaaacttacagcaagcgtatactttttagcatgtcagtatttttattatgttgccctccttgtctttgataactgcctgtggacgctgtgtaaactttctggtaaaaatccttttttttccccctgtagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctg

SEQ ID NO: 134013 - DNA, 1093 bp, Homo sapiens
ctgctggcagtggacgcaggtggtgtggcatcgtctgctaagttgtttccagtgaaaagctcctgttatgcagcatgcctggagaattaggccataacaacacttcaggcttctgagtcagactcagagatagtgggaaagccttctctggaggctgcagggcctcagggtcacctttgtgcacgctcttgtggtgtccggagtggacagccagtatacatagtgcatagttgccctgatggatttttttcttggaattggacatttatgttcgagacctggctttttagtttttggctttgccgtgttccttgggttgcagatttcactatatctgaaatctcagagtaccgaggctccaaggatgctgcagagaagaaggtgaactggaatataggcaagaggtaggtaggatggaggattttgtcagggcagatgggaaggaagaaaatacatctgctgcacactgctctgcaaagccatgcttggcctgggttggaaggcagaaggccgcgagtgcccgggttccctgtgacagaggcaacacgtcaccctctggtgcctgtcaggtggtgtgtgctgtcactcatgatagctcagtggagttctcccccaaccccgatttcatcagtgcataacctgcagttaggataaataccgtgttgtcagtgcaaataactggagtcttccgtggtgtggttaatacactcaagttctatcattctcttggttttaaagttccacagaaattactagctatttaatattattattatattagttcactttaatttacactaattttatagagaaataaatacttttaaaaagatgttttccagcagcctgagaatgactacaggatttagcagtagtgtcttgttttgaatggcatttaaacacttcagtcatagttttaatttgagaaatcaggattcagatttcctaagcaggcagtgtatcagctcttgtttttttctcagattaattattttgcagtgtgattgttgtctgtacttttggccaaccgtggcctcaaattatttgagaattaggtgttgtatttaaaaaaaaaaagccaacaggagtcttg

SEQ ID NO: 134014 - DNA, 1856 bp, Homo sapiens
accatattataaaaatgtgccattcccttagcttcctggatggctcaggagttagtaactcccttgaagtgagatcagttctgctgtattacgttcatttttagttgtgcctcctgtgattttgttaactagtctggggttttgtgtttttttgtttgtttgtttttggttatctggttttgcctcctttgccccttgtggtttgctttagttttctgtgtgtgcacatcttctgctttttgaagaacctcaatcatttatctgtgactgatttcagtatcataaagttaaattaacatggggtagttatctcactagtgactgagtcccaaagtatgaaacctgtttaaacacagcatttttttattcaacataaaatggcaaaactccatccttgttgaccacccctttgtatccctgttgctgttggctgggcttttagggtgtctaaaattcacatatggcttgattgattgatgattgcgtaatttattttggcttcccaatttgaacatctgttctttccccttcacccctttccagatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctgtaagtgtcccgttctgtttctctgccgttgcttacttctggtgcctagtgtggttcccacaatgcatgtttttctccttgtcagctcctagctttgttggtttgcctattttcaaaggttctttttctgaatcttttcaattaatgggatggtggtggggagggaaggtgggcttcactgttcctctcatagaaaggatattgaaagtaacatacgttgttttaaagttatgcttatccttaacatatttcaaaatagcagttgataaagacactgaaacagtttttcttcactgaaacagtttttcttccctatcaaaagtagttagcttaggataattggggtggttttattttcgtcagttggctatacaatttccctctagttttctgtatcttgagtatgtccttcccagtctagcaaagaagcatttttcccactgatctactttcattaaatatgtgattttgtagcctcgaaatctgccattgtacagcagctctctcataagtcttctctctttagtgtgcagaatttcctgctctgtctcattttcctcctcccctttagggaatacagtaagtacagtgtgtagcacttgatgctaaatgaaagtaggaggtcggagctgaggtcgcctgtttaaattggtgcatttccatatgatggtcattgttcctgcttttctccttgcccagacatagccagaatgcctttaataggctaatagcagcaaatctgtattctcttgagatctttcatctttgaaatgaagaccttaacagcgaagaggctttatttctgcagaagaatgtacaagaggcccacttgtggaacagcatgttgaagacccccagaaggcgggtgtgtccgtgtcacggggtccaccgccacccttctgtgtctgagctgcgttcttccttctctgaagctttttccttaactcatattttaagaatttcttctcttgtctcctcttggacttggaagttatgaaagaatgcaaaagttccttgcaagatctcttccaaagaaaaattccattgcaaccaactctggtactttgtggtttcactgagtattttcacatagctgagaaagatttaaaaatcaagctgatttcactcttcagaattaggcaaaacctgcttaacttgctcctatttat

SEQ ID NO: 134015 - DNA, 1482 bp, Homo sapiens
ctcttcactgttgatgtgttttctaacaagagtgctgctgtgttgtctctgaaagtcaactttggctgtcttaaaatgtcacctgaagcttgattgtgaaagggaaaaatattctagagcttgcagaaacttggactgtgttcatgtggataaattgctgctctgctgtactgcattaataagtgcaacttaaatcattagctcagtgtttttttacttacacagtacagtgatgatgacgaaatcaatggagtgacacaaggtgatagacttcgggccttgaaaagcagaagacaatccaaaacaaacgctattcctctcacgtgagtctgggttcctttgttgtggttgatgtttcttcatatgtgtgtggggtccttggtgagggtttttcctgtacatttttctccatagttgcaagcccatgatgccactttgaaatgcttgcctatgttatttaaaacctaggggtgctggccttggaagctctcagctgtcccttgtttaccttggtcctcatgagcctttatgggtgggaaggcgacatcagggatactttttctccatgaataatcagcatggggcatcctcaggagcgcgacagcagatgtaaagcccaggatgccagacttgtccatagttactaaagtggtgtatttctttacatttgccatgttgcagatcatttgttttgataagcatgacatgatggcttaatgacattatgttgttttggggcaacaatgaactggtctaaactatattttgggtttttcgtttgtttctttggggaatgattttctaattatagaggaagatttagcctgagaataggaaatgttgtagtactgagtgtatgtatgtctatgtgtacattcttgtgaatgtgtgttagttgggattcaacctgatggagcatccaagattgttagaaaaatatgcagaagcaaagtacatgaccatggtattttttgtaggctgttctttagtaaatgctcccacttgttgccattggatttcttccttctagttacttcctttttcattgtgggacaccagatttccagccttcttttttgcggggagggagtgtgatggacatagatcatttattcagtaagcatcttgtaatatggtaaggaagtatgatataatataccatttatattggcagagaacaggttttcttttcaattaaaagtaattcctcactagtgtctcgtcataaaaattctgaagtagaattacacctaaggcatgtgtcattatgggttgctcccctgggaggttcttcttaaaagacccaaggcaaagaattgagttttacaatatgcagtgttatgtgaatgaatgtagggcatccattttgattataggcatttattaagcatttcttttgcaacttagtggtactttagtcaactatacttttttaaaaatggtgccttttggccaggtgtggtggctcatgcctgtaatccc

SEQ ID NO: 134016 - DNA, 1049 bp, Homo sapiens
gaagaaataaatccaggccgggcatggtggctcacgcctataatcccagcactttgggaggccatggcgggcggatcgcctgaggtcaggagtttgagaccagcctggccaaaatagtgaaaccctgtctctactaaaaatacaaaaaaattagctgggtgtggtgacggatacctgtaatcccagctactttggaggctgaggcacaaaaatcacttgaacccggaaggcagaggttgcaatgagctgagatcatgccactgcactccagcctggccaatagacagaacaaaaaaaagaagaagaaataaatccacagaagctatccctgagaaagatcaaattgtggacttagtaggcaaaaaattttaaataaccatcttaaagatacccaagagttaaaagaatatgtgggaaaagtcaaggaaacgatttatgaagaaatactaatatcagttataaaaagaacacataaaagggaaccaaaaggaaattctggaaatgtactaaaactgagatgaaaaattcactggagggattcaaaagcatatttgagcaggcagaagaatcagtgcgtgtgaagctagaatcattaaagaattagcaagtctgaggaacagaaagaataaagagcataacataaatgaacagaatttaagggatccctgagacacacccaagtagaccaagatacagatcgtgggagttccagagggagaagagaagtaaaggagcagacagatgatttggctgaaaactccccagatttgatatatgcaggaatatccaagaagctcaacaaactccaagcaggataaactcagaggcccatgtgaacatgcattataatcaagctataatgccacagacagtcttgaaagcagcaagagagaagtgacctaccacatacaggggataccactgagattgtcagcagatctctcatcagaaacattgcaggccagaaggcagtgggttgatatattcaaaatgcataagtgagggaaaacctgttaagaattctacatctggcaaaactccttcaaaaa

SEQ ID NO: 134017 - DNA, 1791 bp, Homo sapiens
ttgctttcctctaatgtttaatagattactttggtagagctaattgtaacatgtaggttccctgttcaaaatttatcactgtatattattattttttatgtttaagcagtttttatagctgtaagaatggcttaccttgtaagcatttatgttgaaaatgatgatactaattaaatttaagaatatattaactcagcaatctgtgagaagaattctaaactgcattaaatttgagattgcctctacagttatgataagagctcagggactttgttatttaatgatgatcttttgaatctgtggtcccactttttaaatgatttaattatcttggactcagaatagccagtgcctgcaggaggaaaggatcagttgggaagttaagacaagggaacagagaacgaggatctagacgcagtgggtaagaatccagttcagcaaacagctgcccagatgggacagcagaggctggaggacagaatgaggtcataacacccttcctgggtgtctgtgaaaggcagggcaaacagcacgaggcaaccgtcagtagtagccaggccccagctagtgtgaggcgaactgggctgagcaaagggacggcacaggccctcagtgggaagccagtgcttccttgggagccggccctgtgggaggcagctgtctgccctgctcacagtgcatcacagtttgacttcccttgccacccgagggcttctgacgggcgtttccactgcccgtggtgcttgctgggtgctgttaacttggggaaaaagtgaagagaaatggctctctgatagcttaagatccttgactgcagatccgttaagctttctggaattttgggtcccatccttgttccggtcattgttttagataggatgggttcctgtctataaatacggccagaggagcaggccctcttccatcaataataggcggtgtgatcttggatgagcagttgatgccaaggtctggaaagttgtagcctgccagttttatgaaactcacagagcattataaatagttgtgggttttttttcctctgtggttaaaatttaggagatttcattttttaaaaaatcaagatttttttcttggtctttaaaaaatgtccctaccactcaaatgtgtactaattcccagggccaattcactatttttattagcagacttggtagatacgtgtttgctactctgaacttccagtttcattttgtcgaaattgaggatcattatatatatcattatatatatgtaaaagtaattttaaaagttaaaactattgaaatataagttcatctgaggttttttttaacgagttttttttcttaaccagttttgtgcaggagctatgaaagtgattttatttacttttttattctctgtgttctttcctctgctcaccttttttattgagcagttgaatgtgtaagcctatcttcaacttgcattgatttgtgagcattctttgttaatctggagagagtgatttttttttttaataatcaatcaagttcttggcgtaggaaagactgtatcatctggctgacatgaaaatagtcacaagagtctttaagtgctggaaacattgtgacatctctccaggatttcctggttactcaggctgccacatttgttgctggaatttcaatatcctttgtcactctcagctctagggtgaaatgacttgtgtaacgtttgggttctaaattgtacagaggctctctaagtatataaataaagcttcagaatcctgtgcataagagtagaaataggaagcacatgtctaat

SEQ ID NO: 134018 - DNA, 1734 bp, Homo sapiens
ggtaatttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggggagctaaacttttacaaaaataggtttgtttagaagtcatatcactacatgaaaaatcaccacttttgaaacttacggttaaaggcagtttctcttttaaaaatgtgctcattgattattcccacccaaatagccagaatattttgtaattacccattaccactcctaccatctgaaacgtgcatgaaaaaaatgaaaaattgacttcatctgaaaagagttgtgtcatgatatatgaaacgttttttgtaacctccaggaaggaacattgcaatttttccatttcagatcgcctttgttttgccattctctacagcagaccaaagagtgcatcaaatgtacattatttcagcatagataatgaacttgaatatgagaagtaagtattgctctttaaaagattttaactttttgtttttgaagaatctaaaggtatggttataaatgggatggcctgggaaaattataaatctattgattgctaattacaggatgcttgtttttcacctgtagtaataaaataaacctttagagcaaaaaaaaaaaaacctccctaaatttaaacatttagatttgctagtctaatatttacactacaatgagatataaatgtgtactaagtaagatattgtggttttgcccttggaaatatgtgtggaaaaacagcttttttaatttagaaggtatgttcatgttcattgaggttacatgtaggcattatagcacttgtggcatttttaagtaggcattatttaccagaatagtcttccaccagtaaaacagtacctttaagttgtattggcccataacaatttggtatatgcttgcttatcttaatttgatcttgtagacccaaaaaaggcatttatattcagagcatctagaatgtacatcacatttttatttttcatttttaaagcttctacgcagattttggaccactcaatctggcaatggtttacagatattgttgcaagatcaataagaaattaaaggtaaagtctttaagatttgacttaagtaatcattgttagcttgatctgggggacgaaagtaaggaaaacatctctttttaaaaaggaaatgacatgtttttcactgcagtggtgtttgggacatgcacatggttttcttgttttataagatcatagtgtatctatttgttttctagagttttgaatgaacagtttaagtttgggtcgtttggttctagtttgaattagtgatgcccaaatacttgaaaagccaaagtgggaatcagttaattaagtgaacctcgtattgtctgacctaatagaactgaaacttaacaagagaaactcttcccttgctgtggccattgttctttctgccttcattttgatggggagtgatagcaaactaacaagaaagctggactcatcttactttctctcctattttgaaactcccatgatactgtactacatgat

SEQ ID NO: 134019 - DNA, 1032 bp, Homo sapiens
atgtgtagtttgaattttagcaagtgtacaactacgctaaagttccctgggtctttcctgtcatcccactaccccaagcatctgctgtctggtttctgtcactatagattagttttacctgctcttgaacttgatgcatatggaatcataaaacaaactcttgtgtctgtctccttttgtgtatcagtacttcattcctttgttactgctgagcggtgttcccttgtatgaatatatgcggtctatccattgtcttattgatgtacatttgggttgctttcagtttttagcttttataaagctgcagaaatattcatctgcaaatctttttgtagacacacatactaatttgccttagatatatacttaggagtagaatgtctgggtcatagggaaagcctgagtaactttgtaagaaactgctcaattttgccagtgtctacataccattttacattccattagcaatgtatgaattctaattgcactacatcttctccaacaattggtgttgtcatttctaattttagccattttaatgggtgtgaagtggtatttcattgtggttttaatttgcatttccctgatactgaatgcttttttcatgggcttataggccattcctgtatctgcttttgtgaaatgtattcaaaacttttgccctggttcccatttttaaaacttcaatatgtaccttacaatgagaacacagggacacagggagggaaacatcacccactggggcctgtctgggggttgggggcaaggggagggaaagcattaggacaaatacctaatgcatgtggggcttaaaacctagatgacgggttgatgggtgcagcaaaccaccatgccacatgtatacacgttctgcacatatatcccagaacttaaagttaaaaaaaaaaaaagtgccttaatcccttccacaccattttctttaaataaacaacaacagtgcaattggcatgacaatgcattttaaatctctctgagaagttgttttctaaagaaagaattacttattaatat

SEQ ID NO: 134020 - DNA, 1076 bp, Homo sapiens
ggccagtgacaggtcctgacttcggtgaatgtggagtgactggaagagctgagccattgccagtgtagcatgccaggaatggatctccacagagactgtggattccgttcaagttccatttccaggaactcctcgtccttagctagacagagtgtgtgcctgtaaagtcaaccactttaagtcttttatttcgaataagggaagataacaaatactttggcactcttgggaatgtttcaaggtggatctactggtttaattgttccagggtttctaatctgtgtgtcacatgcttacacgaagctaggcaatagggagatcacaggttaccgcatgtgatgtcactcagtgctgtttactatcggtacctttttggatgctttcctctctttattaaaatcttgcgcagtgtcttttcattttttcttcagaggtaattcagtctgttcttactggaggggaaaaataagtcatagtgctaatcttgtaagaagtggaatttaacatgctcaagctttcacatgggatcaagattcaataataaaagccttgacgttggaagcttaatagttttagaaataatttttctgcagtttctcgaatgtcagtgggcagcatttagaatgtgtttgactaagtagtgctggtcttcctcccctttaagcctgcacttgtggtacagccaggtttctagtttcatgacgcatttatcattggcctatgcctggcccttggttaggcttcctgtatttttcaaatgtggccaactagacagcattatacctcttcacctagagttgctttcttttttttaagtttttcattttattttgtttattttttaataggtaatatatgcatgtaggttcaaaattcaaaagataacaaaagagtaaacaacatagactaaggcactttcctgttttccctccccataatctgtcaatattactaacctcttgtgtgtcttaccagagatgttttgtgtatttgtgtgtgtgtgtgtgtgtgtgtgtgtgtgtgtgtgtccgtttctatcacctcaaatgacaccacattattctcattgttctgca

SEQ ID NO: 134021 - DNA, 1027 bp, Homo sapiens
gaggttgcagtgagcagagattgtgccactgcactccagcctgggtgaaagagtgagactccatctcaaaaatatatatatatgaataatttttccaatgtctggtgaaaatctgtcttgtgtgtcttttcgtgtgtgtgtgtgtgtgtgtgtgtgtgtgtgtgtctgtgttttaacctttaaacaacagggaatagtgtcattttggtatgtaactgatcatatataagtatatgttaataattcaccgaaaaccctatctctattaaaatacatctaaaggaaaaggtctacatttcaattagttctatatctctaatttggatctcttgctatcccagaggatataatttaaaataagatttcttgtttattctcggtaagaagtaattacagagcacctttaagctgagtattgcttcttaaattgaaggcactaaagataaagattgctaaatatttcgggaactagatttaactgtgtgacttgaactgaaaagcattctaattttccattcttttatgggtgctggggaagaactgctttgacatgaatgtataatagaattaaaatgtcggtcttaaattttggggagttgttctcagtttgctcttggaatttattattgtaatactgtcattagatagtttgttggaagcagctaatacgtgaaagtgaagcatcttaatatgcatctcttttctttctgacaatgaactgtcaaaaaagctttgagtttatctaacaaacacagctgaggctgggattttaactccactattaatatattctaattttaaactactgtaactgaaagggcatacagcactaattcaatccagacatgtttgagtgcgtttgatagtctcatccttgtaatagctgctgaaaaagatgtggtagagatttcagactggaccactgacgtctgggaattgacactagcacacagactgggtcaggcaaggtacaacctggtgccgccagctgttttgcatggaagaccttatctgtaaaactcataga

SEQ ID NO: 134022 - DNA, 1048 bp, Homo sapiens
acaaatattcagtagctaagatgggaaggaaaacaaaaaatactggctactaaaattcatttttcccagggtaataaaaaatagatttaaagatctcatttcttctttatatcctattcccaacctttccaaataacttgtctctctgctacacattaagcatggaaaggtcctttgaaagcaatttgttttacaaacaaaaaaacaaaaaaagaccctgtctgccaataatatgcaccattagtttcaaatcttttggataatcgtctgtgaaacactattttaaaacatatacaagagcattttttaaattaaccactctgaaaatttatattctatcagtaaataatttcatatattgttttattttctacctcaggctctcccatggtagaggggtctcccatctttaagaagacctccccaacaataagcttagctgcaatttaatattaggcaatataagtcttcagtataataaaaatacataacaatagcctcaagaatgaagtaacagctttggtttattcctccttttacagggaatctttctaaagagaaactctaacatttatcccaaggcagaaaagatgatcaccacggcaccaaacctcctccgctgctctgacaaatacagagccagcctcatctggagcatttctgccctgagctcgctctcagaagcagacagaggaacacactgcatttccactgtgctgattcactgaaccttttgtgcaagtacacgggaatgtttgcttcttagcttgaaacccttccagccgtgatgactgtgcctcagcctgccctttgtcctcgcagctgctgtcacgcgtgtgacacaagagaacactgatgcagccctggccatcaatgggcatcaagccaggcacttcatatgcatccccttcatttcattctcacaacaaatctgtggcagatgaaagcatcgaggctccaaaaggttactaataatctgtctgtgctcaaccctgggatggggcagagactaggtttccccagtgtcctcatgcctagtggctagctt

SEQ ID NO: 134023 - DNA, 1003 bp, Homo sapiens
gttttatggagtcttcctcccttggtaatgtttttcctccttcaattttctgtgcacattcaagtttctggaaattgtgccataccagcaagattagttctctttttttttgagacggagtcttgctctgttgcccgggttgagtgcggtggagctatctcggctcaccacaacctctgcctcccgggttcaagcaattctcctgcctcagcttcctgagtagttggaactacaggcatacgccaccatgcccggctaatttttgtaattttagtagagatggggtttcactatgttggccaggctggtctggaactcctgacttcgtgatcccccccagcctagatctcccaaagtgctggggttacaggcgtgagccaccgcccgcagctgattagttatcttttgatggctgcattatatggccaaatcatgatttatttagtagtaataaatagctggttatttgggggttttccagtccctattgcaaatggctgcagtagcatcaatgtatgtgtctgtttatatgtgtgactatatctatagagtgtatttctagaggtgaaaacgccaggccagagtacatatggactttatccattcctcagtggactttttggctattaggaataatgctgctgtgaacattcatatacaggttgttgcatggacatgttttcagtataacacccaggagtagaatggcaggatcacatggtatctccacgtttaatgttttaaggaactgtcagactctttttccgaatggctacgccgccagcgttcccacaagcaatgcaccaattattccacatccttgccagcacttaatattggattgacaagattctttcacagtggagtaggtttgtaaaaattaatgcatattgtcacttctgtccaccctgcccttaaatacatcattttttaacttagtcccttgacatttttattgcagcctatttaatctgtaaattgaattcccatagatcccaggata

SEQ ID NO: 134024 - DNA, 1001 bp, Homo sapiens
aaacccccgctgctccgtagccttgggaccctgggcgccgcgttgcccgtccggcgcgtaagcccgagcccctctcctgggcctcccgcgccctgccccctagcgcgccccccgaacgcctccgcctcccggggtccgctccccgccggggcctcgagaaggaaggtgtcacgttggtggcattcgagccagccggcaagacgaatgtccgggttgtcacttttgagaaatcccagccagccagagcaggtagccaagcagcccttcgatagctgttctgttagtgctgattcgactgttcttggagactcataaatccaatttggcagctgttaggtttgctgggattgacagtgacgcgtgtgaaggcattaaatgtgatgatgtatgtggcaacgctgtgtaaacagcagagctgtccacgattttgagggaattggcagtctgttttcagtggcggggaatgtgtcaacctcggtgcgtggcgttattaaaaactgtttccagcccctagcctttgataaaccaggtaagctggagtggcgagaacattaagtggaagtgtttagacaaacacagacgtttaggagaaataatattctaggttcatggacaatctggaaactaagttcgttttgaaatgaagctgagagcagagcgggtttctcggctttggtggatggcccttgggaaccagagcgggcataggaaggggttgccctgagtaccagtccccggccggtagctgcggggggtgtgcgggaggtgaagcctgctgagactgagaagccaagtcccgctaacgttgtgcccttcccaggagagggcctcgccgaggacggatggggctgggaacgggtgggcctatacatagtttctgcccgttattgtttatacctcttgaaaggatctgtgttgaatgggatttaattttaggacaagtaatgcatttacatggtacagaactccaattctaaaggtgcacaggagtacgtgcagaa

SEQ ID NO: 134025 - DNA, 1051 bp, Homo sapiens
tcttacatctctccatctctttcgccgctgtcaagtctctgacacctgtttggcaccagacctcggctccggaaacacctctggcttgcttactctgaccaagttggacaggctctgctggctggagtctcggtcctcttcttcagacagaacttggctgttctctcttgggctctgcaacatttgctacaaatccaagttgtccctgcctttggcccccgctgccaggctcaccccccaggtctcctccctcaggggaatgggaaagacagcagagagcctgcttcacagtcataatcaatggagatcatcaggtaatccgaggtagctaacagcctcctttatcctctacacggttttctttccaatcattgcaggacaagaaagacatccttgtctgactctccccttatccacacaattagaagtgaattaaaggcatcaatttcaagtcacttctgtagttgtggaagggtgaaggcaatttattttttatctcctgttgtggctggaaagaaaacttcttgcaatgacttttctggttttggaagagaaccagcaaccaattctaaaatatcgggtgatttttctttttgttacaaattcttccgaatgtgatgaaatcctagcgcactgggttcccactcaaccagagttctccttaggaaaaaggagatcaggaatgaccaaaatgcacagatctatagttttgcattctcatatggtgggaagtttttctctattcatgattttttttttctcttcagtgataccagagcatacatttgggcagattaggttggattctctattaagttcctctttccatttttaaatgcagattcaaatgagcagtgaattattttatccaaagttaggggctatataaaataaaaaaaatgaagaaggctgaaatggccccttatataggcagtcagcttctagaaatagaagcaaatgaatatttaacaatacttaaagaaaggcaatttgttttcacatttatatattaattattttagtttgtgcgttattaaatattacatacctt

SEQ ID NO: 134026 - DNA, 1036 bp, Homo sapiens
tttttttgagatggagtctcactctatcgcccaggctggagtgcagtggcgcgatctcagctcactgcaagctccgcctcccgggttcacgccattctcctgcctcagcctcctgagtagctgggactaacaggcgcccgccaccacgcccggctaattttttgtatttttagtagagacgggtttcaccgtgttagccagtatggtctccatctcctgacctcgtgatctgcccgccttggcctcccaaagtgctgggattacaggcgtgagccaccgcgcccggccgataccgcattttctttatatttatccattgttgaacactgaggttgcttctatatcttggtgttgtgaatcatgctgtaataaaacatgggagtgcagatatctcttcaacatactgatttcatttcctttgaataaatgcccagtagtgggattgctggatcatattatatttctatttttaattttaataacttccagactgttttccgtaatggctgtactaatttacattcctaacaacagtgtacaaaagttcctttttctccacatcctcaccaacacttatcttgcatcttactgatagccatttaacaagtgtgaggttatatcattgtaattttaatttgtatttcactgatgagtagtgattttgagcatcttttcatatatctcttggctatttcttttttttttttttttttgaggcggagtcttattctgccccccaggctggagagcagtggcacaatctcggctgactacaaccttcgcctcctaggttcaagtgattctcctgcctcagcctccagagtagctgggattacaggcacatgccaccacacccagctaatttttgtatttttagtggagatggggtttcaccatgttggtcaggctggtcttgatctcctgacctcaggtgatccacctgacttggcaaaagtgctgggattacaggcgtaagccaccatgctcagccctttgtccattttttaatcaggctatgttgttttcttgcaaagtt

SEQ ID NO: 134027 - DNA, 1110 bp, Homo sapiens
tgctaccacccccttctaaaaattatctcatgaaaagctagtgattaattctcttactgaggtggttatcttgtctgtccattaacctctgaactcttcttggccatccatgtggaattagaaagcaggcagagccaaggaggaggaacagccatgacactgcatgtccaggggaaatgacagtctatctccttttgctttcaagttgctgatatttactgtgtattgtgatctttgagttggccatcatgtgtgggaacagcttccaaccttatctttttttgatggacagcagatgacctgattgattgagaaaagccaggtgcctagttcatctgaactttttgggtcatattgagaaagtaggcgaaggggttggtagagactgcccttttgctcaagtacacagtagcaggttagaactccttagtgtggggaacagggttagtggtcaagtgaaggtctacgctttgctttgcctgaggaactagctacatttgactcctgtcacttactcaggttgctgcaatgcaggctggctgccatatgtatgtactgattctatttgtggaaacatttgggctgtataagaaaagtaatgtattacagtggttagtagcacatactctggaggtgtgtgactatcttggtggaataccagttcatgcacttactatgtgagttgggaaagttgcttaaattctctgcatctgagtttgtcatctatgaaatcgggataataatagttcctatctcaaaggttgtagtgaggataaaatgaaggtatgtatatataatgtgctttggttagggccccgcataatatctgttgctgctattgttgctgctgttataggataattatactttttgcccagatattgctcaggggtctttgtaatatactcaataacctctgtccttttccttcagagcgtatatttccatttataattttacattccgtgaaatgagagcaaggactgtatcctgtttctcaccattgtccccaacacctagctggtatagtcaaggttaacaaatgtttgttgagtgaatgaatcgtttggagttgagtattttcactcttatagaatgttggacatatac

SEQ ID NO: 134028 - DNA, 1360 bp, Homo sapiens
cctctgcctcctgggttcaaatgatgattctcctgcctcagcctcccaagtagctgggattacatgcccggttaattttttttttttttttttttaatttagtagaggcagggtttcaccatgttggtcaagctggtctcaaactcctgaaacctcaggtgatccacccgcctcagcctcccaaagtgctgggattacaggcatgcaccgcacctggccaatttttgtatttttaatagagacgaggtttcaccagattggccaagctggtctcaaactcctgacctcaagtgatctgcccacctcggcctcccaaagtgctgggattgcaggcgtgagccactgtgcccagcctcaggacatttataaatggatattaacagcatttagaatagtgcctgacacatgggaagcactgtttaagtattagctattattattaatggagccaattttcccttgattccttgtataaaatggaaaacctgctcctctttcagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaaggtgggcctttttttaatgcattggctttttgtgtagtcaggaaatataattaagctctgaaataataacttcatgtgccaatggtatgttaggagaaagatgctagcagaaagctggcttcctggctcttgagtagttataaaaatacagactttatatcagctgcccagttactgtgtgttacccaactcctgaatctaccaaaatttgataaacaatttggaaggacaaacctacattttttttttttatgagacggagtctctctcactctgtcaccaaggctggagtgcagtagtgtgatctcagctcactgcaacctctgcctcccgggtttaagcaattctctgcctcagcctcccgagtagctgggattacaggcgcgtgccaccacgcctagtgtatttttagtagagagagggtttcaccatcttggccaggctggtcttgaactctcgacctcgt

SEQ ID NO: 134029 - DNA, 4799 bp, Homo sapiens
agctcatctcctgctgtgtatcagccaagaaggtgtgaggtggtgttccttggggatccgcttgcatctacttgggatggtacgtcttcattagtgaggttttgcctggatgacctcagtacaattggtgcaaaacctggaccaactctttcctagttttctagttgttgccttaagcttctcacccgtcaggtatctttcacacccttctcataccctaaattatcgcatatgctgtttcaacgcctccaactctgcaggctgcttttaattttggtgggcccatcaaatacctccacttggcctgtttcagcctcttccacagtccttggggaaatgctagggagaataattgaaatatttctattccacgggggctgtaagatggctttttaggattggtctaatcagatactcatttcttttctctttctaggttttgaaacatgaatctttcgctcgtcctggctgccttttgcttgggaatagcctccgctgttccaaaatttgaccaaaatttggatacaaagtggtaccagtggaaggcaacacacagaagattatatggcgcggttggtaacatctgaaactgtccagagggactctggagagaatggtcctcgctgttgggagttgatagccagagagtagcttctagacaccagaccttaccaggcaataacctaacagcacccattataggtgcaatatgggcatatatctccattgtgtcttggcttggagaacagctcccagagaagtatcaacccatccctggccatggtttctcttccatttctgcccgcaaatcggcttggtgaacatgggttgggtaagtagacataaagtccaccagctatatgtttgcctctagaatgaagaaggatggaggagagcagtgtgggaaaagaatatgaaaatgattgaactgcacaatggggaatacagccaagggaaacatggcttcacaatggccatgaatgcttttggtgacatggtgagtgtggcaaggattgctgaactctgtgctgcttctcagttcttcaccaaaatagtcttgcttttaacattttatttacttctccttgaagaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcaggtgagacagcgtcagattcagaccctgtctccacaggaaagccaagaaggaattggtgtcattgctgtggtagatggtggcacaacatatggtgatgggttttttgtatttttggtttttggtgttttttttgtttgcttgtttgagacggagtttagctcttgttgcccaggctggattgcaatggcgtgatctcgtctcactgcaacctctgcctcctgggttcaagagattctcctgcctccacctcccgagtagctgggattgcaagtgctcaccaccatgcccagctaatttttgtgtatttttagtagcgacagggtttcaccatgttggccaggcggatttcaaactcctctcctcaagtgatctgcccgcctcggcctcccaaagtgtggcgatgggttttttttttttttaaagaatattaaggtaattcaattatggggtactgtatttgtattggtcttgtaaatttacagctttttttttctccctttttagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggtaaatggagctccttatcttgtcattcgtgctctgcttttggaaagtggaacactttcagagataacagatacttttttcagaattcacattttatatggtagaatctacatctgcaaaccgtgagtattgtcattataaattattagcctttggccaggcgtggtggatcacctgtaatcccagcagtttgggaggccgagacaggcggatcacgaggtcaggagatcaagacaatcctggctaacacagtgaaaccccgtctctactaaaaatacaaaaaaattagcccggcctggtggcgggtgcccgtagtcccagctactcaggagactgaggcaggagaatgacgtgaacccgggaggcggagcttgcagtgagccaagatcgcaccactacactccagcctgggccgcagagcgagactccatctcaaaaaaaaaaaaaaattattagcctttgcacagttctctggtgagatggtcaacagctaatggttaccatataagtaccattagatggttaacacacagctgttcttgcttttacataacatggagaataagcaaaccattctacatataatagaactttatccattgtgaaaaattttttatggacagattgacctaggggttctcattgaagaaatgtcaactaatttttcattttcaaatcaacaaatagcattttatttcatgggacgatttataagggtgttgatttggaaatcctaggttgcaaattgctgagtgtttcggttctagaactaatgttccccaggaggtagatggtagtgatcaagtctctccccctttaactttaaaaggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggtaagtgtcattttattatagaaatttaggcagaattgggaagcatcactgtgattgattcttggatatgacatcctgctttgcaggaatgtagtattttgagagtgagcatttaacatagtgatgtttgcatttgacatgagaaaatacttagttatgttaaacttctcataaatatttttaaatggctatgtaattgtatagagacaacctaattttccaaactattttccagttgttgggcctttttttctcaaagttttttactactgtaattaggactgtaaagaatccccttcaagtttttgtttgtttattttggtgctattttagactgacatcctaggaacagaaagggattatgcgagttggtatttgggctcagagatatctaaatcaccttagctgtaaacaataggttttatcttttggattttcattttttttggtagaaaatatcttgaacttagttgaagttagttgatttctagtgagttgaggttgacttttttcctttatcagccattactgttttccggccaatattgtttgggtccttatttggcatttgtttatgacattttactgaatttagagatgcctcccttatggagggtggtagggtgggttactgtcacatgtcgcttggagcttctcaccccagcattaattttactctcccaggcatttattttgaaccagactgcagcagcaaaaacctggatcatggtgttctggtggttggctacggctttgaaggagcaaattcgaataacagcaagtattggctcgtcaaaaacaggtataaaactcaaaattgaaaagggaatttttgttccaaatcagtatttggatacaagttcacaaaagctcaatttcaaaattccgaaagtctttcttctacttagagtgaacacagaaatattaatgtttgattataagattccgtaccaagctttttggagttattgctatgtatttgtaatattttattactaagttttgaaaatttttaaattctgaaacacattagtcctcaagggtttcagacaaaggactgtggacctgtaggtttgagagctgattgcttttttctgtctaatttttcaacaaggaatagtaagcagaaacatctgcctctgctggttctttgttaagtctgagagatcatccgggagtccagtggtctgtgtgcatccttctattgtcattggatgccctgtcatcgaatttcactccccagctctcaggctttgaaggttgtcagaatctattttctcacaattagcattctttaattgagatgtgacataaggtagtatgtggggacagactgctacagtggaattccagttctgcctcagtatcttaaatagttaaggacccacaagaatcaatatattcattcattcatttgtttatttattttttgagacagagtgtcgctctgtcacccaggctggagtgcagtggcacgatctcagctcactgcaacctctgcctcctgagttcaagtgattctcctgcctcagcctcccaagtagctgggactacagggatgtgctaccatacccagctaattttttttgtattttttagtagagacggggtttcaccatgtatgccaggctgctgtcgaactgacctcatgtgatccgcctgccttggcctcccaaagcactggtattacagacatgagccaccgtgcccagccagttttattttattctgagatggagtcttgctctgtcactcaggcaagagtgcagtggtgcaatctcggctcactgcagcctccacctctcgggttcaagtgattctcctgcctcagcctccc

SEQ ID NO: 134030 - DNA, 1035 bp, Homo sapiens
taatgcttctgctgggggctgtgcgttcttccactccgtcccacctttgccgtggactaaacaggagccactgaacgagagtaccctggctcccggccctgcagattttcaccaaaaactctaggactaagttaaagtagggactgaaataccacacagagctcgctgtaaaccacccgctcagcgcagtaagtcgggatagtcagtagatctgagcccttgagggaggcgcctccccctcctccgcgcagcccccgggcgcccggcccagcttcccgcagccagggtgtattgaggtaggcgcgcccagacctgagacgggttgggactgggctgcgtcacgcgcgggctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggtgagcgcccccgaccagaccgagggacagggcgaagggggactggaggagggaacccccctttagggacactgagaggaggcgggcgcttctgggagtgagagcttctgcccggagctctgccagcctcgaggtggggaacgggggagggcggttggagaccccagggaggcgccggcaccactgggagggcccgggcggggcaggtcagtcatcctgtgggctgaagccggaccggaccgggcggcttcatgcccccagcctggccgcggagcccccgctccctgcaccgccgcaaacattctcggggcgcggcggcgcgtgcagagggcgagagcaggcggtgcggccccggtcctggcccgcccggagctccgggagctgcctgcctcggtccgggccctggccctggggcccctggcttccagcggcgcggccttgtgaccctgccccggtttaggggagcgagtagcacagacccaagtgtgggacggcgggaa

SEQ ID NO: 134031 - DNA, 1800 bp, Homo sapiens
acacaggatttgggacagtagccctttagacaatgctgggtgttgaagacagaacttcatcgtaaatccgtatgttctaatctgatatttatacaggctatgatcgtctcctgaaatgtttcccaattctttatatgtcttttaaagcacaatttaacatatgctaaaaaatttccttccgcatccaccagttttgaatttaaactcaactaagtctgccaggtcgtacaaaccacaccttaatcattctaagacaactcttaaaattaatctacttgtattgttctgcttgtaccttaactatggcataatgaatttgctaattcaaaatgttgcagagccagtaaccccagtgttatctgcagaccatctgaggtacttttaagcatttttttgaattctattgtttgctttgaaaacatggggtttaaacggtcaaggaaaatgcgttttgtctcgtcattcaggagctcttcgggacacgcctgcagtgttgcagacaggatggaatgcaggcaagagggttccaactcagagcgcagacccttgggaaaagcacttggtgggtcatcctgaaaacttcccatttccggcagtttttgatggcatggcagtcgtgacacctgaggctctcctttggggcactgtcctctgtggccgtgggtggccctgggccctcctcccagccagtcccgccccagagcttcaacaccactgcaggacacccgagcaaaatactctgttggagcagggaacaaacccacggctgcgctcggagtggctgctgaggctggatttcttcttactgattctttcacatatggaagaactgggccgccactgggaagcgagaggccagccctgctcggatcctttctcatttccagtgataatgcctcactctgaatttccatcagccgcaggcttattcatccaggagggtgcatctgcaggccaagggccctccatcggcattctttgcttaaggctgtatgacagtttgtccgagtcacctcctccggcccactgcacttgtgccaggcaggtgccgaggggccctcttctgtccctcatgcttcgtgttcttggatgccgtgggcctgaggtcacgccttcgtcagtccgggagggccttcaatggatctcaatatgaacctataggcggacgttgagcatcatggaagccacgatgtagaagtaggggaagttgatgcgcagccaccaggccagattgaagaagacagcagcttgcgagtcagccccttgcgtaagactccacaggagcgggcggcggctgagcgctagagccggacagccaggcgcgacagagccgccgccatatagagaccggcgctcccacagcccgcctgccctctccgcgccgcgtcgctcgggccgctggccttcgcttggcgggctcagggagcgagggaggcggcggctagactggcgggcgagcgggctgcgggagcggagtccgcgcgtcacgctcggagaagcacctccgcgagctgccgcctggtcccccagttcactgtattttttaaattttctttgagacttccttttgacccatggattacttaaaagtgtgttgttttgtttctagtcatttgaatatcttcctgttatctttgttattgatttctcatttgattccattgtcattacaaaacacactctatatgatttcacttatttaaaatttgttgaggcttgtttgatagcccaggatatgacctatcttgggatatatattttgtggtcatttgaaaagaatgtgtattctgatgttgctaa

SEQ ID NO: 134032 - DNA, 1720 bp, Homo sapiens
tttaggaagaacatatctcagaattattagtgttgttagttggaaacagtgcagaagatgttccattcagttgaaatgctgcaaattcaaagccatttctgaggaagcaaaagtagtttttgttctgttttgagcccacagtcattcattcactcatctattcaataaatgtactgatgcttgcttgggattagccacagcagctcctaaccctttgagctttgagctccccataaaatgggcagattagaatatgatctctaagagtcctgcagatctttatacctcattttctagattctcagaaaagactcaggcaccattggagagcaaactggctctgcagttatatctgaaaagcacaaatggggccatgtcaggaggtactgcctggcctgacctgcctctgaatttcagggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcaggtaacggctcctgtttgaacctacgctggattcagaccccaggaagtaaataccctgaggctccctgggatccctgaggtgccccaggttccgcttttcctgctccttttctctatactccatgccctgggtgcccttgagctaggaagcccaggaggcttagctcccagtcaacctgacgatgggacccactcaggctttgtgtccttgtcctgttaactggtctcctgccttgttcctggaagtgaactctagctctgctagtggagttctccatatcccatgtgtttgagtctccaacccatatcccaggctacatggcagatgtcttccaagatgaggctacattttgatgattctgccctgctgcttaccacaagatctctgaggctctctgcctctctagggctcagactgtgttcattgctattcccaacactgcagatactcaattctaaaggacaacttacatcccttcaacctccctcatgtctgcaggagtcccagtctcacatgaatgtgccacatcttacacattccaggcagccctttcaaacactttggagagggagttcccctccctgagacccctcactccttcagtctgtctgctctgattctatcctaggtccccatgtctcagctaggtccagaacaaggtggttcctgttgcagaccctaatcgacaacccaagactcaccatgcacagaaaattaaaattagggcacagttcccaggagtcccaaattctgatggcatgctcggagagctgacgctggcccccatcatctgctccaaagccaggctaggacatctgccaccaagagagggctcaatctaaccagcagctgtcccctgcaatgaaatgggatggcacaggcaccatccatgcagatggcagacaacaatggtcactcatgggatggccacctgggctgagggatgaagtttcaggactatttcactcccttggcaaaaaagattaaaaaactaaagaaaagtctgttgaacaaactttacccattaatgacttccactatccattgtgggtaggcagccttggagagttacttgttaaaaagcacttagtttacctacaaagcagaattttatgtcactggagaaggtggtaaaatgtgtacatcaggagagttt

SEQ ID NO: 134033 - DNA, 1049 bp, Homo sapiens
tcatttgccttgcatgtatcaagctctgccccaggcacttgggaacacaaacaattaagacacttagagtctagtgtgggaaacagacatgaatataaatgatgtgtgtggggtttatttatgtgtcttcatatttggaaaaatcttcctacatatatccagtataatttatataaaatttatttttagtgagggtatgaggtagggatctatttctttttttcaaatagttatttgaccagtccctcacctgtctgttttgaaatgccactttcattatgtaccaagatataatgcaaattgcatgtttctaagttctctaccattttacctgtctgtacaactcatttaagtgttgtaacttcataatgcatttcaacatctggtgatgcaagtccttcattttttggttatattccaaaatgttctttgtttccaactgtttatttttgcatggtcttctttattctgttttaccagtttcttataagtgattaattggaattctgacatccaagttttgaaagaggctttcaaagacctagtttaaatttagcttttaacatacttttctctgagtgaatatgaaacatgaaagatgatgccaggttttatttttattttttctgattttaaattattttaatgacttgttttgctgttaaatgccactgagactttaaatgaaaagtgtagtgtttaaaacttggtatagactttgttatttacatttattttactttttttttttttaatatcttaggtttagcccaaaggcgtcccttcaaccacctttgcagatgcatctctcaagaacctctactaaggaaatgagtggtatgttttccaaacatttttgagatacatattggcttccggagtcaagaaacatatctggtggtggcttttgacatttgctctcaccttctcctgtttggaatatatccttcctcccctttttcctaattgctttgcatcatgaatcaaagtgatcttaagagaaaatggtgcctcccaaagatatcattatctaaacactgacttgaggc

SEQ ID NO: 134034 - DNA, 1140 bp, Homo sapiens
atatcattatttgggaagaacttaaataaattagctatacccttaataggaaatatatgtggatatcctggagccttctcttctctgtgccaatctaagacttagcaaggccagatcctgccctttgatggaagagcagagtcagcgtccaagtgtcctcaaggaatagctcactctgggcttcctggcattctcagaggcagcatccccaaatcagactgtctctacctgcaaattaaaaattactgaatcccagcagagatactatctgcttaaaatatgcatatattttgcatatagatggtaatatttaatatactcagatctgtatctcagtgaaatttcgtagagatttggaataaatttcatagttcttaaaattccaggactgtcagctatagtaaacactcagatttctttattttctggggatattaactctcacattctaagttttaagtaaaaacgaaatgcaaaatagctataaagccaaaactttataaatacacacttatgaaagataaatgattgatattggggaaataaaagttatctgtgggttccaaaccttttatgtttataaactgaggctaggatgatgatgattatagatggatcaattttttaacttttgtgtgttgctaaattatttgttttccattaataaaggtgaaaattgatcataatattcaaactcaggcaattttttatcttctacaaaactagtataagatcaaaaagttatttgatctgttaaggaattattcctatgttctgtggaatatagctttaaattcagtattgtctgtaaactaatatataaaatgcaatcttcctcagcaggtagaaaacggttggttaaataatttaattattctttatgtagcaagatcatcttgatgtttaaactatgaagcatccttgcaaaataaagggactaggttccctctttgggtgtttcttgacccacaagaaacactgctggttatttcagggttaaaacttagaatgaagttgtcacggtgctgctctgcctaatcctgctcccttctaagtcctttggctaccacaagcccacactatagcaaaacctgaagatgcaaatattaggtaatggggataatctaaaatgttaagcat

SEQ ID NO: 134035 - DNA, 1042 bp, Homo sapiens
atggagtctctgtgccctctctgggcctgccaccctccaggcagccctccaaacctgtcatcttggggttttatggaggcttcattacgcaggcatgttgattaaaccattgaccattggtgatcagcttgaccttcagtgcctcttccctcccggcatttgaatggtggggccaaaagtttcaaccctctaatcctgccttggactttctggtaagcagccctaccctgaagctctcagtcagtattagcatagaaaaagataagctctttggagattccagggattttaggaattgtatttaggaaactgggaaggaagaccaaatatatatttcacggtatcacagcctcacatctgccaagcctagtatttctgctccaaacttacagaaatccagaggggtgtgagggaagtgtctcattcaaattgtgattccaactgtggcagaaatcaaactgattatcatgaacttacgggaatagaaagtttaaggcgtattaggtacagcatcttctgatgatcagcaaaggaaagggcttgactccatggtctagggagttcatctttaatgttacctgtctctcctgctggaggtgggggtgggagtgtacacatggtacgtgaagttacaagtcatgctagttcccagtcgttggactgatggattttttgggtggacattcagaaccaaagagaaaattacagagccacaaaacaaagaaaacatgaaggacaaggataggagtattgtcctgagtcttctcccacagtagaggaggccttctgactccctccttaggtatatgcctgaatcaagtgggctaaaggaactagatgccgtaaaagttcccttttgagagatctacctgaagtggttagcagttgattatcacactaaggaaataataaaagccatgtttcaagtagatgttggcttgccttggtcatttgtgaagaccataagatggctgttctgtcttgggaaatgaggcaggagatgaacatgtaaatcttttcagatgcaccagagcccagtaaa

SEQ ID NO: 134036 - DNA, 1069 bp, Homo sapiens
tcagctggcctggcatggcagctcatgcttgtaatcccaactccttagaaggctgaggcaggaggatcacttgagcccaggaggtggaggctgcagtgagtcgagattgcgccactgcactctagcctgggcaacggaacaagtcccagccttaacaaaaagagagagagaaagaaaagaaaccccaaagattggaatgaagtatgtggaccaggtattttttccatatcactaaatttatctgtgaatatttgcctaaagtgttgaaggatatctgaatcaattccaggtagagtcaggttcggtgccttgttaggcctatgtttaatcttagtaaatgcttatttgaatgtatagaagccaaatcattggagaacaagtgaaatgtaggcacataactaactgttttgagataaaagaataaaccattaaagactggaaagtgcttacaattcaaggaactggtcattagagtgggatatggttatctactttaaacaataagaataatataaaactgctgagggaaaaaatctgtcttctaattcagatgattatttggctatggtttgtactttgggtaaattcagacttattggtcaaaaattcactttataggctgactggcaaagtttgacttaaatgctgcagacacagccctggaagcttagtacctccagatgatctttaagtattattctggaataaaagccagaaaaaaatgggaattctgctcttgccctggaccaactcaagtggacataacgtccctaacttcagttaagacagcagttcctatttggaagaacttgtgctggtcatgtcagaggtcattgttagaggtttgataggtatgttattaggtaattggcactaatcacatctaaggcacagatggaatggcagtctggggactgggagaggggagactaagcaatgaagcatcccagattctcagtacactccttggaaagaaaaagataataaagccgaagaaccctcttaccttctttgggttagaagaaggctatatggacagtgggggatggggcttaggaagttattttag

SEQ ID NO: 134037 - DNA, 1101 bp, Homo sapiens
atggcgggttgcaggagaggagagacacagtcagagttgtgcttggtgaaggacatggtggagatcatcctcctgttcccctaggtgtcttaggatctacccagaggggcctccagccttgctcggggtgactcatgggtatccttgctttctcttgtgcttcaaggcccttgctgagatgctcaaggagaacaaggtgttgaagacactgaatgtggaatccaacttcatttctggagctgggattctgcgcctggtagaagccctcccatacaacacttctctggtggaaatgaaaattgacaaccaggtgagatgggcaacggtctcctcaggtctgttactacatgcagctcgctggcctgcagtgtttcccatgctgctggatggagctgagaatgctgatgatagaagctcagagcccagctttgagggacctccaaggtccctaaagttcacaccctctaccacgctcaccttccttcttcatcgcttccactacgtgctcttccagttctgattgagtccctctcatgatgggggacacactccttaccaacatcatcacttccattcttaggcaatgagaacattcttccttatatccggtagaagtcagctccccgtaagtcctgtttgttgggcttagctctgttctctgcttcactcaggacatctgttgcacagatctcatggaccactaagctctccttctccaggttaaaattcccagttttcttcattcacccccattcaatgcggcttttgaatttcctcaccattcacattactctctaggcaattctagtttgtctttattcttatggagttactgtttctctgtaacttctgtgggtcaatcattttatctgcggggcaactctttcagctctgactttctaagaggatgctaataacaacatcttacatgttacatgtgttgagagtgtactgtggaccaggctctgagatacacatcttacatccatcatctttgatcttcacaacaaccctacagaatgtgggtatcatcagtctcagttttcagaaaatagtccagacaggccaaagataagcccctttttcagggccatagggtca

SEQ ID NO: 134038 - DNA, 1127 bp, Homo sapiens
tttccagtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcct

SEQ ID NO: 134039 - DNA, 1056 bp, Homo sapiens
tattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaat

SEQ ID NO: 134040 - DNA, 1106 bp, Homo sapiens
gaagacttactatttggaaaccttccccgggttccacaggatctacgagattctagtcagcaaagggagcaatgcctgtccacgtgtgtgtgaatgtatgtgtttataatgatggcttttccttcctccccagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatg

SEQ ID NO: 134041 - DNA, 1047 bp, Homo sapiens
cagtttacaaagcctgtagtcagccacgtacttgcccagctcctccatgtacagtgacaatagagcagtggccatttcctgacctaccagtgaccatacaatggaccagcaaattcacatggcaatttagatcccagttgcctggtttttatcactagggttaggccaagtatgaggatgcaaaattctttgactagttatttctaaactaccaggtctccattgccctcattttaggaggagggagattgaggatacctggaattactggaattactaagttatttcatcatgatcatcaagtagtgttcttttcagacagttgtaattatgaagagaagagatttgggtggaaagaaacaaagcaacacgtaagtcaggctgggtgagtcatgattgggttttggtttttttgtctttgttttaatataatttttttggtttggttttaggaatccatttatccccaggtgaatttcataaagaagtagaaaagtttttatctcaggcaaatcaagaacaaagtgatactatccttcttgattgcagaaacttctatgaaagcaaaatagtaagtaaaagccagaactgagttctctgaattggtagatctccccattcccacagtgtggtatatttcccaaggggaccttgtgtgtgcccacctgtggccacatggatctcctcccagtactggcagcttcagagaaaacccaagtcctaaaactcagaaatctggtgagagagtctaagaaaatatgaattaaaggcatccaggcacataatatactttgtgactcccatgagcctgcctttgacatgtatcaaggatcttgcaaagttgcctttgggcagcctctccagttcccctgaggaccctgggaaggtgacccacagcccacagcctcggttttaagttgagatcttgaagttgaaaggtcagagtggggatgagattagcaactggcaggggcttctttgctaagtagggtttgttgggtacaaaaagaacctttgttcctaccaggtatgtttttctgataattt

SEQ ID NO: 134042 - DNA, 1092 bp, Homo sapiens
cataatctggacaataataattgtattcccaagatatatttctctgtcctctttatttcctataagttgatcattagatttagagtagtgctaatagaagtataatgtgagctacacaattttacattttctagtagccatgtctttaaaagtaaaaaatagatgagattaatttaaataatatggttttcttaatgcagtatatcaaaaatattatttcaacatgtaatcaatataaaaaattattagtttactttttttcatgctaagtccttgagattcagtatgtatgtcacccctattatagcacaagtgcttgtcagccacatgtggctagtagctactgtattaacaaccaggactagagacttgatcagattccaatttgatttctttttctcccgccaccaagactacataagcactgttgtcttctttgatcaggaagcacaaaggtctggttgactccatggtgttcattttgtaatatgtaaagttttgaaagaagtctaagagtgaagccagggggaaacgggattaggatacaggcatctgggaaagagactcatgcatggggagatgagggccagaaagagctgttgtctgcttactgttcccatcttagcaggaggcagtatgactacaaacagcttttcctgggcactgcaggacattgcaggcagagagtgggctctaggcagtgctgtcttgttttcacttgaaggaagtttaaagggacctctttttctttttttgagacagtcttgctctgttgcctgggctggagtgcagtggcgtgatttcagctcactgtaaccttttcccccggggttcaagcgattctcctgcctcagcttcccaagttgctgggattacaagtgtgcgccaccacacccgggtaatttttgtatttttagtagagatggggtttcgccacactggccaggctggtctcaaactcctgacctcaagtgatctgcccacctcagcctcacaaagtgctggaattataggcatcagccaccgcacctggtaaagagatgtcttttaaacacatccatgctggtcactgtccaaacaatcgttctcagg

SEQ ID NO: 134043 - DNA, 1065 bp, Homo sapiens
aataccctttcccctttattttttggggcttggggagtttttttgttttgttttttgacagggtcttgctctgtcacccaggctggagtgcagtggcgtgatcatggctcactgcagcctcaacctccctgggctcaggtgatcctcccaggtagctaggaccataggcgtgcatcaccatgtctggctaatttttttgtagagacggggtctcactatgttgcccaggctggtatggaactcttgggttcaagcagtcctcccacgtcagcctcctatagtgctgagatatggacgtgagataccgcacctgccccctttcccctttaaatgtgcttttctctttaggttacgagacagtacaatagaaggagtatgctcgtccccattctttcactgagtcaccatatgattttggaccagctagtgctctagacctcagtatcccttcttataaaataagaatgttacagctcatgcaatctgggactccaaatcttggacatattagctcacttgagagaccaccagcctggtcagcagatcactgtgtttttagtaaatctggaattgtaagattaacacttcataccacatgggggaataaagttgttgctctcacaggtgggctgctttgtttgagtgactttataccttgtcataataagtgataaggtgatgggaaatgccttgctagcgttcatgctggcaatgataggaaaagaatgaaaaccgggtatagtcacatgttagaattgctcagcggtgttgcagttttataattaaatgcttacacctaaagaaacactttttcagcttaacattcctgcacatggcaggtatgcagtaagtatttatcaatgttgaattatctggaacattctgggccctaactagaggttttttaagacttcagctattgttattacaaaacagaccatcattcttatattggcacttgtcttatacctggagatgggacagcaagactgtattctgttttgtttctcattggctagaccagcaaaggaggagctcactgttttccagaattgcgtgttggtg

SEQ ID NO: 134044 - DNA, 1080 bp, Homo sapiens
aagtactggtatatatcagtgttatatgactagaacaatataggaccttgaattaaatcatctctttttccagacagtgccatgatgccacatgtgctgcccttgctagcacttttctttagagagctcagttccctttaaagatgatccatctttaaactcatccacaggattttgtagtacgaaaacaaccaactctgcagggcccccagaacactgcctcttaaggctggggctttaccccaggctctaatgtcccctaaccaggggagcatttcaaagagaatatgggacttgagatgccaaagagccccagatatggatgcatattcatttattcaacaaatcgtattgagtgcctactatgtggcaggcactgttctaggggatatgctggtgagcaaaacagacacacacccatgtggaacttgtattccagtggatggtttgcagtggtaggctgtcctccaaacaccatgcagagatacatgctcatgtataccctcagccctcagatgtactctgtgctttaggattttggtagtatctcctcagcagttcttttcatttctggtgctctttagttccctttttattcatataaagaaattaagattcagagaagtcaattaactttctcacagctacatgcaagtgagtggcagagcttaatcttgagcctagatctgctgacctctgtggaggactctgttaagctacctggatttagattaagctcagaattcacttctttggctgttggactattgtagctccatagcaaatggggctttccaggagttttattcacattcttttgttcagcatgcatgaaacagaatacctcatctgaactgaaggctatgccattttagaaaaatacaagtatccagctgggcacggtggcttgtgcctgtaatcccagcactttgggaggccaaggcgggtagatcacttgaggccaggagttggagaccagcctggccaacatggcgaaaccccgtctctactaaaaatacgaacattagctgggcttggtggcgcatgcctgtaatcccagctactcaggaggctgaggta

SEQ ID NO: 134045 - DNA, 1899 bp, Homo sapiens
tccctgcctgccacttaatccattctccacacagccataatgatcctaaaaggtgaatcaaatcacatcactccctcctcaaactctttcagtggctgccacttctggtgcatatggaggaaatccagtgccttaaaaatgcccttaggttcctgcgtgagttggccccttcttaccttttcctctcgtctgatactgttctttgctcattatactccagcaacatggtctttcagttttttggaacccaccgagttcttttctctccttgggccttcttacaagcaaactatcttcaaggaactctcctacacccactctgctgctccagtctgatttttactcaagcttagttttcaattttcatgacacttcctcaaagagacctttcctgtcaatctaaattcatttttcccagtgcactctctcatggcatcttgtaattgtttttcataacatttgtccatttgtaacttttattttaatatctgtgacctcccatagtctgtaagctcctaaaggggaaaagctatatttttttcaagcactgtatccctaattcctagcacaattcctggtgtaaataaataaataatatttaatactttcatcaccattcctattcagaaaacttccacaccctgaaagatggatactctcacagtaaacctgaatgtacaaggtttgaaaacagcctcttggtttagaggcagatcatttttcttggcccaacccaagtgctaaattagcaatgagggatcttacccacaaggtggcagcacttgcctagatcttggatataaattcctaggtgtcaaggatacatgcccagtttaatgagagttttgtgtttggagatttggcaaaatatcagtgcctaagtagggaaagagaagaacctgacagttgtagaattatgggaaaaaagcctctactctattgctgtgtattctttattgcctcaaaaaatttgaggggatacattgaaggctttggaaaggaaaagttataagattgggagctagtaagatctggttttgaatcccagatttaccagctatcagctataccactgggcaagttacttgatttctctgagcttttgtttccttttctgtaaaacggggattatgatatctgcctttcaggattataatgtaatgcttctgtctcatagcaagtgctgaataaatgctaatgattgttcttctcagtttcttacaaggccttcctcactaaggagctttgaaggatttctgttagagaatcctgggggttcaaagtctagtgcacgagtttagagcatgctctgccctagctatatagggagcagatgtgcttgtcttctctttgggttctgagattaaaataaattagaaaagaatctactagcctaccccaagagaggtacttagacatacatacttcatcctacctgctgtagtcagaaactcttttggagtgggttttctgactcttacactgattgggctctatttttctatgtagtccactataagttggtagtggggacagtagcctgtgtagcagagatgtcacaggcttcctgcttccctctcccatgcccagaactggcttcactagactgcagcactgtttctcaaggagtctggatgtgacccggaatctttgtcatggaactctggaaaacattttacagtactatacgtagaggtgtgattccaagcttcttaattttctagaacctgccagggtcatttaccagctcagggtattgacatttgctgtttccttcctctctagagtgctcttccctgcaccttcacatggcgcataccccacttcagatctcggctcacatattgtctccttagagctgcagtctgaagtagtcctctccagatcttgtcacgttct

SEQ ID NO: 134046 - DNA, 1065 bp, Homo sapiens
aggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggtatgtgctcatctactcccactttccggcttttgccgccttgggaaaagtgggaggagaggttgggccaagctcggcatgcggggtggggcctgggcgggaggcggtgccgcacgtgccgccccttggtatggaaaggccggccctgacgcgagcgtgcggctccgggcttgccggctggccgtcattttccttaagttgtttgcttaggaaggaacaaatgattgttttagtaatctgttttcaagggttattgggtacctatatgcctgtgtgtgagcgtcccctcccctgatgtctttatgagcaccatactggcttatctgctttgtccatggccatctgaaatttcactctcccggcctaattctccttcggtcttacccatttcagtaaatgacgtcatccgtcggccgcttaatccaaaaatttagagtctttcttagctcttttccctctttttacataacaattatctgtaaaccctgcctgctctgctttcaacacaaatccagaatcagatcgtgttactgctttgtttaaaagtctcctatgacggccgggcggggtagctaacgcttgtaatcctaacacttatgggaggccgacgcgggcggatccgcttgagcctaggagttcaagacccacctgggcaacaaggcgaacaccgtctttacaggaaaaaaaaaaaaattagctgagcctagtgtttggcgcctgtagtcccagttactcgaggggagggttgggggccgaggtgggaggatcccttgagcccaggaggtcgagaatgcagtgagcggtgatcgcacactgcactccagcctgggcaacaaa

SEQ ID NO: 134047 - DNA, 3586 bp, Homo sapiens
ataggtgggcagcctcacaaaaggagaaagacctctgatgcaaatgaaactgaagatcatttggaatctttaatatgtaaagtaggagaaaaggtatgtcacacaataggcacaggctgtgatgggtttaagaatgtggttaactgtgctttgattaatttttgcagctgaaaagttggactacattttggcaaagctggtattaccatgcatctgtatcccaaattgaatccatgttgaagcccctgggatgtagataattgatcatttttagtactttagtaattaataattttcatagaagatgagcccttagaagggacctagggtatagaccccttaatttatgcatgaactaaatcagccctgaatacttgaggtaatttgcccagagtaagagagtgaattagtaaaagaggtaaaatggagcccatggtgtcctcccatttctaatacttattctgttatcatagactgcttagtttttaaatttcactcgtccacttttcatggatttctgaagaacaataactatctgaattgatttatactaaacccattatagctctgtatgcatgtaagactattttaatgatcatgcagaagtttttattttagttcactaaaatagcaattgaaaggacagatgattggtaatgattttaaaatgatagattttaaaatatgtatatatttacatttaaatagatttttaaaaataaatttatgttgctgagtacttgacagatatttaatgtgatgtcctctacagagtgcctgctctttggagagcaacctagaaggcttggctggtgttttggaagctgatcttcctaactacaagagcaagatcttaaggcttctttgtacagtgtatgtatgcaaaagatttatgaatccaggtgataatgtattatctactcttaaatgctttgggaaatgttcaaaatacatgtttatgttctatatgtccttggctttacttctatggggaaatttgtacaaatgagccaacctttggcgctttggcgaactctttttcttagggataaaactaaaattgaacattttccttgtatgttcttacaaccttagaatcattttagttgactttttatagagatagtagatactgtctcattcagatatatatttttaagcatgtacatttaaatgtatgatacttacatttttaaattagtaccagacaaatttgggaattggtaactcaggtaatagcccttcttggaagactgaagatgctttggaagccactgttaataggcatactctctggataaatgggagtctttgtagttacatgaaattgtaatgtatccatgaggtgtttttaaattatgaaggtgatgtttatcacttctcagccttttagtttagatcaagtgaaggtaactttaagaaactactaaggaaatcttctgaaatcctttattaaaatggagtagtatttacacttaaactgttggaagccttgtttgtttaaggctgaacttgtattgcttcgcagtgttcttttttaatttttggttttgggagggtttcagggaccacagttaccatcaacacaggtattttttttgaagaccttgattgtccctgatgttctgctaggtactttaggaaaacaagtcaaagagaatctcttgcccacttaatgattatgaattcttattgctttttgagctaattctaaaggctgcctaaattaggaaaaattgctttttctaaaggtttattgtaatcctttcccatacttttaaaataactttaatgaaatcagcacacttggagtaagcaactgagacgtaaacaaatcttaactatatcagagtatgtttttaaaaaattcaataattaaactggtaggaacttagatgaaactcgttttaattgtgcatcttttctaaacaactagaatagtgtttctcaaagtagaattctagttccatgacatttggttagctaagtttagaaattctgaatgctgcacgcccccccttaatgattctgtattaaagaggcttgtttcacccaggatttctgagctattttaccatggaaaccatgttctgtggaaatgctattcagttccactaagcacacttgaagaaaaactgttgtagcattagttttatttatttcagtatgataactttacaattaaatcatttactttcttaactcttagattaactgatgaattaaaatgaaaaattacgggactatgtctgtaacatttctcaatgacatgctttttctgaagtatttttaaagacatagctaaaagtaatcctgttccaaagttaatggaatgataaaaagattcacataaaattcagcaacttaacgccattgttttggggttttcttgttatactgggttcttaaatcagtgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtaagttagtttgtttgttggtatgttatgactactgttgggatggagggaaaaggtgaactacaaccaaataatttaaaatgctctcctaaaacattctcattcactttcatagcttcataagccacctttattttgacgatacccccaaatctgtaactgtatctccaacctttctcctgagctccagtccagtattccagatgctagctgcatagccttcagataccttactaggaagtgcctaaattaatgcatcattcatacctccttttttctgccctctccccagctcatacagtggccactgtgtactgaataacccatctagaaagctgagcattaatttttgtcttccctttgccctctcgtaccataggtgttcccaatccctgtcaattctgtctccctaatttctctcaagtctgtcctttcttagtctccagggcctctagcatagtttatgccttcctccagatgttcttaatagcctcttaactgatctttttgcatctagattctctgcttttcactttgtgttctacagtggcaccagactggtctttctataactaggctctgcacatgttggttactggttaaaaaaaccttagttccttcccattgtctacagtgagtggtcttaaaagcctggtgcacaagatgattccttgggtttcaggaagtgaatattaagaactcttatttatcttaagtggaaatgaaattaaaccttactaataatacatagattaatggtgatccagtgtatatcataaatacatatgtatgtgttgaagatatgtgatcaaattcttttttactgagtacacaatcaaaaaagtttggacacccatcaggctataggattaaagtccagactctttagcctgaccctttatggtttccccagtctgtttctctattcttgtctcccatatgctccccagcaatatcaaaataacttgcagatccctaaacacaccttgtttttgaacctctatgcctagactgc

SEQ ID NO: 134048 - DNA, 2025 bp, Homo sapiens
aatttccatttctgtaattcagtgaaaattacagccaaacagaaaaggagattataggttgaagtagctagaatattttacaatctggattcttgatgtagtatagcatagaaacgtatgaactcacagattactgtcctttatatagtctttgttacaacttctcaattctgccattgtagcacaaaagcaaccatagacaatatgtaactgaatgagcgtggctattccactaagtttacttatgggcactgaaacttgaatttcatgtaatttgtatatgtcataaaatactcttgatttttttttcacgcatttaaaaatgtaaaaaccatttttagttcccagctatgcaaaaaacaggtagtaggctagattcagcccttaggctatagttttttagaccaatagtttagcctatacaagattgcttattttgtagttattataaagaacatttaggtttaatagcagaaattgtttgccccaacaggtccgttttttatctgatcttgtgaattgtcatgtgattgccgccccatcaatggttgctatgtttgaaaattttgtaagcgtaactcaggaagaagatgtacctcaggtaagagaacccctcatgctgaatcttgaggggttcttgaggggttactgaatcctggtacttccatatagtaccaggaatttttcgctgataacccattagcaataaagaaaaaaataacagcagactatcacactttaagttcttactatctaaaaattaagctgactggcacactggtgggttctcataatatctgtatgttgatttaaatgatgctgtctagtaagattagaactaatatatctagaaatgctctgtataaaccagatgtcttatttaagtcctattaaatagcttccataggatttcattcaagaataaataaaatatgaatgaatataattaaagcatattttaaacttaactttttaaaaatcctttaggtgcgacgagattggtatgtgtatgcatttctgtcatctttgccctgggttggaaaggagttgtacgaaaagaaagatgcagagatggaccgcatctttgccaacactgaaagctatcttaagtaagggcacagctcatagtactctttgttgcttaggtaaaggatatcttatatcagtgataccatttgagtttctcaaaaataagctgtagagttcctgaaggtattttctaggtaatcctgttctcctgctgttttaactcactgagacctcaaagtagtcagatatggtttgcttacttttgccagtgcaaaggacagttggcaatatagcttcttttaagctgcttttatatgtttgtttataaaagacataaaacaccctagtgcaatagttcctcaaatattagtgtggataagaattacctgtggtacttaaaatactcagaccccaacccccagacctgataaattatacaatttgagagagaggtttggacatctgtattattaacacatttcacaagtggagaaccactgtcctagcacatacagtatatttagttcatgtaaattaatcttaaatcaagctcttaaaacagtggtccttaaccctccatccagccagtacttcttaagtaatatgacacatttcaattaaaatagtcacatgtcttcccattactcatctctcctaagccaatgtaaaagcttggtttatattgttagatacaataataataaataggtctttttagtaaatttatgcttaactatccagcaacatggtaatggttatgtggcccttaggtttttacagattgattttgttgttaagtttcattttctcttttttaagtgctttttttggataactgttaatagctacttagttggttattaagtaaagttaaaagaagcttaaaaaataagaatcttttggccgggcgcagtggctcacgcctgtaatcccagcactttaggaggccaaggcaggtggatcacccgaggtcaggagtttgagaccagcctggcc

SEQ ID NO: 134049 - DNA, 1214 bp, Homo sapiens
gacacgacctcaactcagtgcaacctccgcctcctgggttcaagcagttctcctgcctcaggctctcaagttgctgggactataggtgcccaccaccacacctggctaatttttgtattttttgtagagacagagtttcaccgtgttggccaggctggtcttgaactcctgacctcaagtaatctgcctgcctcagcctcccaaagtgctgggattacaggcgtgagccactgcgcccagcctaagagttcttgttatttataggaatgaaactgtcatggatcttttgagcccctcaaaaagctgtacatcctggctcagctgtggtgctttcaaagttggaatttaattgcatagttctctgggaggagtgtagatcgaataagcattagtgtcgtgtgtttttatttgatcgaattatagagagaagaaattttcattacagttttcagttttagatttttgtgtttgaaagagcataattttaaatattaaaaagtaattccattttcatatgaatgccatggagttagagctcagatttagaatgttaaggtctttctaatagaagtgcaaagatagcagttggattgaattgtgactcatgattcttttgtaggtgatctttgcagagctgtttcaacttccagcaccccctcacattgatgtgatgtacacaacactcctcattgaactgtgcaaacttcaacctggctctctaccccaagttgtatccttttctttatttttaaacttaatctctttggcctggtcttaaaagattattaaatatttctgcttgtgggtttaaattttgtaggtaaaaaatgtggcttttgaagtgtgttgtgtgtgtgtattacatgtatgtacttgtatgtctgtaaatacatatgtacctatacatatgtagatacatccttcactatttgggtcagggagttcaaaaatagacaacaataaaatttgttgcctagattgacttttcctctcacaatagatttctctgaagcatgtgatgcttgctgtttgatacagcattttacccacagtagaacttctttcagagttggaattaatcttcccaaaccctgccactgctttattagctaagtttctatgatattctaaatccttcgttgtcattcagcagtgttcacaaggagttgattccatctcaaaaaaacactttctttgctcatacatagaaagca

SEQ ID NO: 134050 - DNA, 2705 bp, Homo sapiens
tggcttgcactgaggtgcgggtgagtgagctcatgagcctggtggccaagtatgtggggtgatgatggggcatggtggagatgactgcacgctttggaaactggctatattctatcaaataaataaatattgaggataatggaagccaagtttgttactgcctgagaaggtgtttacaaatcatggtagagaagaagtgtagaaataaggtattgagttggaattggaggcatatatacacacaggtggacataaaaacagttatggatggatggatgtgtgtccaccaagaggcttagaaccaatgacaccccaatggcaatgagcatatcaagtgcccagatcttggctcctaaataccatattccattactactttactagaaactagggctccatgaataaatagatgattccagtgatagggcaagaaaacgcaagatgatcctaaatatgttgttctagaaaataagggaatgctcaatgaatggctggggacgttaaaaaaaaaaaaaaaaatatatatatatatatatatagagagagagagagagagagagcttaccggggctcctcatgtacataccagggacaatttgggcatcaaaataaataatcctcatagtttataacccatcgaatgaaatataaattaattagtccctactgatatataaataaaggaataaataaatgggggagaaaggacagctcttacagaaggcccactaataaatgtagaaaaaataatggaatgagaaaatcatcacttggcaaccatcttagtggtagctgctaaaagcaggatggagatctgatgaagaacagagtaagagtaaaacttcagaatatctaaaatacttatcaattctactaaagggaaaaatggtgaggttaaggtagagaaagctggcagatattgacatgaccaggtggatcaggattaacatcaccagtggtgggaatcatgtgcctctagaagtgacacaccaagagcattaacaatttaagacctcagtctgctcatgagaaatatcagagcaatccaagtaaggtctagactctttcaaactggtaaaaacacaaagatagaaaaaagagttaagtgttcaagactgaaggaatctgaagagaatgacaactcaacactatatatgtacctggataagatttcagaccaggctgggcacggtggctcatgcctgtaatctcagcactttgggaggccgaggcgggcggatcacgaggtcaggagatcgagatcatcccagctaacacagtgaaaccccgtctctactaaaactacaaaaaattagccaggcgtggtggcgggcgcctgtagtcccagctaccaggaggctgaggcaggagaatggcgtgaacccggaggtggcgcttgcagtgagccgagatcgtgccactgcactccagcctgggtgacagagcgagactccaactcaaaaacaaaacaaaacaaaacaaaaaaaacactccagaccagacaggaaatacaggtgttgggacggctggcaaaatttcagcagcacctgtgaattatgtggtaggattgtaccacagctaattttctgatctaaaaggttgtatgctggctaggtaggagagtggttttgttttgggaagatatgtaatggaacattaaaggataatgggccattacatcagctgggtatgcagcttattctcaaaggaaaaccaacgtaatgggtctctagggagagacgaaaagggagtgagcatgagagcaaacatgataaaatgttaatagctatggaatctaggtgaagaggatacagaattctttgtaatgttgtgccaacttttctataaatctgaattcatttcatatataacaccttttttattttatttttttgagataagagtgtcgctctgtcggccagattggagtgcagtggcgccatcttggctcaaaggactctccctcaacctcccaagtagctgggattatagacgttcgccaacacgcctcgcaaatttttatttttagtagagagggggtttccccatgttggccatgctagcctgaactcctcacatcatgtgatccacccgctttggcctcccaaagtgctgggattacaggcgtgagccactgcgcccggcctgtgacatctttaaaagaacttattggcttaaattcacatggaatctatatggcatggttgcctaatttttcttagcctaagtcttgattaaaaatgggatggaagatgagtaagtggattttgaatccaatattctgaacacacatcacaagtgcagagaagagaaagaaatcctcccaaagaagttaaaaggagaaaacacaaaaaacttacctcatacatttttctagaacttctcttacaaacttcggtttgggactttcaggatcttgactaagacaatctgacctaaggaggaaatgtagttttatcaatgcttacatataatctgcacttacacccatttgtactataattatctgttaacttataacaacttacaagttttgttaagttataattgcacttgtaactatttgtacttaactacaaatagtttccaagaaattaaatatttcagacacttttatgttacagttttaaacattagtagttttttgactacagaaaaagataaaacaaaccatcacttaccaatcttcccagctccaacggaac

SEQ ID NO: 134051 - DNA, 1456 bp, Homo sapiens
aaagcagatttcttgttgctctggtgatgccttacggtgtatattagcacaaatttttataataaggactcaactgataccaaccaatagtaaatacaaggagtcccatcacgtgagcatctgacttacgtagattcaagcttgtggactcagcaaaaaagaaaagtacaaaaacaaaacctctctgaagttggcagccattaccttgttgagactcagacttcatttccacggtcccgaggaaagaaagaggaagtgggtgttggcaaaatgaaagagaagtacgttggttctgggattttgagcccaggagagttgagggcattaaaagacagtttaactgtgtccacttttctccttaccattcatcttgaggatgatcagcaccttgtgctctaaattttacttagctaagtgtccttaatgaattgttgaaatgagaattgtccctttttaggtgaaaaaccattaacctattagaaaaagctttcacatacggtatttatatgtgattaaatattgaccttgggataaagagcatcctattttgaaaggaagaatttaaaaaaaatttttctcagttatttaactgttcattagaatagtcttgaaacctgatctgtcattccccttacccccaattctgtgtttagattctcttcctggacattctgttgccctctgtttagctgttgcctttaaaagtaaggcaaccaatgatgaaatcttcagcattctgaaagatgtaccaaatcctaaccaggatgatgacgacggtaagtggaattcagtatttcttaagtggaactatgtataggccaacttaaagcataaacataactctggcaacatgatgctcttaaagcaatatatctatatctgtttgacctgttcagactgttgttcttagcaccccaggtattttccccttatataaaaagagatcctaacatttctgtgatatagcttacttaagaatataaacttcatcgtaaatacaaagtgaaatatgttaccattcaaggatttttaacccctgctttcaccatagagaagttcctgaatagaaagacttggtgtgttataaagttggatgttttctccaagttaagctattagaataataatgtttaacatttactcagttatataccatgtaattccaaccagaatcctaggagtttttctgggcaagagtgggaaaattgacaaaataatttatacagttgcctgaatcaataaatggatatgcacatagaaaaactactgaatcaaaataagatattagtggcctttgggtatttattactgggattttgtttggatatctctaagaaatttgtattatgatattagagaaaatgagtttagaaagaataagccaaaatgatggcattaaattcagatgttgtcagacatcttaagacataagcttaagtgtttttttttttttttt

SEQ ID NO: 134052 - DNA, 1716 bp, Homo sapiens
aggagcaagcaggcactgctgccactgccttgaatcatgaattctgtttacatagaagttggtaagaactggattttttaaaaagctattgagcatccatttttttcatttccctttttatttttttaatgttggggattttcaggggtccattgttcctatcagcacttttttttccccttcctcttttcatcattctgcagcatgggtgggctgctgaaggaaatgttccacaagattgcttatatgctttttcctgacctaactacccccttttgtgtgtccacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagt

SEQ ID NO: 134053 - DNA, 1114 bp, Homo sapiens
ggcatatatattagtagtatgaacagaactcttaaaagatttagttttcactggtattactttttaaagaaatataaactttaatataattagctttttttctcattacattaaattgctgctgttaatcaccagataagctactgtcaattgtcctcattttcgaagagtttgaatttgccctgaagtttttcatagagttagacctcttgggtctggtttctttttcagttcgcttgttatttgaatgaaggatgtcttttgaggacattttccaaagtggttacatgagtgatatattttccaagtgtctctgtaaatagaaatgttttactgcttttgtgcatatgaatacctaagttctgtaacattactccactgtcttctggtgtttaatgtgcagagaggtcagtgtgatgccttctttaattatggcttcttgttgatttactttagaggttgttcccgccttcctgaataggccacaaagggctgagactggagtagacactgtagagattagacacaaggagcttactgtgcagttttctcagaaggctcagaacagagaggaataaaagcaagtctaaaagtattttagttgaaaagaaattggaacctggttcctcttggtcttctgattttgatccacaaagaagctgacacagtttacttctttatgggaaggtaagagattatatttacctgctttgagaatatgatcttctactttagcagtttgagaattgatcttactaccaaaaagaattttacagtttaaatagtataaggtgtgtatagatagatagatagatagatagataaaaataaggtgaaagacaagaaagtgttttcttgttagtgaattcaaattgttctgccttgttagatacaaggcagaaactgctgttcagtttttttaactggtatcaaaactctgtatcaaaatattcaaaggaccgatagagagtatttggagagttcttttgaatttggccttttaatcttttcagtgccctacaccagtccttcctctcttcagtagcaaggagagccttgaaggataaagtagtgaacaggcatcttaaggagtctgaaagagaggactgttaca

SEQ ID NO: 134054 - DNA, 1083 bp, Homo sapiens
gtgtgctaggtaccatgatagtgatgaacgtgcggtgctgcaggagcacagaggtcactttgtgctctatcacagaatccctaaaagagtcttaaaaaaggaaacatacatgttcttcatgcagtaattatgcagagtcccattgtagtgtacagtgtgtagagataacacatactttatgtatatattcggttttatatatatactaaattaattcattgaaagtgaacgtcctatccatataattttgctcatgtttttaggattcataagtggttttggagagtgaataaggtcagatgtcttaaaaacaaaaaagcaaaaccaaaaattgaatgtaagccttccttgttgtgaggaacacaagttgttgtaatccttctcattgtgaggatttgtttttcctttgtcattacaagtgtaattcagttacagtgcagaaaagagaattacaaagagctcttattgcatgattttcctactcagagacaatcatcagcaacattttaatttttgctcttcctgttcttttctatcctaagatccttaaatttttttttaaaataaaaatggaagcactgtttgacacgaagttaagcaactccatgatcaacatccttatacacatctttttatatagttacttagcaattcctgaatcacaaggtaaggcacacattcatggctttgtagagaggtttcctgtaataagctgtgccatataagagcatttcattaaagaaccttcccaaaattagccactgctgtattgagaggatttggaaagagttctgatgaatttggccctttaatcttttcagtgctttacaccagtccttcctctgtagtagcaaggagaaccctgaaagataaagtagtgaaaaggcattttaagaggtgcgaaagggaggacagagtgatagattagttatatactagcctagggttttttgttaactccagctacctgaaatcacctcaactcttacctctttgctgcctccttaaaccatttccaggtggtattttggtgcagataataatacatggataaaataataagtattaattaaaaacctgtat

SEQ ID NO: 134055 - DNA, 1051 bp, Homo sapiens
attctcttaaaatctaagtaaatactataaagagtaaaggtatataatgtaaagttttaaaagtagaatgaagactttttacatcatcttggtaccaaaattaaaaaaaaatatatcctgcagatcagaagtcaagtcgatagagacaattattgatcttgaaggagatgagtagtagtaattggtaatttcctgcggttggagatttttggagatgacctcatatttaggtctgatgtggctaatctgtcaacaaactgtttctttggtgagcccaccacagttgatcaaactcactgaccacgtgtacttttgattcctgtgacaatacagtcagaggacaacttttctatttataatctaattcagcatacgtttactgacagtttcataggtttagatagatgttttattagagttgtttctgatcattaatatttaaaatctttaaatttctaataagtatttataaatttatacttgagttagatcattctttggtacctttggatttgacagttataactataatatttcgcaagtctgaatcacaacttatttaaatatggattttgtgttgtagattgtgaagaggtctcttgaagtttggggtagtcaagaagcattagaagaagcaaaggaagtccgacaggaaaaccgagaaaaaatgaaacagaagaaatttgataaaaaagtaaaaggtagatggccacattttatatcgtgaaggattgtgttttaccattttgcaaaaagcctttagctagattcttcctgtttaatgtcaccaatagattggaatgtgttttttagaggttgaaaaaaatgacttacagtttgccctcagtatgttggtcttcaaggcactaagctcaaacctcacagtacgacatttctgaaaagcatgtacgtcatcatcttaaagtgaatcatgtttttatataggaacaatgtgaggatcaggagtggtatcactggtcaaggatttggcatcaattaaatcttaagtatgatcaacaggtgtgttataaaaaacacacctaccaacaat

SEQ ID NO: 134056 - DNA, 1130 bp, Homo sapiens
cttcattctacttttaaaactttacattatatacctttactctttatagtatttacttagattttaagagaatttacacactaagaattatgctcaggatacctctcacaatatgttaaaaggaccataatattaatcagcatagccaaactcaaatttaacataatcaagtgatacactcatatttcgtatattctgagacatcacgttttccgcaatttaacatccctgaaaatgctgcatcaccaatgcacttaatggtactttaacaactgtgagtcaaaaagtggtgcagaagaattggactctgaatgtaaagtttaggaataccttcataagtcttttgcacttgcattttcccttttatgtgtgcaaaagtcgtgatatatgacaaactataataaagtctaatggcactatttcaccaagtataaaaagcatcaagtgataagaaagcatatgttgattttaatcagcggcatttaaaaatatttaatggtacataaaacaatagtgaatgttctaatcaacagaatcttagtatttaatgaaattcagtacacgttttgttttacaatatggcttcttaattttatttggagatatgggattttctagtatagtatatattcaaactgtgctctaaagcaatgcctcccaatattttaagctaacagcacaaaaagaatattacaatatttgtaccactctgaggtagatacaagaggctgcttgtgactcaaagaaactggcctgggcactagcagtcctagccactaagtggatcaccgtcttggcacacctataacccatctgcagcaagtggagttgagacgatctgctctgagattatagagctatatggacactcgctagcattccagatgggtagagttagattttaggtatttatgaaattcttgaaatttttctttttttaaaatatttcttttttggtgggagatggaggtgaaagagggtaaggaaacagggcctgactcccattccaaccttttttagtttccaaattgtactcttaacatcacccaatagcaacaggtttctttcaaagtgccatattagaagcaaaatgaggccaggcgtggcggctcatgcctgtaatcccagca

SEQ ID NO: 134057 - DNA, 1070 bp, Homo sapiens
ctggtctctcccccattacccctttcgcacccctagggtctccttttcatatagtattttgctcaaaaccttctagtggtttctaaccattgtcttcaccattgcttgcaaggtcctgactgtctctgactgtatctcccaccactcctcaccatcgcttacttcaggtcttctagttacactggtcctcttgctgtaagctctctttgcaaaatacacccctgccctagagccttttcccttgctgttccctttgctaggaatgtttttttctctagataatgtaacttaccagaataagtaaaagataaagtatttttctgttagaattcttatgttgctaatttaaccatgagagttgcaggaaaaagtattttatatgtcctttttgctgtgtgtgcccctaagttgctgggctatttgcaaacttagcttatttaaaataactaatttatataatggacttaatctgttttcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacaggtctctaataagttgtatttattatttttcactctggtaaattcttaataacaaactagtcataattggtttggcttttgcttacagagtgtggaaaaactcttttccctagttttgcatatgcttcacagtcatgtataatgacatttaataacatgttttctcattttgcttttttcttttcttttttcaaacaataaggtctcactctgtcactcaggctggagtgcagtggtgagatcatggctcactgcagccttgacctcccgggctcaggtaatccttccacctcagccttctgagtagcacctggctagttttttgtattttttgtagagatggggttttaccatattgcccaggctggtctcgaactccagggctcaagtgatcctcctgctttggcctcgcaaagtgctgggatt

SEQ ID NO: 134058 - DNA, 1004 bp, Homo sapiens
ttttcagggcagaggttgtacacatctcttcctaggttgttatttcttaattctaattgtagattcttgtggatattttacacacataattacatcatctgtgaatagatgctgttttacttctttcttttcatcctttatgcctttttggttttcttgctctgttagactagctgggaccttcagtataatgttgaatagaagtagtgattgtggacatccttgtgttgtttgagatatattgaattcaaaggaattttctatttatgaacaaggtaacatacaggcttacctacttcaattgttgactgcttttacttacttttgtaggcatggctaatgtaaaagcagccccaaagataattgacacaggaggaggcttcattttagaagaggaagaagaagaagaacagaaaattggaaaagttgttcatcaaccaggtaaagtgagtttttcaaaaataagtatctagattggttattttgagtaacatgcataattctatgcaaagtgatgctaaataatgccataactactttaatcagtgagtacattatctttataaaagtgataaagtttggcagttttgctagtagattaaaaaaacaatcaaagaaacagccatgcatatggaaatgattatttaacttgtggctgatgtacttaggggttgctgctctctgttgttttataataggcagggttagccagtatattgattggtagaataaatactcaaaattatcttgataggctgaaatgaggcaccagaatccaagagataacatttaggacattcttttatttatctgtggagaaagaaagcagcttacaaagtataagatagaccagcataaaaagaaggatgtaactatgatctaaggttagtgctttggtaaatcacttatatgtacacatatcttcacagtgagggtactttcacactctttgggaaaaagatagaaacactttatttgttcataagtttggcagccaacagtgc

SEQ ID NO: 134059 - DNA, 1036 bp, Homo sapiens
tttggacaaatatttaacttcctggaggctcagattcctccttgagatacacttggcctgtatcccccacaacacaggtatgtagatcatacgggataacgtgtaagaaagcactttcaagtataacacgtggtgacatacttgagcctgtggactgttgtcactgaccactccaccctgtgtaccagaggctggggctgtcagagtctagtgtcccaggaccttccccaggcttctctatgatcccttcactcctaccttcaccacgtgtgaccaagtcccctggtttcccagctaggagagattgccagaaaggagctcatgttgatactgtacttgcttgctctttggaaaagcacgtattgattaatctcttcacctttgctgtaccccttttcctagcatggcctgtgtgactccagggccctagtgctgctgaggttggcatgggaggggaatcccataggaagggaatgtgaaagaaagccccagcatgaggaataagggaagttccacaatgcccatggtgtgggagaatgcaactcccaccaggcctgctgggccttctatctatccccattctgttttgtttttgtttttttgttttagagtcttgctctgtcacccaggctggagtgcagtgatgcagtctcacctcactgcaaccctttacctcctgggttcaagcaattctcctacctcagccccctgagtagctgggattacagacacctgccaccacacctagctaatttttgtattttttgtagtgacagggtcaccatgtttgccaggctggtctcaaactcctgacctcaagcaatccttctgccttggcctcccaaagtgctgagattaaaggtgtgagccatcatgcccagctcccattctgcttctggctgaagcttgtatctcctgacttttgcagccatctgggcaggcttcctgatgagggcagcttgtagcaagatgactcctgctgggagggtcaaggttgattgaccatacaagctgaacttctgctgtttatgggggt

SEQ ID NO: 134060 - DNA, 1170 bp, Homo sapiens
tttttctttaatagctgtctattattacaaaatatagatgtatattttgtaatatacacactcttgttaatggagggctatgttgttgttataataactgtgacaaacccccttagacacattcttggccacttatgtatttttatgaacaggatatcagaagtggatatattgggttagaaggtaagcatatttagaattttggggaactacttccaaattatcctctaaaattaaccaatgtatacttcaataatatatgcaaatgacctttttcttacacccttcccaacacaatatgttatcagttttttacatttttgcctgatggggaaaaagagtattttggatttttagtttaatttctaaatttagaaatttctaattattagtgaagctcaacatcttttcatatggttcttagctacttgccatttttttgtgaattacttattcatgttctttgcatagtgtcctatattgggttgtccttagtaatttgtaggaacaatttgtgtgccacagatattaacctatggtccattatgtatgtagcaaacgttttctcttaggctgacattttgtagtacataaatgtaatgatttcatgagttcaaatctgttagtttttcttcttggcttcttggttttgtatcttttttaggaaggtctagtcatgccaaatggaaaaagaaaggaaggtctggtaaaggtatttaacatttctgaacttcaatttcctcatcccaaaaatgggggataaattatattacttaagacagttaaggcgattgtatgaaatgagtgtaaaaatgttttaccgtactacctggcaaacagcagacacttagtaaatattgtttgttgggcacttgataaacgtctctcaagttcctactgtgtgccagttgttgtgttagctgcaaaggatgtggagatgagattctgtctcttcctttaaggaaaggggatggtgttattttcttcctaccagatgacaagttaatactatttaaaacatgatttctgttaatttgtgggagattgcatttttttccccatcagatcattgtggtaaaataacttgtgctcttttcttattccgtggtttgttttgttttgttttctataggattttgtttgtttttcacaaaaatggtcatttgagct

SEQ ID NO: 134061 - DNA, 1022 bp, Homo sapiens
aggcagcggggttcggcctgttggccccagactgtgtggcaggcaaaaggtgaacgtcaaagcctgtccccggcttcttcacatctcgcgcctccgcgggcgtcgggccgcccccgtgagcctccccggatggactgggttttagggacccccgcagccggactgcaaagcttcccaccaacccttcccgcgaacctcccagcccgggccgcaagcccagctccgggcgcgacgacgtggggccggaggtagaaggagtctcagcgcggcgggggccggggggcggggaagcccccccacccacgagaaaggtcttacatcagccgccccacgtgcaatcggagagagggaggaagtcgctcctctattcgggctgcgcctttccccagcctccgccccgcccgccgcgagtctccccgccccgccttggtgcagccgcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgtaagcagagacccctctgggtgccctctcccccgatgacttgcatgtaatggtggccacctgcggggcccgggctgagggttcgccggccccggcgcggggaagagcgcagctcgtgggctcggacggggaaggcgggcgggcgcggaggggggagcgagcgcgcgaggattaactcttt

SEQ ID NO: 134062 - DNA, 3991 bp, Homo sapiens
cactggcgggagccgcgcgccgcggccgccgccgactcatcccgtcgcgggcgcgctgccgaccccctcccccttcttaaaagggcaacggcaggcggccgcccccgccccgcgccgggcgcgcgggattttgggcgggcttcggctcggctcgtgggccgggcggcctctggcctcccacgtgcttgagagcggcctggtgcggtcggccgcgcgccttgcgggctgtaggggcctgagggcggccctcttgcggcgcggctgcgtgggcgtgggtccgacctgtgggaattgccccattcgtctcccgggtttagcgcggctgcccgccgtcgcgagccccccccccgccgcggaccggcgcgggccagttagcgccgcggccgggtgccccagcgggccagtggctttcccgcggagggcggccccgcggggcctcccgacccgctctgggctaagcgagcggccaggtttcgtgccctcaggtggctgtggttaacaagtcgcgaacttgtgggaattcgtcgaccagggtttacctggtgtgctcgacattttaaatccttgctctctagtctttgaggtcaccactaacgcggggcgggccgggctccaccgcacggcgctgtccttcccggagggcccgcgagggtgggccgctccgggggttgcgagatggagggtcgcgggcgtgcgttcttccgaccttccgtcagacattttgtgcccgccacgtgctagcctatcgcccagctcgcgcctcaaaacttgagaggctttcttggcttgagaaggtgtttattccagacttttccattgcggcgtaattgcaaatccgtagaatatggagtagctaaaattagccaaagtgcccgcaagagaagtacacacgtgggtcttcagaaatgcgttaaaatctagaatttgaattctttaggatatgctcaaactaaaggtcttttaaaattctcaagagtagtgttccctctgggaaacacagttggtctgctgttccccttagaggatgttttcatatatgaagtaatattgctttaaaaacacatgtatatctacaggtgttcatttttcttttttctgtttttcttttttttttgagactgagtctctctcttgcccaggctggagtgcaatggcactatctcggctcacctcagcctccgcttaccgggttcaagcgattctcctgcctcaacctcccgcgtagctgggattacaggcatgcgccaccatgctcggctaattttgtatttttagtagaggcggggtttctccctgttgttcaggctggtctccaactcctgacctcgggtgatccacccgcctcggcctcccaaagtgctgggattacaggcgtgagccaccgcccccggccaccagttcatttttcaagtaatcagcttaaccttcttgccagtcaggccagagccatttaattcagttaaattaaaacattttctctgtaatactatccacatttcaagtgctcagacgtgacaagtggctcgtgggtgctgcgttaggcagcactggcctgcagaatccactggtttattaagtaaacattttaagcctgagaaaccattgaggtggtgtggtgctttttgcacttgggagagttgatgaggccttgagagagtgttgtgggagccagctaagattgtgggggtagaggaaggttcccttagggagactgagaccagtgggagttaggtacccagttgggcgaataaaactttgacctaaaagtgaagggtttttcaggaaaaaatgctgtagattttgaaggaaattctaaaagagagtttaaagtgttttcgcacagaggcgtcatccttaaggcaaatgaaaagtttggagatcactctcttaaaatcacattcagctagtcacatgataccttatgtgtgatgtgctggaacatgccataaacaccacagaaattgatggcattgtcagctgttacacagtaggcttggcctctgggatcctgcagacttgtcgtgtggggtaacatgaagaatcgtttcccttgttgaaggtatactgttgttgtatgaacaggatgccctgaaatatacagcagtgtcccatggttgaccttaatgattttaaagtcaagtgagatttaagggtgtttgaagagggcgaataggggtttaattgtaaatatgttcttacgtttaagaccagatgggcttttattgtgtatatggcttttttttaattactggggtttgaagaagaccctagtaacacttttgttcagttgggctcttgtgtgttctgaccaaggaagacaagaaggtaaacacaaaagtgttactagggtcttcttcagttcacctgttactatatccctattccttataaacacaagtatgcccatttccctaagggatgggggcgagggattgtaaagaaatacagaattttatttatttttttctaagtccaaaagagctcttatggcagggtatattctcatagtggaacaaaatggcctaagatggcattttaaagtaatcttcatgaagaatggtggttaccatttaaaaacattttatagacaaggataggagatagtttgtatgacaaggaaatattttatataaaatattggcagttcactgagagtaaattgaacagtgctagaatacaccatatatacaccatggaaattggaggtcttgtcagtaaaatgagaagacactgacatgcagtagctagatataaaccacatttagttgtattctaaaattggaaaagaatacctgttctttatgtgagattcttatccttccagtaaactgaacatgtcgctctgttagaagcacctcattaaccacgcatctggggacagtcagccttcctatcagctctgagtttttcattcaaagttagaaagccaagcagttccttactgtggcttgcagtctatgcacctgcgaaatgctggtgtgctatatgctggactgtgacatttcatataccaaaataaaagtctttacgtagtcccaatttactgagaaaaaatgtagattgtctttaacttccatctttttttgatccgcaccccctccccagcttttgacctcttttgttgtgtctactgtgatgtaattttgagctcaattggatattctagttggttgcatagcaactaattggggtttttttccttgtataagtaatacatcttcgtttaagaaaaattagatatagataggccaaaaaattgtaggtatagacaagcaaaaagaagatagacatcatacatgcctaacgtaccatctagacactttagtgtattatagtctaccagaatgtttaaattttttctaaacttggttcatgcaaataatccaaatgctagctagcttgttgcttttttttttagaaaaaaaatacagtcaacatctttgtgtgtgtccttattttatagactcattattaatgtctgcatagatcataatttaaacatccctctcaggttgttcacagggattttggctgttttaaatactgctgaaatgagcatcttataatgtgatttttttttccatctgccagattgcttttcagaatggttcccgtctttaaatacccaccagtagaatattggtgtttccttccttaatgccagcagtcgtgctacctaaacacattggagaaccactaatagagatccgttccaggctgggcacagtggctcgtgcctataatcctagcactttgggtggcagaggagggtgggtcacctgaggtcagggattcaagaccagaccgggcaacatggcgaaaccccgtctctactaaaaatacaaaaattagccaggtgtggtggcaggcacctgtcatcccagttattctggaggctgaggcaggagaattgcttgaaccccggggacagagtttgcagtgagccaagataacaccacttcactccagcataggcaaaagagcgagactc

SEQ ID NO: 134063 - DNA, 1030 bp, Homo sapiens
tttgttttgaattaaggactcttgcatcctgattttttttcccagtgtcaagataatcttggcaaagattactaaaaccagagttggaaagtgcgttggtgcagaaacctctagccagaatctcttagtggtcttgataggaaacataaagctttcctcttttccaggggtcatcttctgggccttaaggtagacccagcctaaagagtgtcttcattctgcatttgcatttagataaaagctgccctttggggaacaggctggagaaaagaaataaggggaatacgcttacttcacttatatcttaaaaagtatagtttctgtttctggaaaaacaaagagcgtaagtgtttatacccatggaataatattccatctttgaacctgtcagtatattgttactgaaggcttaatcagtttttatctttttataactatgatctaggtctaagtaagaggctgcctgtatatatgggtgtttttgcaggatatttatggtagaagtttctgcattgttgtttgttttcaatgtgtttttgagagcttatccttttttctttgtcatccacaggttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaaggtaagtgctttttctttaacagtaaaagagaacgatcctgggaagggaaaatgtatgattttacctgtaaggaagcacttagtgtagcagaaagcacatggcctttggaactgggcagatatgggattgaattctagccctagcatttccttgatgggcaaacttctgcaggttacttaatctctctaaggcccaatttcctcacctgtaaactggtggtattacttgaccttgcagaattgctgtgaagtttggaaataatgcatgttgggtgctcaataagtagtagttaggaagaataattactgt

SEQ ID NO: 134064 - DNA, 1030 bp, Homo sapiens
gagtttcaggtgaccgtttctgatgagaaagaaatttccccttctaagtatactagaggttcaagtataattcttttatatttgcatgggttatcagtgacattggaagctctgattagcccagttaaacatagtatagctttttagcatctatttacataaacttgatgctagcagatccttagtgtgtgttttgtgttgttttcctagcattctgatttattttcccaaattactgttggtctctgtactctcagacttattcagaaattcagcctatcagtgaccgtttttatagggactttaataaacctttcagaattctgaatagagcttgtttgagttctgagaaggacagggtttttgtttttgttggttttgggtgggagggcacgttaagtacacaaattaaaaacttttaacatttaaaacattaatcacttcccttatagggctaatgagagggaatcatacttaaaggcaggttgagtgtactcatgattgataagaactttattttcttcctattccagaacacaaattggttttgttttgttttgtttttgagatggagtttaactcttgttgcccaggttggagtgcagtggtgccatctcggctcactgcaacctccgcctcccaggttcaagcgattctcctgccacagcctcctgagtagctgggattacagacatgcaccaccacgcctggctactttttgtatttttttttttgtagagatgggggtttcaccatattggtcaggctggtttcgaactcctgacctcaggtgatcagcccacctcggcctctcaaagtactgggattacaggtgtgagccaccgtgcccggcccacaaattgtttttaacaagaaataagtactgaaaaaaaattgatgtgtaaatgtcacaaattttctaaatttacacatctatttcatttcaaaataaatatgctaataaatgttttggtagactgccttgttttggtagattgccttgttattcctactccctaagatacacatg

SEQ ID NO: 134065 - DNA, 1273 bp, Homo sapiens
atgcaagatgtggcctccagggagctggtttcataaacctgaggctgttgacctactccctttcctgaggttatgaagcttctttatgggcttacttgtagggcccgttcctctcttgtagctttcagagcaacattccctggtggcttccaggtgtagaactctacagtgtatgtcagtattgtccagaaattaggtttcaagtgggcattgcaagctttgaaggcacacaaaatatgctgctcagaatgcacagactattaaaccatttaccctttctggcaggtatagggtattacaacttgtcaaaggattctaattggttttgacccactttttaagttagaaaatttatttgctgatgttagagaccagttcttgagtaagctgttattagcagctgattaggaaaacacaatacttctgaccttaccttctcctgttaattatttggatttaaacaaaatgaacatgcatgccctaatagaaatagggatcatttgatcttgataaatctttgagaactgtatttgttacttacaataccttaaatgatttctgtttctctgtgtgtatttgtgtttgtgttgtgtccattttctcttgcagcttgaactcagtgaaaatagaatctttggaggtctggacatgttagctgaaaaacttccaaatctcacacatctaaacttaagtggaaataaactgaaagatatcagcaccttggaacctttggtaagtaactgagaatttggaaactggaacttactggtcattttcattttcatatttctttatagtgggggaaattactggcaataataattggttgagaaagtggtggctttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgaaagtggtggctttttactttttatgtaagtcccaattttaaagatcagggcctctctaattagatgtatttctgtggctttgctctctccctgcctgatattgtggtggca

SEQ ID NO: 134066 - DNA, 1476 bp, Homo sapiens
ccacccccctttttttttctggtttaattttttttttttttttttagacggagtctcgctctgtcacccaggctggagtgcagtggcgccatctcggctcattgcaagctccgccttctgggttcacgccattctcctgcctcagcctcccaagtagctgggactacaggcacctgccaccatgcctggctaagttttttgtatttttagtagagatggggtttcactgtgtttgccaggatggtctcgatctcctgagctcgtgatccgcctgcctcagcctcccaaagcgctgggattacaggcgtgagccaccatgcctggccttctcttttaatttttaaagaacagagtagcaggcagtaccttttcactgttggccagttgatgactggccattacctagttctcgtggcagcctgaatcctctgattatcagaagcctttttcagtgttgtagcacacagcaatggagcagaagcaaatactgtgtgggagttgtttgcttgagttttttcctgatctggtcagtaatgtatgagaggaccctctggtggctgtgaaagtctcagtcccccaggatagtgaaggataaaaagtaatcttcgttgtgttcaccatttttagaggatctgctatacccatacatttactgggtgctttatgcatgttttattagtaattgtaaaaaaaaaaaccttcgatacaaagtggatagaaatagcatggcccttgttttatattgaggaagctaaggcttgggtgaggctgaatcccttgtccagagtcacacaccctgtggcagagccacagggctacacaccagagctatttcgaaaagcctggggtcccgccattctgctatacttggcactcagattcctggcggtgctaggttggtctcctgaagttctaacttggaattaagtaaatctgtaggagaaggtgaaggggggaagagttgggtccattttgacttctggcagtattcttcagtggggaaaaacaccatcctcatcctcattaaccacatacattttgaacaccgtctactttgagcccagttcttatagtcaatgcaatgattgtgaatgcctctgcttgctacagggacattaatcgagagacaaagaaggcatcaattcaaacttccttggacaccttttttaagagacctgggccatccaaaccatcccccaaagcccttctaaattctaagaaggcaagcaaaattattgttaataaaatgtttaatgtttattatggctagcctattagcttacatcaaatttctggtatggtagagttgtaattttttttaatcagtatttacacattacattgggatcctgaataatctgtgtgtagtgtattttgtgcctattgggccttaaagcacaattttactactttcagcagttccagagtactacagttatttgggatttttgttgttttcttgctttcatttcattt

SEQ ID NO: 134067 - DNA, 1294 bp, Homo sapiens
ggcatgtccaaattgtttgagaaggggtgctttgccaggaagtagccaaaaatctcacataattgtacagtttcagaaacaggagagccttggaggccctgtgtactggaagagtcaatgaaactagatagagaaagggcttttggtattaaaaagcattagataaatatcagaggttgtatgtgtttttgtgcacctatttctaggaaataattctgaaatataaatggctcattcctttaagtggagaatttttagagtgaacctttttggaaaagctgcctaaagctgactctagctggcatcgagtcagcctttgtgaagagaaagccagtatgctagctagccatctggggtggcattgcagcatttttttcctctttggcaagaagtcatacctgggcttctggaagtcagggcctgactggaagggaagctaatctgaaaattacatgatacaaaagcagctctatgaccagaagggctggggacagctttcttaaaacgtcaaggaactgactatataagcacattgtttgatccacagactcttggatcattgtacaatttgtgttttgaggggtgcaacgttttcctgttgctgtaaccctgctgtgtgttccctgcatgaataaaacaagtgtgggagcctctttcttcatcaagaagatgaagttcttcatgtgcaggggtcagtagcccttttctctaagggccaaatagtaggttcatttggctttgtagcctgtttatatagtctctgtcacaactagtctgcttggccattttagtacataaggagccatacataaataaatgagtgtgactgtgttccaatggagcttattttacaaaaacaagtggtgggccagaattggccactggaccaccggttcccaacccctgctctagagccttgaggcagattttcacaccattttatatctcctcagaactacatagataccttgagttctgaaaataaggttttgttttgtctgcatttcttctcaggtccttgtgagtgttgtaacagctttcctaataaagcagcaaaacctgttaagcatcaacatttatttttttagaaattattttatgtggaggtcctcttaaagtttgtttgggtgtttttagtactatcttcttagagaataccgaagtttttctcttgattcagaaccattaaaggttgtgtttatgaagctatccagatatatgtagttattgcccctattctgaaaggcaccaggctatgtgctacttcacattggatttgcctttcataggctgc

SEQ ID NO: 134068 - DNA, 1397 bp, Homo sapiens
aataaaatcagaagaactttacatcataaaagtctggtaacatgtcagtcttttccccaaatactaaaaaagaagagtgcaatgtttctccgtatttccgaagtttcaactctgcgcccctctgctttttcctcagcccatattgactcctgtcttccctgaaagtagctgcattgccacactttatattttattatatttcatcctctagtgtttcatgtctgtgccctaactaaaattgtaagcaccctaagattgtgttataaatctctgaatttttccctatactgccaccctagaacattaaagaccgcttgatacccaggaagttcttaatggccatttgattactcaaatgttaacatttgtttcagctaaatttattaaactgtttgattgtctcatactgtgaaaatacctggatttaataaaaattattttcaatttatatttctttagactactatgctgccagaaaaacacatagttctctgggagagtagataaaggaagagagggactaaagtctagtaacctaatataaaggttgcaaaagacttgatgtatttttctatatatgaggctgagtgggtagtggaaattgaatatagagcctagaattttacctcttcaagagatggatttgttacttatattcctttggtttaggagttgtggtttttgatccttttcttcagaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaaagctattggatgttggccgggcgcagtggcacacaaccgtaatcccagcactttgggtggccgaggcagggggcattgcttgagcccaggagtttgagactagcctgggcaacatggcaataccttgtttctacagaaaatagaaaaaaaaaaaattagccaggtgtggtggcgcacacctggagtcttagctactcagaagactggaggccgaggtgggaggatcacttgaacctaggagtttgaggctacagtgagccatgattgttccccactgcactccgtctcagaagacagacagggtgtctcaaaaaaaaaagctactagatgttcttactattgaggaaaatagtgtgtgtttgtgtgcgtgcgcacgcgtgtattttttgaatgtaggcattccattaaatttatagctaaggcctatttcataagcacctggcctcaaggga

SEQ ID NO: 134069 - DNA, 1062 bp, Homo sapiens
aaggtacatgatttttttttttttaactttttactgtcaaaaatttcagacagtgacaaagggtaaaaataatagcaaaatgaacccccatgttcttatcactcagcttcagcaattattggtcatagctgatcttattttattcctgcatacccttaccttcttccccactccatataattttgaagcaaatcttagccattgtatcatttcatcagcgagaattatagtgtttgtcttatctaccaggacttctagctctctgattttatgggactctatcggacaaagggactgagctgtagcacatagtagaaagaaagtgactgcagttcgtggccttacagcatttgttctgtgagccagcccacagatcctcaacactttgtcccctgtggagcgtcgaggatatttaatgaatcccttttggactatttttagaaggagaagatgaggaagacgaggacgatgaggatggtgaagaagaggagtttgatgaagaagatgatgaagatgaagatgtagaaggggatgaggacgacgatgaagtcagtgaggaggtcagtgcagctgttttctaccctgcttcctatttgtaattacaacaaaagtgggggtttcaaaaagatgacaaaagaaaagaaaaaacaccttttgaagaaattagtatacctgtgaatacatttacaatatgaatctggttaatttagtgtttgtctggctttaaataactactaaatagaatgcctactgaactcaaactagtacggttcctggctgtgcaaggtaagttctggccctctgggggaaggaatgaattgagtattcagtgtggtgagaaaactggacatgttgagaattgatggtatgtctgttccttcattgaattgtagggaagtttatgtttaccaagtctaaactttttcttgtatattcagtgtaattcagtaaatatatatctgctatgttaaagagttgggagtacaaaatgaaatgagattgtggtcctgccctgaaagagcacagtctggtttatgaaatacccaataatagaggatccct

SEQ ID NO: 134070 - DNA, 1348 bp, Homo sapiens
acatgccaccatgcctggctcatttttgtatttttagtagagacggagtttcaccatgttggccagggtggtctggaactcctgacctcaggtgatctgcctgccttggcctcccaaagtgctgggattataggcatgagccagtgggcctgaccagctcaggttaataataagcactttaataattgctagatttgtaaaaagaaacatttggaagacaacaccttaaaatcgaggaaactggattaacttttcctgggtgagttgaggtgctgctgtgcattttgcttttcttggttctgtggtcaccacttatacttgctattagtcacctatattaatctgatcaagtttacattgttttatctcctaactgtcaaaaactttgttgttgttgcctccattggcaataatctaagcaaaatgcctttccactgtcctaaagtcaatttttgttactgtacagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcacca

SEQ ID NO: 134071 - DNA, 1087 bp, Homo sapiens
agatggagtctcgctctgtggcccaggctggagtgcagtggcatgatctcagctcactgcaacctccgcctcccaggttcaagtgattctcctgcctcagccttctgagtagctgggatcacaggtgcccgccaccacacccggctaatttttatatttttagtagagacggggtttcaccatgttggtcaggctagtctcaaactcctgacctcaggtgatctgcccgcctcggcctcccaaagtgcaggcatgagccaccacgcccagcccttttccagattcctgtagccagcaaagaccagcaccaaacgtttgttgggctaatggatgggtggatgcaaatgaatgtttgcatttgaatgaaatgactgagaacaaatctttgcctgctttcaagttgctgagcgtccctctactgcctaagatgaggggtttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggtaagtgtctaatttttgacttaaaatcgaagggagtccaaaccttcatatttttactcccctcatggtggcccactttcagcagatttcatgaagacaaattttagcctcttttcatttttttaaatagagatagggtctcgctgtgttggccaggttggtcttgaactcctggcctaaagcaatcctcccatctcgacctcccaaagtgctaggattacaggcatgagccactgtgccctgccagaaacctcttttcaatcagcctgtacttccattttttgtaagctaatttgaaagaaaatgaattaagaatatgacagtttttataagacatttagaaattctttttaagaatttttttttttttttaatagagacaaggtctgtctatgttgcccaggttggtcttgaactcctggattcaagtgatcctcctacttcagcctcccaaagtgttggg

SEQ ID NO: 134072 - DNA, 1010 bp, Homo sapiens
gggaccacaggcacgcatcaccatgcctgactaatttttatatttttaataagaaggggtttcaccatgttggccaggctagtctcgaactcctgacctcaggtgatctgcccacctcgacctcccaaagtgctgggattacaggcatgacccaccgcgcctggccaagaaaatttcatttacagtcaccctctttagaatgtatgtgcttcctcaactgcttagctcgaatttgatttggtaacagcaagactgtcaaaggatgttcaaattataaagtatgccatgtttgttagaattttggttataaaaaagactacgccttccccatagtaaatggcccaagaagggaaccccctccctcctgctcaccgagatgacccgcaggttgacgtcctcaggctggagcgggtatgcgctggtacactgcaagaagcagaagttggggttgaggggcttcacgatctgataaacttgcttcatggtgtccattgactgcatcccactggagatcaccattgggcgacctgagtaatccagcaccaacaccatcagcactttctctttagaggttctgactctccccaacacatcccaactgctggtctcatcattcaactgaactccacagacatctcttaaaacactgtgccagcccctgtgggggaacagagaggagcttgttgggttcctgccctcggccacaggaaaggtgggctcccctctgccccccgacagtgttcttgagcaaaaggaactgaattaaagaggcagaggaatttcacactgccaagaggaaaatgagtatcttatctgattaataggttgtataccatggcagtacagtagaatgagtgctgattcaagagtgtgaatgaatgtgaggtgtggagctgccacttctagctgtgcctgggcagagtactgtccgtctctgagtctcagaggcctcccctgtgaaataagtatcaagcatcataatcatgacctgtttcagtcctaggagtgtt

SEQ ID NO: 134073 - DNA, 1026 bp, Homo sapiens
actcctaggactgaaacaggtcatgattatgatgcttgatacttatttcacaggggaggcctctgagactcagagacggacagtactctgcccaggcacagctagaagtggcagctccacacctcacattcattcacactcttgaatcagcactcattctactgtactgccatggtatacaacctattaatcagataagatactcattttcctcttggcagtgtgaaattcctctgcctctttaattcagttccttttgctcaagaacactgtcggggggcagaggggagcccacctttcctgtggccgagggcaggaacccaacaagctcctctctgttcccccacaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggtgagcaggagggagggggttcccttcttgggccatttactatggggaaggcgtagtcttttttataaccaaaattctaacaaacatggcatactttataatttgaacatcctttgacagtcttgctgttaccaaatcaaattcgagctaagcagttgaggaagcacatacattctaaagagggtgactgtaaatgaaattttcttggccaggcgcggtgggtcatgcctgtaatcccagcactttgggaggtcgaggtgggcagatcacctgaggtcaggagttcgagactagcctggccaacatggtgaaaccccttcttattaaaaatataaaaattagtcaggcatggtgatgcgtgcctgtggtcccagctactcaggaggctgag

SEQ ID NO: 134074 - DNA, 1090 bp, Homo sapiens
attcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaaggtgtgtcctgccggactctactcggttctgctgccgtgtgtggaaaaaggataggctggcctgagagggatggtcaggaccagccctccctgagccaggctgatgaaatgatcagtgaatgtgctcccacccgtgtcagcttcttcaggcttctcttcagtaatgcatgtcactctggcctgtagcagcagcaggagacacatgttatctaactttagcagtttctctggccacctagggtcacattagagtcttccactaattctctgaagcccatggccccagtactcctagactccagaatatgtaacaggagtgaggccctggaataagtcaagtctgggctcccttggagcaggtaagccctgagaaacatttaggcacggtgttccctgaggtaccagaagagcctgtggcatttcctaagccagggtggcactggtgggaagggcagtgagtcgttgcagaggtgggtgggtgatgatgcagctattccttgtgcaacagtgaccttcagacagaggaactggtgggcctagaagcactgcctggcatgctgactatcagggcttcctggaagccgtggcctggaccttcttgccttctgagtcatagagccaggcaggcatcctggggctgccaggcacacacacacctaacctgtaggctgtcggggtcaaggcaaagaccaaacaccaggcatgcctgggactgttgtcaccttttattctagtggggcctacctgcttccccaaatcaaagatgcatctataccaggaaattaaaataaagtaaaaagaaatagtttctttatagaggaaacaggagagaattagaccagaaacca

SEQ ID NO: 134075 - DNA, 1017 bp, Homo sapiens
tcctggcccctagggcagccgggggatgctgatggccccctcccagagccgcagggccgggtagagcggctcctggaacgtggcgcggaaggtatgcaggtggctcatgccgcccgtcacgtcgtagaaggcgaggacgccggcctcgtagtccaggaagacgccgagccggtcgaggtcgtcgcggggccgcaggcggctgcgctggccgtcgtggaaggcccagtactcaaggtcgtagcgcttgaggcaccaggactggcggttgcagcccaggcgggcggcggccgaggccccgcggcgccgaagggaggcgtaggccgcgcccacccaccagccggcgcccgcctcctgcacgtcaacctcccagtagtggcggccggtggcgaagcagtcacgagccagcacttgccagagcgcgtcgaaccgcagcacgggcacgggccccaggctgcccagcaggccgcagcgcaccgtcaggcgatcggcggacaggcgcaggcgcgcgtgcatcgtgtcaggatccagcgtgggcgtgcgcgcgtctgcagggggcgagacaagggacgcacctggtgggcggggccagcgcggcgccccgcccccgggaacccaccaacgcacgtgcaaatcacaaaatgcgaagcgcggaaatggcccaaggaaggggtgacagacccctttaaaccgcgactgcccctggggcggggtcttggggaaaggggaagaagagatcactctgctgcacatcccttatactgtctgtattttgtgccgtgaaatttgttgccaattaatacaaatttaattaaaactaatcctatcactgttaacattagggtgtgtgtacttcctatctttcccctccccttgctgctttatagcttttctttttcttttttttctttttttgaaacggagtctcgctctgttgcccaggctggagtgcagtggcgcgatctccgctcactgcaagctccgcctcccaggttcaggccattctcctgcctcagcctc

SEQ ID NO: 134076 - DNA, 1051 bp, Homo sapiens
acttacaggtggcagctcactgtgcccacaagtcaaattttaagagagagaacagataaaacttcaaatattatatgtgaaaccacaaatttacgaaggggcactggtagccagcaatgcctacccatcctgttcaaagaccaaatcaggtcatttcattctttccttaaagccacaaacagtacaattaatgaataatctattataatggtttgcaccacgcccagtttgggttcagtttcagccaccctgcagctaacccttgtcctgcaatgagtttagggctgggtaaagaagaggggcctttggaacaggcaggaaactctctctgtctctttctctctctctctctctctctctctctctctctcacacacacacatacacacacacacacacaccccgcatgtatgtcaagaaaggagcatattgcatagcaggaagaggggtctctcaactagtcctcagactacttcccacctgcactgctcatcataacatgacttcagtctagtcacttcccttgcaccccagttttcccatcatcaaatgggggaaaataatccccacctaccttgcaggagagttgtgagccactgtcaggtgttaagaaataaactcaaggccgggcacaatggcttacgcctgtaatctcagcacttagggaggccaaggtaggcggatcacctgaggtcaggagtttgtgaccagcctgggcaacttggcaaaaccctgtctctactaaaaatacaaaaattagtggggcacagtggcatgcgcctgttatcccagctactctggaggctgaggcaggagaatcgcttgaacccaggaggcagaggttgcagtgagctgagatagcaccactgcacactccagcctgggcaacagagcgagactccgtctcaaagaaaaaaaaagaaataaactcagtgcgatgcaaaacccagagatgactacatcctttctgggagttgggaattcacaggccccggagcctaatcccatggcatcaggcccaccaagcctgcatgggatcacagcagcagaa

SEQ ID NO: 134077 - DNA, 1135 bp, Homo sapiens
aggatcatacattcaatctatgtcatctgccaccagtgtccagggcttaatcaccttcccctgctgcctgtagtccatccctggaatgtcagagttggtgggttccattaagataccatcccccaaacctagcccctccccccgccagccacccctctcctggcatcatttcacagataggtaaagtaaggcccaataagagatggggccttgctcagcatctgtcagccagtcaggagcagataggtgaagtctcattcaaataagaaatcgggagctgagcatttgtgcagggttgatatgacagctgcttctagcctggccttgagcctggagtttgtaggggccctggcaaatggcatgaccctgcccacaggcagtgcaggggcaggcgtgtgttccctgggcccaagagtcttgtccctctagccagccctgggtgggaggtgagtttggggctttgcccacactgcaggtcccctgagagttgtctcctgtactctgactgtgcatttatttctggctctggtgccagcaaactcctggggctgcctgctgccagggatgcagccctggcttctagccccatctcagacactgagtggccttgggccagggtctctcctggcccacctgcaaaatggcatcataacggccccagccacaggatgaagtaagaagtgcaagggaagttcttgcacagggcgtggtctatggcgtgctcaataactgggcaactcctgtggctgttcctaaggctgcaccacggtgttggcccaggctggggaattgagcccactgcagacagagccccctcctgccaacctccctttcacacctggctgaccaggtagacctgcctgagaaatcagatacgagcctccagcaatggtttggagtctaagattgcggacaacaagggatgcagtggagcaaaagaacccaggcctctgaagaaggagagctgaccccgctgctgatatgctccttaggcaagtcttgacccttctttatgactcagtgtcctcatctgtaaaaggggaagaataattcctgccttagtcattgtaatgatcttcaccccagcaaccacctattgatgtttttctaatgcttggggagtgtgaatgcagac

SEQ ID NO: 134078 - DNA, 1087 bp, Homo sapiens
cagcagggctgcacccctgcacaaccccagggggcagccttcatgccacagtcctgggatgccatgacctgagctcgtatagcaccaaggtactgctctgctgccctctgcagctgcatggcctctggcctctcttcattctgcgtgtctgcttccttctctctcagcagaccagcctctgtccattcattcattggacatttagggaccatcgaagctgttagaatggagacctcagcccctgagtcttgagcctttcagtgagtcttcccaccccacccctcatgttccagttctaaattccccaaagaaaaaatctgattggcccagccaggaataatttccacttctggtccaattggtaggggacgcagggagggactggggttaggggatgaggtcacctggttcacagggctatctcccctccaagactgtgagggactgtcatccccccgctccagccccagctatttcagtagaagctgcatagttgcaaatattttcccaaagcaagttttcactcgatttaatttaaacacacatatacctaagcaaaatttacataagccatgctgcttttttttagaataggtggtgtgtgacatttatttaacacagaatcaacattcagtgtccttactcaaatttgagtggttcccaaaggtagatatttttcatactctatttccagcctaaaattgggtgaaattgagcatgtgtatgtacaattcctgggaattaagagttaaactccaacagtaatgcctctcagtcgaagcctccttggaaaatatgttcagatttcatgccacactaaacgtctgccacaggtcaggtctgtagaaatttcattcattcaacagtctgacaaaagcccctgtacttctcatttgtttgaacatgttaaaatccagaagaaacaaaacctgcaaagcctcttctaagaatagctgtgaagggagctggaagctatgagatcagaatgaataataatttttgcatttcacacaaaagccaggtaggaagtaaagcataatgggggcctcttggatgccaggtgtttaacacctgatggcatctaatc

SEQ ID NO: 134079 - DNA, 1050 bp, Homo sapiens
tgatcatggctcactgctgccttgacctcccagactcaagcatcctccaacctcagtctctcaagtagctggaactacagacttgcaccaccacacctagctaatttttaaacaaaatttttagtagagacagggccccccatgttgcccaggctggtctcaaattcctgggctcaagtgatcctcccaccttggcttcccaaagtgatgggattacgggtgtgagccaccacatctagcctcagtcttcattttgttcctggaaggaacacttagactttgatttaaatcatgttcccgcttgacctgcccacgtgctagggaatgagagaatgtgagactgtttgcccttccatgtccttcttaaatgctcagagactgagctttgtagttaatgttggttttgttgcccaggagcaaagccatgcctttgctttcagtgaatgtaactctagcattttttcccaggaataaggaaattgtgaaatatctgctaaaccaaggggccgatgtcactcttcgtgcaaaaaatggatacacggcctttgacctggtgatgctgctgaatgatcccggtaggtaatttcaagaaaagggttgtaaatctacccagcgtttcttggactgggagtcaagacaggcacctcctctgtgacttgtgttttaagcacttgcttattcgtgggggaaagtcactctcaagtgtcaggagcttactgcatgatcttaggcaagttccttccctccccagtgaagcgctggacttggaccaggtggccccggggacttcctccagcaccaacctcctaggagtctctagagagggaaggaaaataagacgtgtctgactttgcagtccacacacaccctagaatggcatctgtgcttcacagccagaaatcctgagtcactcaggtggaaacataaagtcccctttgataagcagaatgggagatagagcgatggccttctcagcttaattgtgtaggtagaggctgcagggtcaagggtcgtgtactgggaatgtagccgttagttccaccccatttt

SEQ ID NO: 134080 - DNA, 1033 bp, Homo sapiens
aacggggtagggagggcttcgtgtaggaggagactgcggaactgggccttgaaggatgagttgggaattgaaaggcaggaaaggaggccgaggacatgagtgggctgcacagctgggaggcggcaagagagaagggtagctgtagaggggagtgggagaaaagtcagagagaaaacggggagcagaagttatcgggctataggatataggaaacatttccccattttggagaaaactcagtgacgtggctgtccttggagtctggcagttaaatgcaagtagtggaaatttcttctctttccaggcaggagcagaagcagagggctctggcctaggctggggctcggacgtcggctctggctctggtgacctggtgggcagtgagcagctgctgagagtgagtgtgaaggaggacacgacctggtgtctgggactgccttcaaaataaccccagagggagggacgtgggggccagggacagatgaaactggattggctgctgctggggttgccggcagtgagctcatgggggttcattctacttttccttgtgcttgtatatatgtttgaaattgttcactttgatcagttgcattgtaagtgagtacgagcctacatttatcttcaggacctcctcaccccaccttcttcctttccctggtgggcttcttgagcaggctgccctgcagcaggtgtgcccagtgcccttcacctctgccaactggctttcaatcctccctccccctcctctcaccctattcattaaagagacctgctggttttgtctctgggtggctattctacttcagcttccagaaccttcctgaaatctccttcccttatgcattccctccctgcctccctctccaggctactctttctctttggtgcctcttgctcccctggcctcctgccaaggctggagctccaccagtcctttctgaaattgccccctggggagcttctaccttctctagctgcagctggtgcctctgtccctgagagcctgtgctgaatccctggttgaaagctc

SEQ ID NO: 134081 - DNA, 1024 bp, Homo sapiens
cacagacacacccatcgctctacccggccctccggggctagcggctgagcggtgctggggctggcagaccccgcccccacgcggcctctcggagccgggagccgatcgggccggggctggggtctggcggcccagcccccggggagcgtggggcgtggccagaaaccggcgctcgcggctgcggattggctgcctggcgggcccgcaggcggggctcccggctgggtcccgcttggcagctcgcggcggcggggaggcggggccggcgggagcccggcagccaatggacgcgcgtcctccgagcagttacaaagggccggagcgaggccgccgcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacgggtgagcggcggcgcggcgggcgggcgactgcggggcgcgcgggccggacccggcctctggctcgctcctgctctttctcaaacatggcgcggggccgggggcgcaggtggcggcgccggggcccgggccgggctctcgtggcgccgcgcggctcggcggctgccgggcgaaccgcaagcggggagcggaggcggggcaggggcgtgtgtccgggcgcgggcggacgtgtccggctgcccgaggccgccccgctcgggactccccggggaggtggagtcgggcggagtcgtccgaggtccggggctgccctctggggtgtgagtgggcgagggccaggggcggagagtgcgaggccggcggggactggcagagccgtggctgcccgccgccgccccctgggcacggcgtgaccttgttctggggacccccgccccaagagggtccgtgccagaggctgccgaacccggggcggggtttgaggttggggtggaaggcggctc

SEQ ID NO: 134082 - DNA, 1050 bp, Homo sapiens
gacccctgggtccgcaggccgccctgactcccgcccggctcgacccgagccgaccctgctggaaggggctgctcctccagccaggggggctttgtgtgagaagaaggaagcgcggagatgcgcggaatgtttcttctttcgtgcgtctggggagtgttgaagtgagtccagtaaccagacggctacggattgttttcatagtggaaacttgaacgtttgctcattctgcgggttttggaaattttgggaacgactgtgaattgattaaacgctttttatttcctcgaaggaacatcactcacgttgttccttttcttgagtgacagttaatagtttgattcagacatctgtatagctggttttcaaggaagactgttggctggatttttcaaaatagtaaatcaggttggggtaggtggttggtatccacaaagggatgagtgaaaaacttcgttagcagctgaactgagacactagaagctaaaatacacagcctcagtgttagcaactaaaatgcagtgaaagtacatttctgtttctgaaactggacaaaagatgttgaaatttttttaaaaaatcaagactgacggtgacgattataatcagtcctaatagctaccgtctatgtattgtgcattactacgatgtaaatgcatacactattgtataattacattatttaatcaccacaagtaaactcccaggagtagtggcatttgccccactttacagatgtgcaaagtggggtacagacacgttaagtacccaataacttaagtgctaaagctaggattttcactcagatctcagtttcccaaacctgtatgtcatatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggagg

SEQ ID NO: 134083 - DNA, 1171 bp, Homo sapiens
tgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttggcttcccttttaaagacttgcacctttttatgttctgagtatgttttaatgttctctgcccaacttctgtctccaacataggtttctctagggaaattgattccttatccctagtgcacagtttagtaccactatgtctatatgtatatcccatctgagaatgctatttgcttcctttctgccatttcataactttttttctttgaaaacgtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttccccgtgaaggtttataagatttcccatttgtattcagcacttagaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggca

SEQ ID NO: 134084 - DNA, 1049 bp, Homo sapiens
aggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacataaaaataatcaagaggaagataaatcttgttcctgtgaggagggccgctcatgtagggaagacccctgtcaaaaggttctaggccttagttgagcagttacagggactcaacaccattcttgtagtgtcattttattgcaccaaatatgttcatgtgtaataaatggaattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtgattgggtcacatctttgcttcctgcttttggaattgagggcagatgctggcatatttctcagggattttttaatgctttgtcccatagaactagcttgaggaaaagttttggagtcttctcagaatttatggtcagttttgacccagcctaactccaatacttaggattacatttaatgccattcttagctgaattttctcaatgtcaaatccaggcagtctccataaacattaaaattgtttaccactctgaattagatccaattttatgtgttttgtttgctttccaggtaagtttcttatggctacccttcttcatcatgaagaaaattggttggtagacttgtaattattcatctcagacatcactttcttaaatactagtggactaagttcagttggttttatggtccaattttatagatcagatcaagtcttttataaagctgctccctcaaagaacaatttctaatctaacttaaaaaaaattgacttgcaaagtatacacacag

SEQ ID NO: 134085 - DNA, 2619 bp, Homo sapiens
agacactgctttgaatggcacagatgtagactaacagtagttcagccactgagactcaaatgattttgtattaccataaaccccatctgcctgggcaggcagaattgacacaattttgctcagattggaacctagttcatatctatgaaagaagaccctctttgtttccattttatagaccaggaaactgaagttatgctgttaatgaaaggtggagccttcagttaagcactccagggtatgtactcttttcctatacaaatgctcctctacttatgatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgacgagtccagtgatagttgatcacttactatttgtattgatttatacatatattcatagcaaattcttttcttctaaaagttacataagcacaggactgaaaatttgtattagagaaaggaaaaaaaccatcaccagccattattaacatttggcatatcctgcacccatgcttttttttttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagctgcttgggaggctgaggcaggagaatcacttgaactcaggaggtggagtttgcagtgagccgagattgcgccactgcactccagcccgggcgacagagtgaaactccatctcaacaaaaacaaacaaacaaaaaaacagcaacaaaccattctttaatcattctatttcagcagtttatgaaagctaataaaagtgtttaaattgacaaacagcttcagtttacagaggaaagagcttcagtttacagaggaaatagctcatctattcttagcaaatatttagtagtgatcaacatgatgagaaatataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagcattctaagtttcaggatttctaagaggagaaatggaagttcatggtgtaaagggtgggctcagagaattatgggccttgaaaatcaggagagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttcctccctcacctcctgcaagtctttgctcagatgacacctttttctcagtgaggcttatcctgccaccttttaaaatattgtcatcatcctacagtgctttccttctctgtaacaataccttctaacatactgtatttatttacttatcatatgtacttatttactgtttattgtctccttcctatcattctatgctttgtgaaagtggatgtcttcgttttgttcactaatgtatctcaagtgtatggaaagtgcctggtgcatcctaggcactcagtaaatatttgttgagtggcagtaggtcttagctgtaaagaggtggagtacagaaattcagagtgactccatgaaagaaaaaagaatgactccaagcttttttaggctggataatgcctttaacttaatgagtaatttggcacgaggattaaggggagacgaattctggtttaagcatgttgagtttgaggtgaaggtagccaaataaaattgctcagtagtcagcaaagattaaaaaaaaatggaacctagttggaaatgggagagcaccttaagcaaagaaatggctactagcatctagcattcacctcatattctctctctctctctctgtctttctcttttgggggtaggaggattctagtgtcctaaaacgctaccttaaatggagtttttatttagaccctgaagtcctagcttgtatctggagtcctggtccgtttgctgggatatggttctttcctgttttgcaggttcatgctatttttcccccacctctcttagtaaagatgtatatattcagaattacttgtgatcttctggttgtattgaaattaaccttcagacagtgctgctttctctgcagtaatgcgtttgatcttttgggagtgtggttcttggctgagataaaagagaggaag

SEQ ID NO: 134086 - DNA, 1554 bp, Homo sapiens
cctaatttacctgatcgttgtgaagatagtgtacagtagtatttacacttagtacatagcctgacaccagtaggtgttcaataaaggggaattattatatatttaaataagtgaaagaatgtcttctgaaagaagaaatacatgtctgtgtaatgaagaactagaattaattggtagactgaaaggcagaattcagctcaatgtaaggaatgactctctaccatagctgtcaaaatggaacattgtaaggtagtatgttccctgtcaccctggaactattcaggcagaggctagataaccttctgtctgagaaattgtagaaggaatttcttacattaggtaggaggtcggacttgtttatctctaagctctgtttctcctctaaaattctgtacttttgggcataatccaagcttccttgcttactggttttagccaaatatagtctaaatatccctaggattcatggcttcaagatgagcagtatcttgttgctcctgtattatacgagaaaagttagtttatccattgattggcttttattttggtcattttccaaaaaaggattttggaagcttgaaataatagcaaattcagtaagaccaaatctactgaccacaaaagataagaatcagtaagtcaaaaagggaaagaaaaagagaacaattatccgtaagtttagctgaggaaagctttagaagttgaacacaatacttagctctgagttttctggtaaccaaggcaagtaaggaagactgataatttgcatagatctcattgcctatcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtgtctccatttgatacacttcatcagagtactgctaccaaaggcagagccagacatttaccttcaaacaggtgcaagtcagtaagatccagagtgtctttgcttgggtttcttgtttgaagaactgcttcatttctgagtaatggacgttcggaatgattactttaggagagaccacacttatctgagagtgtggccctactgtactggtctcacagtaatcccagtattcatggaaaagataggcacgtacattagcatgagggcattctgtggttagaagcattctgatttcattgggaaaaacaagcttctctctgttcttgagcagaagcttttatagaagtctttgtacatgggccattgaaaaataaagtgaacaattcgg

SEQ ID NO: 134087 - DNA, 2051 bp, Homo sapiens
ttggttttctttttaaaatttttaaaattgttttgcttttcttaagttttggtttctacattaataaaatgacagaactgaattgcctagatgatattcaaagtttcatgtggttctgttagtctgggattctacagtggaattttgtcactacttttgggaagaagtttacctttggtggcctacgaataaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccagtcaggaaagctttctcacccttatctatctaacaaattgtacatattctccaagttctgacttgaatgctggtgaagcttttcttgataatctcttctaccgcagcagagtagaaacactttgatcattcttctcaggactcaggattttaattatctgtttaatgcctttcccttccaccctagtgaactactcaagtgcaaataccttgtcttactcatctctgcacctcatagcccacactgtacctggcatatagagatgcttagtgaataattgcagaattaaatgaaagagtcaaggtgatgtgttgcagagtgaggagaacttgggctttgggctggcggaaggaggtgtcttcgtttacgttttttagattgaaattttgccatgtatatgcgtttaaaaatttaaaacctagttgaataaaaggttggggggggcagtatccaggggccaaatctatctattaataaaataaatttgaattttttaaaaaaatggcaattaaaactcatgttcatggaaaaaattaagttcttattttagtttttccctaaacgatcttgccgtatcacataacagcagtcttgtagtcaatcaagactgacttcaagtggtgaaatggaattttttaattccctgaagagagaaatctttacctagttaagctttgtgttatcttgatgtttttatttgtctagtgacctcttctgattgaaagagtagttaagaaaaaccctttagtactgactttttcaaatttaccgtaatgtaatgacctctttgaaaggagaagtacagagtgtatttttcataatgttacttaaattctgtagacatgaaactagatataaaacccttatgttcttggctcatacaccactataaaccaaatctgcaaattaaatacaaagacaactacaaaaaaaaacaaaattcaaatgaatacaattattccatgtgacagatgatgtttaggttttgcagtagaaaaaaatagctttaggtctaattccattttaaatgtgtttctgtattttaacttcagtgataataaaagctgtgagtagtgcctcttctcatcagtaatgttatgcaggagggcattaatgacttcaaggccttgttggtaagttcaggatgagacatcatacctaaccaaaacacttgacagcaagcattcctcaaatacaggcttataagttttactgagatgtcatccattttgttcattggaagataaggttaatatcttgacattattgaaatcttcattaaatgattttctaaaccagttattgctggaaatgagaatggaaaaacattgcatacctacaattatatttactgctaacaaatgtttgcaaattgtactacacatgtaggacccatatagcacttgcatataataaagtacatatatggtattggctgttaggctattggcttttgaatatgcatgccatgcctgtattgccatatggtcgattcaaattccctttattttttactctttcttttacaatgaccatgaaacttatgctgtgtgtagtgtgccacaaggacatttggcctgaaggggatcttcac

SEQ ID NO: 134088 - DNA, 1224 bp, Homo sapiens
ttgagccataaagatcaagtagatacaagtgggcatgaagctagtattttgctgccagtcatttctgtagttaggttgcctatgtggttggagcatgtatgtattgttacaggtgtagtctgcttggcttccctaagagaatgccccagtcctggccagaatatacatgtcttttttagggtttgcaccaaggggaatagagagtgtctggctcagtacaaatctgtttccgttactccattatccagaaagccactgaaatggcattagcctacacttaatgggtggtagtgttttcacacattgcttctcaaaggaggagtatgtgaatgtttagtttgggcctggtaaaaaaaaaaaaaaaaaaaaaaaagtataaccattacaaatttaaatgtactttgtttctaatgggaaggcaaatgcttgccttgctttgatgaaattgaacataacaaaatttttctatacttggaagcaaaaaacttcaggaaaaaacctgggtccaaatgttgctacatttccttgggcttccacgtgtatgtggttcttaatataatttgaaacttctaagagcaacaaatagttgttttttgcttctaagagcaacaaacagtgcatagaaattgtgtgataataggatcaagaatgtattattagagtgaatattggataatttcaaactgttaaccttgagattttttctaagaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtaagttgtataaaatttttttcctagatactacaagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtggttccagggtggacttcctctgaggtctgttatacctaaaaggatagataaa

SEQ ID NO: 134089 - DNA, 1023 bp, Homo sapiens
agtataaataatattgcaggtttgaacctaataaaaatctttaagcttgatgtatatatgactgtggctggtttaaaatagattggaacttaactttaactgttaaagcgaatcaataagtcagctccatggtggtataaatttcaaagcgttctcacttgtataatctaatttgcttttcatcactgtgaggtagaaaggataagaacaattattctcatatagatgaagctgaaggtcaaagatattcacatgatctgcagctaacccattctattcaggattgtttagcagcttgatgtttacatttgaaaacaggcatgacagaaatgtattcagaattgtgaaggttatttactttttaaacattatatgaaattgtctttcgtataggcctggttttttaaaattaaactaatgaactcttatgtcattttctcacttgagaaaaatgtctaaccaccttcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgggcttctgtttcctcatcaaaaatatggaacccatactgttgataaaaacacttcaagtggtttgttaagacttttaaatgagatgtactatcctttgaaaagtatgagtcatcttcaaataagggctaaattcatgaataaagtgaaaatttgtaaagcgtatataatgaaaatttcactaattttggtgaaagcccatctctattaaaaatgcaaaaaaattagccggg

SEQ ID NO: 134090 - DNA, 1040 bp, Homo sapiens
tatctccccagtgagataaattcctaaagggatagcttaaagtatcagttttctgggtcactcattagtgcctatcatgatgtttgaaacatgtaatattgttgattgtgttgagtactatttatttttacctttaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaaggtctgtaacatttgcttttccttatgttatatataacaagatctctttaagtctttacagatatggtgactaaccatcatcaaagtagatgagacatagatgtctctcatgtagattagacccattaagtcgaatacaatatattagtaacttttagaactaggaacttcttcaagattttcttgactcttgatagcattcctaaaatctcttaatgttttataaaatataaaagagctattttaaaaagccatgtactttgttggtttagtttagggcagttagttattgagagtactcatgatatagaaaagatatataaacttgctcaaaattttgagaatagggctcagatagctgtttccttttaatctcttcctgaccagtaggatgtttcaatatggactattgaccttattaatggggagagtaaaaataacttgtcagtgttctgagttgccaagggctaaatagatgaatcttctggcaaactcaaagagataaattgtttcttcaaccaccctggtaactgtacggacacttttctgcctatcatgctggtgcctgaggcccagtgtcaggtcagatgctgaagaaggaaggaagcctgtcagcagggagtcagaatgagtggggactgcaagcagtgaccttagactgtgctgctgccac

SEQ ID NO: 134091 - DNA, 1001 bp, Homo sapiens
tacatcctattgcatcatatgtggaggtgtatagtgtttgattaagacggggcagtgaggtatatgatgaatgtaggtagcgattatcagtggcacctgacaatgtaatacctcttaagttaaaaacaaaacaggccgggcacagtggctcacgcctgtaatcccagcactttgggaagccaaggtgggtggatcacgaggtcaagagttcaagaccagcctggctggccaagatgatgaaaccccatctctactaaaaatacaaaaaaattagccaggcatgatggcaggtgcctataatcccagctacttgggaagctaaggcagagaattgcttgaacctgggaggtggaggttgcagtcagagctgagatcgcaccactgcactccagcctgggcgacacagggagactctgtctcaaaaaaaaaacaacaacaaaacaaaacaaaacaaaaaatagtaatcagtctgaccaaatccttagttctcattttcgtttctgcctttatcaccatttatttcctcccccaactcttaaaacaaccttttctttatttactgtgtttgatgaccctagactttccttgttccttcttacttcttcatagttgtctttgttttctcaactcttactcttctcactggttcatatgaaggtactgattttataagtggtaatttcttccttaagaacatagccacattcatggtttcaaactctaccatgttggcaactctcaaatctccatttgaaagcttaaacctcacccagggtctggattttgtcacattccaagttacaaacacagcagcacaaaatgttggtgagtctgtgccctgaacttctaaccaggctgatgctgtcatctggtggtcaccatgggaactagctgaccctactggctcttccctactccccttctttcttctttgtcaggggttaatgtactttctctgagcctagcccctccacctcagttcctttatcttctcctgattt

SEQ ID NO: 134092 - DNA, 1008 bp, Homo sapiens
ccttgcttccctctctgttccttccttttttttaaccttctctccttccaggaacagccactgagcacccaacccgacccagagatttttctaggcacttaagagtgccagctctgataccaattatctgtgaagactcaaaaaagtcaccatctttgtctcttaaatgggattaattatacttgccttatctcaagaagaggggcttactctgaggaactaaaggatgtgtacataaaagtataaaacaaacaatgtagaagaaaatgtgaaggaaatacagacttaaggtggcattatattgcagtgtgtgactcaggattgagagtaaaaagtaataaccattgaacaaataaatcataaatggtctgcagcccaaccgaaatgttaattctgttttacagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggtaattctataagcagttctattatttaagctttaaattttcatgaataatgtctatgaaaatagaaggtggaggctgggcctggtggctcatgcctataatcccagcactttgggaggctgaggtgggcagatcgcccgatctcaggagttcatggccagcctgggcaacatgacaaaaccgcatctctaccaacatacaaaaaattagtcgggcatggtggcatgcacctgtagtcccagctactcagggggctgaggtaggaggattacctgagcctgggaggtcgaagctgcagtgagcagacatcatgccactgcactcccagctgagtaatagagagagaccctgtctcagaaaaaaaaacaaaaacaaaaacagtaggtggcctaactggagatatttaaaacaaattttttagatgagaacattttat

SEQ ID NO: 134093 - DNA, 1643 bp, Homo sapiens
tgctgtaggtctctgtgggtcctgacccataattttggtaggtttttgaagcttcagtatgaggactggcattcttttgtatctattatttttttccctggagtatattcgtgcccttcctttcatcctcagtgagaagacttctaaattaaaatgcatggtttctacctagtacgtgtataggtggtgtacattaggacacctttaacagtcacaattgttatgtatgtctttcattggaaaccaagatcatgaggcagatagtgtgaaactgctattttagcattttgtgggatttagttgacatcattaatgtgcaaaccagtgtggatatttaatatttttcttgagtctaatatttgttatgtaatattgtgtacatatgtctatgtataaagaaatgtctgaaaggaggttcatccaaatatggcagtaaggggatgattttcaaagttctttttgcaaattttttttaggtacatggcccctgaagttctcgatgattccataaatatgaaacattttgaatccttcaaacgtgctgacatctatgcaatgggcttagtattctgggaaattgctcgacgatgttccattggtggtaaattgctctcctctcccccagtagtttgtcatgagcagaagttgttcaagaattgtcttctttttttaattgaatgaaattatgtacagtccattatctgaaacaggatgtcaccgagtgccagagaaaacaaaggcgatgaaacctttgggaggggacagtgccatggtgtgcacatgcacagctctagcctagtgtattctcttcctgtttccatttgaatctggagactcatcagaacccaaccccttgttatattggaatatagttctttagaatggacagctgcttgagaggctcacctaggaagctgtttctagcatgtacctgggtgtcaaacttattttttttctttgagattgtggttattttctccaacttgatagttacagttacatacacagaatacaattatgttaccattgtgttgtattctagagttagtttgttttaacttctagctttttagatggagtacttttaatgtttactcaggaaacagtctcttaggcttggggacctagacttggctgagacctagtgccttaggtttttgaagcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggaatatcaactcagggaagtggcttgtggatacagatgtggatgagatagagaaagctgtaatctctgttccacatacctactttagtaatgaaacactgtaataggtctctcaggtgatcttttaatgccttggcattagctgaataaattcatcaaaatttaattttttttaaactgatac

SEQ ID NO: 134094 - DNA, 2794 bp, Homo sapiens
gagaccctgtctcaaaaaaaaaaaaaagaaagaaaaatttgatgtgaatacttcaaagtacaaacttaaaatttcagtgtgaggtcagatttcttctttgctttgcccagctctggtttaggattcggccttttcaggtttgctaaatgagtcactctttgtccacctgctttccagcactggcaccagtaccctattgatggaaatttatgtaatttctactcatttgctattacaaataatgcttaaacaataacaagtgtatatgtcatttaaaaagaaaatttacacgtaaaaattcttatccagaccaatggaaaatggtgcatgcattaatttttttttttatattttcttgtaggccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaag

SEQ ID NO: 134095 - DNA, 1715 bp, Homo sapiens
ccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttg

SEQ ID NO: 134096 - DNA, 1004 bp, Homo sapiens
ctttactattcttcagtctgccctcaccctaaccaaattctttgtgtaatgttttttcagtacaactccctctgcagcactgcagttgtagttgtacaggtctttgggtttagaaagactttgctgtttactgtccatttgcctcttcccatcagtcttccgaggtgagtatgattatcccccatcttacacacaagctcagagaggtgaaagacttgcctgaaggcacacaattgaaaagtaactgagccagcatttggcccttagttacctgagccatccgggactttgcgcataccagaatttctcagtctcctcctctttgatatgcgtaaatatcatttgtccttcatacatacacacataaaaacacgatgggccaatagaagagggagtatcatgtccataaagagacccactcagctaagggggagtagtagtgcagttctttgatccaatgacaaatgtctactgaacacgtatttggacagcctttagagcttttgcagagctcattagagattgtctcgtttgctcttcacagcatcctttcaggtaattataggcatttttagagattgaaagtctgaggcttacagctaggaagcagtggagctacaattcaaacccaggtatgtccaacttgaggttaacagttcttttagttgtactacagttgcctcttcagcaaatgcttcatgaccagcctgaccaaaatggagaaaccccgtctctactaaaaatacaaaaaaaatagtgggatgtggtggtgcatgcctgtaatcccagctacttgggaggctgaggcaggagaatcgcttgaacctgggaggcggaggttgcggtgagctgagatcgcaccattgcactctagcctgggcaacaagaacaaaactccatctcaaaaaaaagagtaaaaacagcaccagagcacttcactgctccactctgctcactccatctttaatcataacaatcagcccttctctgtccacctttgccag

SEQ ID NO: 134097 - DNA, 1146 bp, Homo sapiens
gatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaagaaacagtattagattttggtctccataatctattttggtattgttacgaacatggatatgacaaccaaactggaaatcagaacactagggtaaagtggatattgaaatgaagcaagaatattgtcacacatgtgttgtgcatcttgtttagggtatatttcttaatgtcatctaggtcattagttttgttaatatttgtgttgtcttgaccaagctcctactaagtataggacacaaatgttttttatcttccaaggcctggctcaaatgccactgctgcaaagctttctttgaccctctggccacctcccaagccagaagttatcttccccctccatgtactctagccttttcatgacactgatattttcgtgacactgacttatagttcactgtttacctgttggtctaacagcaaatcataaacagtagttttcaacatacttctaaggctaaattcatttccagaagtagcaaagcttactagccaaaggctccacatttatcaactcttaagagctagacttgagagcctaacagcctatatga

SEQ ID NO: 134098 - DNA, 1105 bp, Homo sapiens
ggccccgcccccggacttgcaggcaaggtcctctctgaccccagggacgcctgggtcgtctcacgatatgcctgtagacagtctgctacagacaacttagttacctgctgtatgggaagtagagacctccggcctccttcctttggatcacaacgtccttcagaaagtccaatccctaccgaaggaaaaatataaccggggtcagacaagatattttctcaggcagttactagaccctcacagatttgcgctgatgtggcctaactgacgcacgtacggcagggcggggtcggcccgcagtggccagctgggagctacgagcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgaggcggccgcggggccggctgcgcgagtgcggacctcgccgtggagggcggccgcgggcatgacccctgagagaagaccttccctgtctgcggttcgcaaagatcggaactgacatggagaagtcagggttgtgagcgagcctgtggttctctaactttagtgtgggcccatttaaagttgcagattgctggggttccatcctccaggaagttttcatccaggtgccctgaggtggggcccagacatctgcattttaactgggtcatagggtgattccgaggtagatagtctttggggctctgagaaacgctggtattagaagtcagcttcagtcaccttttactaatgagtaactcgcgtgttgtcttcccg

SEQ ID NO: 134099 - DNA, 1038 bp, Homo sapiens
tagcagtctgcctgcctcagtctcccaaagtgccgagatccttccagagttttttaatgcatttccaagacactacaaatataaattctgtttccctttccttttttatacacatggaagcttacacgtattgttctgcctttttcacttaatagtgtatcttggagttctgtccataacagtggaaaaatatctgagatatatctgagatatatttcatttataatgtatcttggagatctcttcatgtcattgtgtgaatatatcattatttagccagccccatattgatggacatttgggaagttttcaatctttttgctgtttcaagtaatgctacaataaatacttttgttatatagattatacttgtgcaaatatatttgtaggataaattcctagcaattgagggatacaaattacaagtaatgctacaataaatacttttgttatatagattattttatacttgtgcaaatacatttgtagggtaaattcctagaaattgaattactgggccaaagggtatatatatcatagtagtttgataggtactaccaaattactctccatagaggttgtacagtttacactccactaaaaatataggcaagtgcctgaatactcatattcttgccaacaatgtgttatttaaccttaggtttttttccagtctggtcggtgaaaatgttatcttagtgtaactttaatttctttctctcatgagtaagttagaacatctttttcatatgcttaagagccatttatatttccttttggtgaagtgtgtcttatatcctttgcctattttgggaggtgggggtggtttaaaaatcactttgtagttgctgtttataatatggagatttgccctttgttatatgagttgcagcgtatttccccgtagtttgtcatttgtctttcaactttgcttatgatgtttttgctatgtagattttttaaaaaatgtacttgaatttgtcagtcttttatgacttctagatttagtcatagttagaaaaatctatactactccaa

SEQ ID NO: 134100 - DNA, 1075 bp, Homo sapiens
agttacaattttttacttctgtaggcagatctaaagttcttcagctttctttcctgaaactataatctatctcagcgttttgccttatcatgtccatagcagttcgtaaaagttcaaaggatcgtcactgaggtagtgattttaaatgcaagctggaataaatgaattatggaagttgtagaaatgaaaagatttgctttaattgatagtcatgacttgaattgattagcgaggtttagagttttaagtttacatcagggttttttatggaagagcacagacctctttgttctaagactctgtttgaactaagatgcatacgtagtttggtttcaagtgagacgtaaatgacttaaacatttttattctttactgagggaaatcttttatgtttgtttaaaatgtcaaacatttcccacacattatttttttagattaagtattaatatataataatctgtcctcatttcattgcataccctcgcaaacttcatttgaatcctctttaatagtacataaattatggctttaaaaaatattttgagtggtcatggttataaagttctcctttatatttgatctgttaataataatgaagttatcattattcatcataatgtgaaagaagtgtaaatacctggaaatattaagtagaagaaaggtcatagagtaattcatttttcttggttgatgtgaaaatgagagtgtctttatggcaataatgtaaagcatagagtaactattttaagcatttgtaaaaatcatttagagcttttaaaatattggctatttgccatactgttttaatgtaaaacttactctgtatcgcctgcctttgctcttcctttaagttaaataaatatattcagataagattaaaaacattctcagttgtgataaatctacaaattactttttagtccattgactatggccttcctaaacaattgaaacatttttcctagagaggtaaagcattcataggctttaaaggtaaaatagtaatgcagttttataaaatactatttcagttataggtttggctgaaaggggcattgagagaacatgaacttag

SEQ ID NO: 134101 - DNA, 1034 bp, Homo sapiens
tcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttag

SEQ ID NO: 134102 - DNA, 1079 bp, Homo sapiens
aattgataactaagataatatctacagagtggatgccattaattctcttagcagtcacgtgcagaagggaagggtttgggccaacctagggttgtgctgtctctgtcgactagtctaggaaagcacccaggtgtcaggtattttggtcccttccaccacacctcagcaaatgtaaaacaagcccacagttaatggccctgtggcaaccctgccctggagaatctcaataagagcatttgaaatgaggaaagcaagatttcacatttaaatatcttgctttggcacacagttgcttttattgattaataagcaaataattataggggaactactattcatcgaatacacttattaaaatattatagcaccataaactatattggtataaaaatgttttattctttcttttgtagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatac

SEQ ID NO: 134103 - DNA, 1021 bp, Homo sapiens
gttacaaagctgcatagttttcagtggttagcccctaactatttttcccttgagccctgttatttttagtgtgatgttgcagaacaaagtttttttttagttacatatatgtaatttaggaaaatatataaagtgcccattaataaaaaatggttaatttggggtacagcatcttgatagactataatgtgccttaatgataagcatggaaatttttctatgaaacaagtacaggaattagaatacaaaactgagtatctggatactatgcttacaactgtgtaaaaatgtttcacacatacctggcctgcaatagttgtggtaggatggtgggactataggttagcaaaagtttttttaatactgtgaagttggtaaaatagagataagtccattttaacagtttacattttatttgactctggttttagaattcctggaaaactcaagcaattcgtatttgacttacattctggaaaactgcacagagaattccatcatggacctgacccaactgatacagccccaggagaggtaggactcctgtttatttttcaatgagaactctttttttccctttttcagttagcctcaaagagggtctgaagttcttgcatcagcttgagcttcagcttctgaatatttgtgtagagaaattctgagtagaaattaaccttttaaattaatttttaaagctttaggtcttcagaaaagttgaaagaatattataacgtagtttcttgattgtataaaagtgttctgatgtgacctctgtggaatatggctataacagttaaatatagttggcttcaaatgggaataggaaataggaatctaaagcagataaatcagtgaagaaatcagtggattccaataactatccaagccttcctctgtggctggaagattgaccacactataaagaaagtaatgatttgttattcttgctaaatcattctaagagccttcacaaatacactattcataatgctcaaaaccttacagtttaatgcagctttcc

SEQ ID NO: 134104 - DNA, 1208 bp, Homo sapiens
cagctacctgacagtcatttgtatttgtaaactgtgcatttggcacctgctggtctctgttgcattggagctagtggggagccaaaatgggtatacaatgaagttattggttggtacatctcagtgggagttattgaagggaagaaacagcacttccgggacctcaagagaggataaaaagtaaaagaaactggtaatattaactacaagccagctattgtttgctaccaaaaaaataatgattttaaaagtcaatcaattctacccaaggaattaaagtgtatatggacctgcattttaattcttgtaacagaatgaaaaagtgtttctatttaaaatatataattaattttttaaagcaccaagatctcagaaggcagacaattcgtatgagcagagatataaattcagacaagcaatgaaaaaaatgcttaatttgtgaagaaatgtaaattaaaatgcaggtatcttttacttatcaaattagcaaaaccaattttaatttaaaaaagacatgcttggcaagactttaaagaacaaacaggtagacagatagtaaaaaccaactgatgttttataggtataatttgctcacacttggtcaaaagctcttatttgttaacccagtaatcctactttattgtatataactcaaggaaatattacaaagaagaaagcctggtacataaatttgtttagctcagtatggtggtgtctgctacagtgcattgtttctgtgctgcagatttgctcatacatgattggtaattaagagaatagtgtccatagaaagtgaagttgtgtcagtttatatatcattatcctcagaatatcctgaagccatcagaataagctttttcgtaaagagaatgccgcaagggtgtatgaagatctccaaaacaaaacaactgaaaatcctggggaagtccccttgttagtgtaaataaaagctagtttaatgatcttgagaagtgctttgcttttcacaatattaagctatccaatgaagttgcatgtgtggtttgaagacattatgaagacatttgcctctatgtttaggaaaaaaaacatgaaaatgctatgccctggttcaggttaatttgatgaaattggtttcactgtctagtgaaggcccttaaggacccgaacctcaaaagtaggctcacaagctttacgttaaggctgcagaggatcacctggttgacact

SEQ ID NO: 134105 - DNA, 1002 bp, Homo sapiens
ttgcactaagtcaatatgatttctaaagaagttatactctgtgccctaagaactaaaagcctacctattttaagtgttagatatttaggttttagtttttctgatctatattactcttaagaatgttgggtgctttttttttagtatgtcactttttgtgagcttgcaatcttacaaaaatattttcaagaaaatttgaatttacctctcaaaattcttttttcttaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattgtgagtattcattttgttttttaaaaattactgatatgtttttcaaaaatgaactgaaaatagttgtttgaatattttaaataatcctatgttggaacagtaagactttgttaactggatgggagaggtttgggtgactgctgctttttttcactatagagtgtggtataattatgaacattatgatatagccttgtagaaataccaacattaagtgattagaattgataatgaatgcttggatgattagtgattaatgcttgggaatcaatctctcaaagaaaatttttgtcttgtgagaaattagctcttcattgagtttggtctttaccaagcacattgagaaaaatagcttataaccttaggccagggtaaaggaaattggtaatattgctgttcattcgtgacttcacatagcaagaacattagtagtatttatgaatcttgctattactaggcgtttctaatggcatatagctatgaactgttccaagaataggtaagctttctgactcaattctcagatatttatagtattaatatatgtacaagccttgtagctactacagatactgaatttttatcagctttgtgaggtgttaaatacagtggttaaaaatgtagatgttt

SEQ ID NO: 134106 - DNA, 1286 bp, Homo sapiens
tggggaggtcgaggctgtactccagcctgggcgacacagtgagaccctgtctccaaaaaaacaatggtgaaatttatggtatgctaattgtatctcagttttttaaaaaaataaatgtaacaagaggcttaataattgatcttatatacaagtgaaataggcttaaatatggagatgagagccagaagaaaacttttaatcctgtaaaataggtcccagtttgttttttaaaaaataaaggacatttgtactttctggtgaggtagttcctagatttatggagagatcctcaaaaggatagttgatgaaaataattttgttatgagaccctttctggactttttctgatgagtcagaacttagcatttgttggggagaataaatgattaaatctgtctacatatcacattttatttaatcatgtctacccattgtagtattctccaattacaacaataaaaattttaatagcactttataattttcaaggtgcttttctgtgtgtataaataaagaggtatataaaaatatataggggtaggtatttattaataatgttaattgtatattggttgagaattagttaaataatggaggttttgttttttaccctggataaaacacttcaagctttgggtaagttttatatgtaagtgtaatggtttttgcaaccttagaatataaaaaaatacaaaaaattttgcaaatcagatttatttattgctgatatactgtttttcactgttacttgtgaagactgaaaatactagtcatgtttaccccactctaaaattaacaccttggtaaagaaccagcatagttcacctctatatgtcatgaattcaacagcctaaccctgaagtctcatatcccatactggctaacagacagtgggggcagatcagtttctgcagcaaagcagggcatgtgggtcctctgactgtctgggtacttgaggtggggaggggagtgaattcagtcttctgttcaggctaatgtttattcacaccactgggccttttttttcccccgggatattgcaactattgcattacatgggttgggttcaaaattgttcctacctagaaaatagctacaactgaatggagaagcctgataattctcattgaatgcttctctctacaggaattgacagaagaaggactgccttttctcatactctttcacatgaaagaagatacagaaagtttagaaatattccagaatgaagtagctcggcaattaataagtgaaaaaggtagacagattaaggtgtttattttcat

SEQ ID NO: 134107 - DNA, 1014 bp, Homo sapiens
ctcccacgtctgcctccaaaagtgctgggattataggcatgagccacagtgcccaacccatattcattaaatgctgcaagcacagtcctgcagcagagcctgaatctggaagtgcttctcccagatgtcatctcatcagaaagtccttgcctgataactttatttaaagtagcactaccattatttaatttgtcattctttacttattccacttattttcttcatagcatttttttgtaaccaccaaagataaatatatctacttgttagtctgtctctactcaccaaaatgtaaactccatgagagagagagttttgatagttttgttcactcccgtttatccaatgccaagaccatagctggtacaaaggaagcacatagtaaatagttattgaattaattaattaatggaacacatttttttctgttcccacggttatcaatctaggttagcaccccttgcctctatctcctggactactctagttagaaactagagataaatcagtgttcaattaatctaaaaattgattacaaaaataatttgttgtagtactctacaaatgtttattaagcaacttctgtgtgccagatactgtactaggttcaggaaacaacaatggacaaataaacaaaaaattacttatttatggaactatattttagtgatgtgggttatttcgtttttgtttttttttaattagtccatgtgaccaaaccaatgaccttgatccctagttgccggaaaacagtctggggtcaaaaacaaccttttagtgctaaaactcccaatctaaacttacacaaaacacaaaaacaactaactaaaattttcctttaaaaagtctgcctcatattaaacgttttctttaaatgtatacttttcttggtattgcatagtcttgtaatagggaagatgatggataagtatatatttcaagtctgtaattcctacattgcaaaattctgtcattcaggtttattactatttctcccttcctatagggatgttt

SEQ ID NO: 134108 - DNA, 1059 bp, Homo sapiens
ggaattaatttttacatgtggcatagtgtatgaattggagttcaattgtttgcatatggttctggcattatttgttgaaaagactatcctttcttcactgtcattgcatcttgctgaaataaactgacactgtatgtgtgggtctatttttgttctgtctcttctatactgttgatctgtttgtgcttataccagtacttcgtagattactatagcttataaagagttttgaagtctggtcaggtaaagctttcaactttgtacttttttttcagagttgtttggcagttctggttgatttagatttccatttaacttttagaatcagcttgttaatttttaatgacaacataaaaggcgactgggattttaactggggttactttgaatcctcagggcaatttgtgggaaattgttattttaatgatactgattcttcgaatccatgaagattgtatatctctccatttatttaggcattttcagtttcttccagcaatgctttgtggtttttcagcctacatgtcttggatagctttatcagatttattcctaagtatttcttatttttttgatgctattgtaaatgatactttaaactttatttctggaataattgtagatcatatgtagattatagttgcaaaaataatacagagaattcccttatattccttacctattttgccctaacatcaacatcttatattactatggcacatttggattttatttggattttatccctcttccacttaatatctttttgttgttgttgttctagagtatcacttttaggcataatgtcttcctggttacctttgatctatttgtttctcagtcttcattttttacaaccttgacagttttgagtaatattctttaagaattttgtagaatgtccttcattttgggcttgcctggtattttttttctcatgttttggtcatcttttgtgagatctctcagtaagtatttcttattttggggtgctgttataaatggcattgattgttaaattttaatttttagtttttttgttgctagtttatagaaata

SEQ ID NO: 134109 - DNA, 1349 bp, Homo sapiens
tttatctgttcacttcctgacagacatttgggttgtttcgacttgctggctattacaagtaaagctgttatgaacattcagatataaatctttatacaaataaggattacaaataaagctgttataaacattcagatataaatctttatacatatgttttcatttttcctgagcaaatacctagatgtgaaatgctaggtcatatggtaggtccatgtttaactttttaagaaactgccaaactattttccaaagtatttgttctattttatatacccactaatagtacatgagagttccagttgttccatattcttgtcaaaacttggagtggatagtctatttaattttacatattccaatatgtgtgaagtggtgtctccttgtggtttaatttgcatttttctaataattaatgacgttgagaatattcttacatgtttatatacattcatgtatctgtgatgatgtgtctgttcaaatattacacattttttattggattgtttattttcttattgaaatttgtttatttatttgtttgcgacagggtctcactgtctcgcccaggctgtagtgcagtggcacaatcttggctcactgcagtctcggaccttccaggccccagtggcctttccaccacagccccccaagtagcatgtgccaccacacccagctaatttaaaaaaatatttttagagacaggtctccttatgttgcccaggctggtctcaaactcctgggctaaagtgattgttcctcctcggcttctgaaagtgctgggattacaagcatgagccactgtgccctgccctctgagttttgagagttctttatatattgtgaatacaagtcttttttcacatatgtaatttgcaaatattttcgcccattctacccttgtatttttttaaaaaaattgtaacatatacataaaattactatcttaccattttaaattgtacaatttaatactgttaaatgtattcacattgttgtgcaaccagtctccagttcttcatcttgcaaaactgaagctctacacccgttaaacaacagcttcccattgcccattctccccagcccctggcaaccacttttctaccttctttttctacaaatgcgattactctgggtactccacataagtggaatcatacagtatctgtctttttgtgactggcatatttcacttagcataatgtccgcaaggctcattcgtgttgtagcatgcgtcagaatttccctactttttaaggctgaataatatttcgtggtatgtatataccacgatttgtttatcatccatcaagaacactggttgattctgccccttggctattgtgaat

SEQ ID NO: 134110 - DNA, 1017 bp, Homo sapiens
acatgatgtttttggtgtgggttctcatttcaaatctttctattctttatgtatttaattagatgttacagtgcagataagacttcctacttttactgaatttgaaccataaaattggaaattatgctctaaagcttacattcattgggaagaaaatttaatacttatatccttgaaccataaatatcatttattccatcttttaaacagataacttttgaagaaaatctgacatcattgctagtaagctttctttttatgggggcaaatagcacagttcagatgcttttcaatccaccagcaagttatctgaggtattatgcatattttgaggtattatgcatctctctgaatattttttctcttctatgtaattcttttaaagaaatgattgttatgaaacccttattgattaatgtatttacattttccacagtctctttagagattgtaagacaaactgtagttttgttaacctcttatgtgccaattagattgtagaggttttggactggaagaaccttaagaattctgtgttctaaagagaaatgccttttaggcagattattctgtggtcgaatttttttttttcctaaccatttaaacaactttaatttatatactgatatacgtatcagtgctttgaaaaatagattgttcaatcctaaagcagtttttaaaagagatttattgaggtataattgacatatgttacacaaatttaaattttataattttataggttttgatacatgtgtgtatccatgaaaccatcaccacaatcaagatattgagcatagctgtcatcctccaaaattttccttgtgcccctctgtgatccctgtctgtcccttctatacctcaccttcatcatccttaaggaccatctactttccatcactggagattggtttgcattttctagaattttatataagtgaatcatacagtatgaggttttttttgtctgggtttttttttttttctggacttagtatgtttattttgagattgttt

SEQ ID NO: 134111 - DNA, 3335 bp, Homo sapiens
agcatcttgtcagtgctcaaacagttttagattttgaagcattttgaatttttagattaggggcattcaacctgtattaagacaggtcctattttaaacatgaaccatgcttaaatacttaatgagtggcaaactggacaatctagagaaaagaagcccttgatgtgtttttttacgtcgcccttaagccataaagaggcttgcccgctctttcttcactaggtcagatctaaatttttcaagaaaccattaatcagcccctactccttgcctcccttgccctccagctaccttattttcagcgaactgtaagaacccacaaacctgcggtcctagccgctccagttcctccattctatcaatttattgatttaatacatatattgaatgtttattagaatacatagtcaaataagacacggtccatgatgtccacagaccccatcctcttatccctgatgggagagatttaagaatgctaaaagaggaaagagccacttgaaagcaagagattgaagatacagatgtgtctccttgatatattctaggacatctccttaggaagtcaggtgagtgggctagaagagatatatatatacaagaagaaatagggaggaagtataatgtttgcatcctttcacaggctttccaatatttttattgtattaaagctaatatgtatgaactaattacatgtggattaaactgttcactgacatcatttaagtaaatttggtggaaaagggctctggaagcaacagtagcaattgtagtttgtttacatattcttaatacttcttccgtaagagaatggccattctaacccagctggttgctaattctgattcttccccttcttattgggtccctttaattacctagaacatagtcatccatgacatgatgtttaggtcaatgacagaagtcccatatataataccgtatttttactgtaacttttctgtgtttagatacctgctattgtgttacagttgcctacagtatttagtatattaacatgtggtacaggtttgtagcctaggagcagtaggaggctgtataccctatagtgtaggtgcatgctaggctataccatctaggtttgtgtaagtatactttatgatgttcacgtaatgaagaaatcgcctaatggtgtatttctgagtgtatccctgtcgttaaacaccacatgactgtatttgtgaaatgtttggcttgattaagggacagttagaagtaacaagtttgtagaatattgtgggggtttgtgccttgtgtttaaagtaaaagaaaaaagaaaatatagacaggaagtcttggttaggaatttaagatatttgcttctggacttactgtatttagtatgtttacagatataaaagcccattttatcaaggggtaaattttgaggggaaatagttaattatataccatatattcttttaatataacttatttatttagtgtgttaacttgcctgtgagatttgatagaactagccaggtggagaggtctaatatttgcaatacagttaaaatattttacacaatagtctaaaattttattattttgaggtgggaggattgcttgagccctggaggtggagggtgcagtgagctcagattgtgcccctgccctccaacttgggcaacagaatgagaccctgtctcaaaaaaaattaaaaataaataaaatagagaaagctaatttttcataaatgttcaagcctcagtagttacaaatcctaacagtactttgtagagggcttatttcagacttgttttatgacctctgcaagagatccttagctgtgtgctccataatactggcaattgtcttaagatgaataaaaccaaaatctattatacattcttagaattggtatacagtctttgaacttaaaattgtcttcatctccattgaacgatgtcagggtccatgattaaattaagtgtgtgattatctcgcagagtcgtttattatgcctatatcaaatgtcagtgggcaataacggaaataagattttattacttctgcttttcatttctaattggcatccttctctgtgtataggtgtcgtttcagtcagatgttgcatccaatttttgaggaagcttccgatgtcattaaggaagaatttccaaatgaaaatcaagtagtgtttgccagagttgattgtgatcagcactgtaagtacctcaataggaagtctagaagagactgtcccatcccaaacacaggcacacatacacattttttcttttcttttcttttctttttttttccttttctttttttttttaaatgctctgcttttaagtggagaacaaaccgaaaaggttctagtgaccttggttaaattgttactatttaatttttatgtacttagaacactactttccattttgcttgtgtgaaggtttttttgttgttatttaaaaaattacagtaggtcaagcgtagggaacaaaactagcagtgttttctaccaaagcaaataccaaaatcagtaaataagattgaaatgtagtattagaagaaaaaatggatttctgttagttttagaatcatgtgaaaataccatttatagtcatttcaaataagatagtctcagatttttgtgtgtttctgtttttgaaaagattctgttttgaaaagattctggtttagactatttttgagtctaattagctgtagcaactgattataattattaagagtgttaagaaacttagcttaggctcttaaaatccaacctcttgcattttgcttgtcctggtggagcattctctataaaatcctcatggtttttcgtatacatgaaggatttgtctaacttgaactagtgatcttgctagtggtgtttcctcctgtgtgttcccattatacttgaactttcctctctcatcgtgctaaactcattgtatttcgtagttctggttcattgtgtcttagttgtcttatcagctgcattgtctgttcattaaggcaggaatttttttttctttctttttttaatgctcacttttaagaggagaccaaaccacttattaatctctgtgtctcaagcatctgacagttgctgggagacagagactgctcacgaaaagctattgcattgagttatttgtaagttggtgtgaatacagaactgtctcccattcttcaagttttctatttttttatacttaacctactgattaaaattagtatgtgtgtacacacacctaacttttcattttactgatgaggaaatggatatgaagtggcttaatcaatgttacatagctcagtgtctggtaaagcccgaatttgaatcctgattttctgaccaa

SEQ ID NO: 134112 - DNA, 1064 bp, Homo sapiens
taagttattactgtaccttactgtagtctttataaacagtaaacttacgcaatactaaacgtattttaaaatatcttttttctttaatactaaattaactagcttactgtaactttttaactgtataaacgtttgactcttttgttataatatggaggttaaaataccaacacgttacatagctgtacaaaaacatctttctttataacctcattctgtttgcttgttttattaaaatatttttttctttttagcttttttgttgaaaaccaagacaaaaatacacacattagcctagacctacacagggtcaggattatcaagacatcaagaggctccaggaatttttcagcttcattataatcttatgggaccactgtcatatatgtagcctctcattaaccaaaacatttttatgcagtgtgactgtatgtgctgaagtgcctggaaatcgtaccaaagaacagctgggggaaccaactgttaagtagtgatgtagaggggtttctgcaataggtgggaagatcctttgtgagattccttctaagtctgtggatcatcaccaagtggtgtgctttttgctattatataattaaaaccaaattatagtatagactttatttttatttgataacctcagtttcctcaaacatgttaaaatgtttgttcgcaatttcaatttctggaccttttcctcctacttctcatatccaatatcgtctctctaaattcttagtgtgttaacatcatctacctattcatccatctaatcattcatttagtacatatttgaatgtttcttgtgtacaaacagggtacagtgatctgtgggatacaaaattgaataaggtggtctctactttcaaggtactccccgtctgttggaggaagtaagacaccagtgcaaataactaatttaaggatagaattaatttgtttcttaaagacagaataatatgttaacaccctatagaaagtgctcttggtgttcagagcagggagagatataaatttttaataaccatctaatggaagaaaacattctttccttgctgaagaagctc

SEQ ID NO: 134113 - DNA, 1804 bp, Homo sapiens
atcagggatttgggcccaaatcttggatctgctactcaccacccttctttcttcttaacatctctattttcctattaacttctgaggaataatactggtattatgtctgactcctaagtggtggtgttattccatgctactattatgattttatgaaacaaaaagtggtgaaaggtatccccttttctcattcttagatctcagtttgttgtacaatgccttattatagagtaaatgcttaataacaatttaagtactgtggaaaaagaaaaggtagggcttacgtgagaaggatcaggagtgtattaggggagttgtagtttgtaagcatcacgggacaggtgagccttgaagcaagtgagggagttagtcatttggatttcctggaagaagagccttccaggcagggccgttagtcagtgcaaagcccctaatgtgggagtgtcccaggcatattcaagaaatagcaaggagagcagcgtgattgtcatatagtgaataagatacagcatattagaagatgaagtcatttagttaaaacatattttgcaaaagtgtacttgcccttactatgtatgttgtttactgataattgtttttctttttctattctgtgctttattttattttttaaaaattgctgatctgactcagtagggaagaacttcctaactgggtggctgatattattgatctcttcagccttgccccatttgcctctgttgggagtagcctttgttgttttgattctctgttacaggaggggtcccaacttgcagtgtgaaaaatactgttgtagtaacttaaaatgttaaaccaaaagatttcctgacgtgttttttgattcccgaaagtgataacactttcatggtacagaaaagcataatgaagaaaaaaatgcgtacactaaccactgataacattttagtgtatttcctttcggttttattctgtgcatatgcgtatggatttttaatagtaatgtgtatattttgaacaatataagattgggctctttttgtttaatcctgatgtagagtggtagacttctggttcatagaaatatagaaagaaaagataccacatgcttagatgtattctaccacttggaaataactcctagcttgaccatgtaacttcaaaaagttatttaacctttctgagtttccattttctcacatatcagatagagataaagacctctcctgcttagttctggggcagctaatgagactgaatgtgtctgtagtgcattataagaaactaaactctcctggtttttgccacataataggtgttcaataaatgttaagatgagggactgagtgaatgaatgaatgactaaatagataccctttttttgaaactttcaagttgtctgtccaatggtattaaaattgtgtgcactgatgtaatgagttcacttgaccagcttccggcctttgtggtctgtggtcttcttatcctaataattacattgtcattatgccaacaaaaacagcttaaaaatgtgactgttaagtgaataagttatcagcttagctctgttttataactgtattttaattagtgttatacataaatttgttatattattttgaaaaaagcttatggagggagttgtgttttgtcgtatagtccattggttttagaattaaaggagattagggtttgaattctgttctgccattaatttggacacgtcacttagcttatttgaatcttattcatttaataaatattctcccttttactgtatgccagagactgcaaagtttttttttttatttataaaatagggata

SEQ ID NO: 134114 - DNA, 1067 bp, Homo sapiens
cccagaagcccctaatgcatccttctctccccactagaggaataggctatcttgacttttataataatcattacattgtggttttaccacctacatatacatccttaaacactttagttaattttgccatttttgactttttgctaaatgttccatgttcacttgaactaaaaaatgtatgtatattacatttttgtcattttcctgctcaaaattctttcattattcccattatacttggaataaaatttgacaggttacttgtatctctttacctgtccatcctcacgttttacctcacgtggtaaaacttgccttctttcagtgtctcacacctgccaagccctttttcatctcagggcttttgcctgaaacgctgttctccctattctctgtctgaataactcttagtcatccttgagatttcaattttaaggtcacttcttcaaagaggcctgctaaccatccagtctcaatgaaatctgttcattgtattccctcttggccctctgtagtttttcttcatagaacttgtttcagattatcactgtatatttatgtgtatgaatattttaacatctctctcctccataagctagtggccttcatgaaagtagtctgggtctgtttaattcatcactaaatccacaaaatccagcacagtacttggcacataagaaatatatttgttgaaggaatgaataaatattttaatcattctttaagtatcttttctcccaagtagtctataatcatcttgagggccaggactaaaaatgaattgagttgaattaaattgaattgaggagcagattgggactaaattccatgagaaaaaaaaattttaagtcaggacgtatgaagaaaaagtaccaagtaaaatgaattcattaatgctttaattaaaaatataaccttcaaagaaaaaagtgcagtatgttataaattaaaaacacttatatttttatggctcagtcatacagattaattaatgtgttattattaaaacctgaaaccttgaaaatccccaaagagaaaatccttaaaaaccaaaaagcaatcatgat

SEQ ID NO: 134115 - DNA, 1006 bp, Homo sapiens
gtatagggtggtgctctaagaaacctagtattaaacaacagctgggagactagacagctgagtagagattattttaaattatcctatattttcttttatgtttaaatctcttaatatataacacattgatttttgtatggggatccattctcattttaaagcatatggataactaattttcccaacacaacctagttcattaatttttggccatttagtatctgctctctgtcagttccaggcttttgtactacgaactccctatgcatttctgtttttttaaatgagggatcctgaatactagggagcctttgggaaatttgaaaataaaagttacatgatcagtgtattttagggggactaatatggcaactaaagctactttggaagagaaagagtggagatacatagattgctattatagttcaggccaatagagaggaattgggtttaagagatacattatggaggcagaagtgttcattcaacaagcgtttgttaaatatctactatgtaatcatgattatacaactagagagaatatgaaaaaaatgaattacgtatgttagcttatagatggatgctctcagtacccatccctattaatcgtcatttccctttgtttagtgaaccttctgatatattggatatcaaatatcctttccaagtattgtctgtcccacttaattctggtatccatgaatgcagaagtgtgctatttatgtaatcatgaacactcatgtatatgtgtataccttcattcattcaacatgtgttaaaactattatgtaacaggcatcatgttaggccttggaacacaaaggtgaacaacatgattcctgctcttaagttgcttacaaagatcatggatgaagatattaaatgataattaaagctgattgatctaccttgtaatacataagtgttttataaaatatctatagccataatagtcattgttattattgacatgagaagaccaaacattctcatacattatttatta

SEQ ID NO: 134116 - DNA, 1065 bp, Homo sapiens
tgatgttgagcattttttcatgttttttggtcatttgtgtaacttctttataaaagcaaatattcttaatagtgcagacaacccaaatacgtaccaacaggtgaatgagtagctaaattgtgatgtattcctacaatggaacactgcatgaatgaactgctgacacgttcaaccacataagttaatttcatagacattatgttgagtggaacaagtcagacacttataaaaaatttatttgctgttcatatcaacctcaggaacaagaaaaactaatctatggtgagtcaaatcagatttgtggttacctaaaagatgggtaatatactgagaagaatatgaataagctttcaggggtgctgaaaatgttctggatcggtgtgtgtgttggttacattaaaaggtaccagtctgtatgcttaagatttatgcactttactgtatatgttatattctcaatttttaaagtattatttaaaaaatgataaaatgttcagaacttggtagacattatttgtagggaaggtaagggaggacggaaccaagaatggttcctgacctagactgttaagcactcaggtcaaatttcccccatccttagcctcaggagctatatgaaagccctgtgtctatgctcttatccaggggttcttagatgaacatgcagcagaatcacttggagaacttgttaaaacatagacgtctgggccccaccaccagtgtttttaattcagcagggctggtgtggggccagagaatgtgcttatctaacaagctcccaggtgatggtgatgatgtaggcaacacactttgagaatcactactctattctgcttataccatttgtctttgctgcattttcaatgctattggctccataacctctagatacctatcctgttttactggggactcttttgactggtattcctagctcttgatgacatgactcatagaggtaggatatactagtccaggtacaattttgagaggaagttatcgagttcagttgtgaaaaatggaattttaggcttcggtgataatgactagtatgaattgtgatag

SEQ ID NO: 134117 - DNA, 1121 bp, Homo sapiens
agtatgtaaaatatggtccatgtctttatgatactaggaatgcatcttttttttttttttttttgagacagagtctcgctctgtcacccaagctggagtgcactggcccagtctcagctcactgcaagctccacctcccgggttcgcgccattcttcttgcttagccttccaagtagctgggactacaggtacctgccaccatgcctagctaatttttttttgtatttttagtagagacggggttcaacatgttagccaggatggtctcgatctcctgatcttgtgatccgcctgccttagcctcccaaagtgctgggattacaggcatgagccaccgcacctgggaggaatgcatcttttataatttgtagtacttttaatgttttaccaagttgccagttttttacataagtagaatattaagcatctttccagttctattagctgctatgtgtattgctttggattgtctacataagcaatcatgcatgctatctgtgaataataacatttttatttcttcatttccaatctttatacttttcatttctttgctgtgccatattgaattggaaccttcaatacaatcttgaatagaattggtgataattggcatccttaattaattctggtttctcagatggcaagctttcaacattttaccattgagtaagatgttgctatagatttccttatattcccacttgccaagagtttttttaaatcatagttgggtttttgtcaaatactatttatgcatttatcaacaagatttttttttcctcttttctgttaatatggcaaattacattgactgattttttttttagatgttaaacaacccttgcatttctggagtaagccccatatatattatgtacttttatatactgatgtattttacctgctaatattttaagatttttgcgtctatgtttatgagagagattggcctataattttcctttcttgtattatagttgcaaggttttggtagcaaggtaaggctaaccttgtcaaaaaaaaaaagttagaaaatagtcccttgtttttattctcttggagaataaaattggtattacttcttccttaaatgtttggaagaatttcctcttgaagt

SEQ ID NO: 134118 - DNA, 1065 bp, Homo sapiens
atagctttatatttcctgcagtctcaagatatgggacatctcttcaagggagacttgattaagagagagcaggcacttggggagctggtaccagaacctcggtcttcagtctgcctgaaataacaaatagattctctctctgggtctctcacataacacattacataaacaggtaacacatcttttaactctcctattacactttgaatagttgttctagaaaataggtttgttagaaaatattcagatcctcatgaatgataagctgatgggaatatcaaaatggatttttgaggcctttttatgactttgaattaacaaatgtataggatgccacagtcagaaaacattagtgatatactttgacaaatgatactgaggccccatatgagaaaccttgctgaagacattgctatattttgcttctaactttttatggagcatataagcaaatacattaaaggtttagtagtttttaaaagtaacaaacatatgtctcaatttttctctcttggttttataacttccacaaaattattttaatgtgaactattgtttttggctgtcttcactgtatcttgaatggagttgtcatctgtgtacccctctgcaggtgagcaagaataaactggatttgtacagggggtaccaatactaataatcacagttattccattcactggaatggaactttaaagggagttcttttcttttattgttaaagagataggcccaggtgtgtgtgtgtgtgtgtgtgtgtgtgtgtgtgtgtgtgtgtgtgtcaataaaaggctctgctgagattcttggtgggtggtttgcaaggctgtgtgtgtgtgtgtgtgtgtgtgtgtgtgtgtgttgtgtgtcaataaaaggctctgctgagattcttggtgggtggtttgcaaggctgggtgtagaagactgacatgagcagggattgatttgctgcctcccaaatacatgtggagaaacagcccaaggaggctggcattttgctatatccacctttctgcttcttcctttttaagtggtaaaggcactactaaaacctcgggggtg

SEQ ID NO: 134119 - DNA, 2127 bp, Homo sapiens
caagtttttttctttctttcttacctatccaagcttgttttcctatctgtaaaaatgggaataatgccaactttattgtgttttggtgatcattaaaggagataacccaagtaaagtttttagtatacctgacatttgttaagtgctccataaatgttgtcattaaggaaattatttagcaggaataaacttcaggccaatttctagtcacttagttcactctaaagtaagaaaatcagaagttgcagacttcagctttgtctaatggttggctctctgccttcagctgtgtctgtttggccgggacagctctgttgtttaggattcctttggtgattttagtttggggggggggcggttaaaaaagtgtcttgtatagtttgattggcagattatcccttgagattcgtagtgatactttgaagtaatagtgcttttacatgcatataacacaggtgctcattagtattttttcagtagcctttgtaggggtaatggaagtggcagtggaataattcagaaatagtgaagggaagaaaatcaagagcttggattattcccagactggggaatcagcccatctttgtaaagaagagattgacagaaattgttggttggccctgtagagttattctcagttggcactggggtaaagatcatgagacactagaatggcaagagggagaggcaagggtgaagggatggttggtggtgaaatttcattagtctctagcatgtgcaggagggaacagacttaacaagaaaccattagcatttgaggatataactaggaattttcactgcctgtggtaatgcccaattaatagttccctgtttcctggaagacttcctatggtaatttacagatggggatacagttgccaaagctctgggaaattgtgtttgggtgtgaaaaatactgtcaggtagcatagtgatttgggtgcagttctcagattactcttgtttttctctccagacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacgaaccttctttctttgcactgatatatgaaaataatgtttgggcgttcctattgatgtgtaggctggcttcccggactagcacacgatacatggtcataggcggttgtgcattgtgcatttcataggagctaaatatttacaaaatagagagtgatactgtggtaccttctgttatataccaagaaactggctaaatctttgtaattccatccaggcagacctccttctttgtgtttttgtgatcacaaaaacgatgaatgtaataattagtaaactaaaaaccaaggtaattaagtgaacacttcattgcctatctgtctatctcttaccgttagcacagaagtggcactgatctgaagaaaatgaaagcaacccccaaaatacctgtgagtaaaatatatcactgtttatgcctactgtcaatattctcacagcagctttccccttaaacaatgtgaaagagcccatcatcactggattttatttaaaccaggtgttcttagaatgctaggatgtgtgccgtttcattcttccctgccaacagaaatggcattttaagaagattgctcacttctgcaagttggtcagaaaatacaagtagaacgttgacgcctgagttagcaccttgctgcatgaacagtctggtctgtaaaccctacctgacagaatccttgatactgtaatacggctgttggtattcagcactgagaaagccattcagtgaagacgtggcggcaacttgtggccttgagaggctaacgtaggaactgtaaaatgtaaggaatcaccagaatgtatctatggtcttttggacaatttctaaatgaaaacagtgggcaatgattctgatctaaaatttaaacctgattaattttgaagtaatagtgggacgtgatatgtgtgtgtgtgtgtgtgtgtgt

SEQ ID NO: 134120 - DNA, 2565 bp, Homo sapiens
agatgaattatttggaaaattaggccatatataaggtctatttgtttgatctttgacatttgcatcttcaaaataatttgttatgtgtttcctattaatatgtagagcaagtaggtattaaaagaatctattgctgggcacagtggctcacacctgtgatcttagcactttgggagtcttgaggtaggtgggttgcttgaatccaggagtttaagacaagcctgggcaaaatggtggaaccccatctctactaagaatacaaaaattagccaggcgtggtggtgtgcacctgtagtcccagctactggggaggctgaggccagaggattgcttgagccaggtcacgggggttgcggtgagctgagactgcatcactgcactccagcctgggcgacagagtgaaactctgtctcaaaaaaaagaatctgttgaacttgtttctgatctaaaatgttctgatttggttagtggttttctccttttctgacaggcagtttttcacagtttattggttattcctgcccgaagtcagaactttgacatcttgcaaagtgccatcagtaagcatttggtaagtatccttaaactttttctcttaagaatgaacacaggatgcattggttagaatagagttttccacagccccagaaagagcatgtctggaattctaagattaatgatatcatagtctcttgcagcatgatgcattggcaagaactgaggaatcttggtatttttcctggctgttattaatttacttctgagtgaccttgggaaaagtctcttcttaggacctcacttttctaaatcagtgaaataagggacctgaaaattaaacttcacatcctttccaacttctgtaattcacgtgtgcttggcctcattgtattgagaattcaacatctagactgaagtctgggttccacctagaaggtttggggtccaaagtaggcacatcatctaacccggcacaaggtgtggtcactggcagctgtagactcaaccctgagactgacctgttatttgatattggatgtctcatttccattggtattaaattcacattagatatacctctgtagttgcttttaactttctccagtgtttatactcttatctttggctttttattgtaatgtgttatagtacaaagcagggctcccaaattatatctttgagaaacacacttgtttggataaaatataggcacatccagactcctttttctcttaaaatgttacttcccttgagttggaagagagtactgctttgaattcctagtactttctccctgctgtcaaacttccagtccttatccctgtgccatcaacaatgcccacttttttttccctacctccactccagagaattagactctccgttgactacattcattattctagtaaaagatcaatatgccagtcagtcttggccactattttcacacagcctgtggaggaggttaagacatcagagtttgcagactttgtaaaatcattacccaacagtagtctccaggagattgaaaccatgtatatatacagttacaagttagactctaccttaatgacaatgcatacagtacattctagatgaattagcaaactctaatgacccttcctgggtttcctggcagtgaaacagtcaaatgttaactatagtaatatcttttactgactccagtagaggtatgtttattcatgtctgaatgactaaatcaaagtgcagaggaaggctaattttgaaatgaactatttatacatttaattacctggcatatgagtggtgccacatgcaagttttccagcctgaataatttaaaaatttttaagtatgattgttggtattcagattttctttgagtgcatgaaataatccctttaaatagttatttctaaccagcagtagacattttatagaacatttagaagattctgtcatgaaggggaggcagtggattgggttaatagcacttcttgtgtttgcatgttttcaaagtcatataatttagggattaaattctcaaaggaaaacaggaccttaaggtgtggcaggtggcatatgttaggtatatattggttttcagtagaaataatgtaaagttaatcgtgaattaacaggttttggttttatgtggaggagcgggtctgttatgaagaggtgattaatctcgtttttctctgcttaggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagaggtaattattttttattcttcaaccttaattttcctactgttcctcctcccccaaccaaataataaaatagacagttaaagataattaggttatacagataccttaaattctgtttcagagagtttgtgtcagcctagctagctttttctttgttccttcatgaatcccctttgtgttgtagtgaaaatttttagt

SEQ ID NO: 134121 - DNA, 2330 bp, Homo sapiens
attgtgaaatagacctagttacaactttactaagaataagaacacatagttgccttatagtggctttaaagataagttttctttgcctaattaagatacttttgcttagttatgtaggaagctgaagcttgtttaaacataactcatttgctgagggtaagactataaaaatcaaatagtaaatacatagcagctgaacctactactgaaaagcaaaacttcatcttggctccttagagtctgattttcagatgggatggaaattttctgttgtactatatatgttgatcaagtatgctttttaatgaaagtttgtattaatatgtttgaatttcaaactttcatactagggtacttgagcccttggatatgaaattaatacaaggcatactatgggttttattttaagctactaaatcaaacttgttttcagtaaagaacaatggttatatactgtgctacctttgacaagtctgtcaagttggtcacttctggtaatagttctccctttgttttttatagatcatcattttctgggtggaagtattcagctaaagactggttgatgagtgatgtagactatttcagcttcttattttccacacttacaggtaaccacattcacttgccagattaaaaaagaaaaaacctaatatgaatcacaattctccttctaagatttgccattttatcagtttggttcagttttgaagatgataaatattctatcttggagtgatttttgtgattagtaactggaaatcgaaagaatatttctaacctacatacactgttaggcttctgaggcaggaggatggatgatttgtctttaaatctcttatagtatgagtatcaaaaccctgagcattatttgaatgtcatgttattgtatttttaagtttgatgtactactactattattttaaatgtattatttgaatattttcattgtatacttggataatgataggattctttgaaattttctgaagacttgaaattaggagagttaatatagtgtcaggatccaaaaagaacttgacagatccaatactatgctgaatctagcaagataaatacttcagaagataaatgtaagctcctatatgtttactgtatatttatgaatgtatacatttgaggtgggagaggctgtgtgttttaatagtagttgtcagaaagtttttagtgattttagaaagctcattgggagtcagtactatgacatggctatcaaactagatgatgcctctttaggtagtgcttacagaagtatagtgatttgaacatcaaggtagatagggttgggccacatcagtggtattctgatcattttgagaactacctttcaggagtgactttggcagcttgtttgtgtaggttaggccaagtgtaaatagaggtggtaaggggaactagaaattgttgaatgaactatacatgtattgtcaaagtaaaaacacctagggggatggagtagttttgaaacatttgaaggtctattatctaagaacctaaagcatttgatatatatgtaggagtatattactgcttttacttgctcatttgcttttttaaacctaccattaattggaaagattatgcctttcactctaagtaaaattgtcaaaaccctagtagaagtggtaaaacctgtttcttgctatattatagattgggtctgatcacatcttttatataattatatgaatttaactgtcttcattgctagcattttattttttaaaatatagcatgaaatgcagaagctcagagaaaacaaggtagcttaaagaatgttcacttgaaggcatatgtcatctctgttttttaagaaagtcattgttttttgttttttgtttttttaaattggctttctttgttacctgaattagggttttcgaaagaggagttgacttggcttcagagccttcgaggagttcctcatgtcatccagacacagctttcccctgtgcttctctaccttacagatttggatcaatttttacaccactgggatgtaacagaggtaatagttcatttaaaaagaaactaataattattaaaattcagttcatcaaccagtaatagttactatatatgagttgccttgtgtgagatcttttcaaagatacttgtttaaagtgcttataatcttggatgggagaagtacgtttgaaaagggaaacattctttataaattgtgccactagaacagaacaaatcagcaatttgaatgatagatccatctttttaaaagaggaaagcattatgaaagagtaagaatttgaggttttgaaggataagacttaagtaagagttggtatcct

SEQ ID NO: 134122 - DNA, 1066 bp, Homo sapiens
cagatatttgactctggtcactggaagtgtgcttcataactgacaataaacttgccttttaccaaaacagagaaaaacatataaataaaatattgtttgtatttaaaaattttaggtttatttcttccttgtatatgcacattagaggggcctggacatattttttaagaattttaaatattgattagtttcccatgttttttctttttagatattaaaaaactgcactttgttttgtgtaagcaaaatgctaggccttttaaaagttaaatttttaaaaaaaattttccgtaacttaagagcttgttttttatttgacttccagtagagggcactctgttccttagatataacttacattcagttccgttaaatcaccccttgaatgtttcttgaaattgattctccttggaagatgcatttaatgtcttcatcaacatctgttcacttatgtttaataacttttgtcaaggattattttaaaatcttggggtttttttgcttttatctttttgtggcgatgagtggcgagaattgggaaaatatattaattttacaaatactgataatacagactcatatttaaatgattgtcattgtagttaaaagtctaccaaattaaattttgctttttagtatttgtacagagtccattagtagacttctctctatgtaggtatattattcccatctaaagtagtccctttttaaaaagaatacaaaattaggacttttcagccttcttgagcccatagcaccatcattttatcacttttcatagggtcataataagactagccaggcgcagtggctcatacctgtaaatcccagcactatgagaggctgaggcaggcagatcacttgaggtcaggagtttgagaccagcctggccaacgtggtgaaaccccatctctattaaaaatacaaaaattagctgggcatggcggctcatgcatgtaaccccagctactcaggaggctgaggcaggagaattgcttgaacccaggaggcggaggttgtagtgagctgagatcatgccgctgcactctaccctgggtgacagaag

SEQ ID NO: 134123 - DNA, 1559 bp, Homo sapiens
gtagctaatgtatagcagagctgagacttaagttcaggtctatcttgacagcaaagtccatgatagaatcaccagcctttcaggggacctagtgaaaatgttcactgttattcaagacatttacactccagcaagtattctaaagaaataaaaatagcacaagtttgaagctattttgtatgggagcaacttatggtgaatgtgtacatttgttaatatagtataataacaccgattaggataaatagttaagtgtctctatccttcaaaataaaaatacaatttagatactgccccagttaacattaatttagtgggtaaagccttggaaaatgatgctggcatcttgtaggttctcaaatgtttaaatgaataaatgtggtattattgatacataattagtcactttgtgatatatttaagttaaaaaaaaattttttttttgtttaaatttatttcccttgtctttgagtattacattttattcttctttggcctttctaagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatggtaagagttcatttgtttaatggtatgggtagtcattgatccaccctgatatacaaaagaagtttttaaggggagctctgtaattttgcctttcccttagtctgaattagtaataccatggttaaattgccagaacaaaacatcatacagtaaattcattttcaatatttattagaatatagaaggttaatgattgttgatgcttattgcattcttaaattgtctttcaaaccacttgctattcataaattcaaaactaatctgatacttaaaaattcctttgaagctctgatggcaagacatatctttattacttatttaatcatagtgaatatctcgtatgactttcatatattctttgttcatctaggactgacttaactaatattttaagcaaaattattaaaacataactgggatgtatgtatgcatataattattgaaatataattcacatactataaaattcaccattttacaatgtacagttcaatgaattttaaaaaatatattcctaaggttgtgcaactatcaccactgtctaattctaaaacatttttatcaccccagaaagaaacttgtactgattggaagttcatccttattcctttcttcccccagcccctggaaatcactcatctactttctgtctatatggatttgcctatcatggatattttggaattacataacatggggccttttgtgtctggcttgtttcacttagcataatattttcaagatttgtccgtgttgtaacaagtatcaatactttattcctttttattgttgagtagtattttgttgtatggatatgtcactggtatttatccatttgtctggtgatgaacatttgagtggtttccaccttttgtggg

SEQ ID NO: 134124 - DNA, 2284 bp, Homo sapiens
ctaagttgcaaattttgtttttattaaaatattttattttagattttttgaaattgtgttttgtttggctagagtgaataaactgatattaatatgtgaattataaaattgtttcaaatcagtgcttaccggggtatgtctccttatttcacatgtgagaaagttatggccaggaaagactagtgattcttttaagtcagatgattagttaaaagcagagccaagatctactgtgatttccatccaaatataagcatctgccttaaatcaggtgtgtcagggtttttaagtcttatttttcaagttcccaggcaatattataagggcatttacattttgtgtgaatagcaccttgagtaatgaattgagctgtatacactctgtaccttcttaacaactctgattccataatgaaatggtttatttatagaactgtggcctaagtcttgcctatgcacctatcttcttggccatctattaattctagaagggaattttttaaaactccattgatagattattttaagtattctaatgaagcaggcatggtagacgtaatgctttatagatgtgtgtgtctttgtttctagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagaggtaggtgatgctactttgcccttatttaagagtggagctcttacatgtgctatcttaaggtctagctttgaaatgatggcttgtaaacattccatgtagtcaggctaattgtattcaagccataaaaggtagctactgtctacttgaacactgaaattgtttatggctcagagtatctctaagtgggtaggtccactctgaagcagattgataaagatttctaccctcttctgatctagtttggctagaacttgagaactttttcccttgattgatatggcatgaatcttccctgtctctttaccttttttctagcttaaggttaagttatattaagtcagttttagagtgacttactaattctttgattttaaaacaaagttttcctatttggttcccatctaaattgcctttctaatattctggtttttgtcattcctaggtttgttgttaagaaaatttatactgtaactactgattggtttgacttttttattaggctattgctataggacttcaatggtagttgtctatttgtggctaaaattggctttgccataggaagaaagtaaagtacttcggtgcattcagaggaatttgggggctgttaaacattttttgattcatatgcaagttgttttctttctgtttgtagaggacacagagactcttattaaggcagtttatacattatatcagcagaggggccttatccttccagttcggactttgttattgaagtttttcagtaaaatctatcagacagaagaactgagatcttgtagattcaggtaaaatcttgttatttttcctttcttttttctcttgctgagtttttctgtagtctaagtatttaaataattttagagagattaaatctttggagaagttcattctttttaatcctacttgtttgcatttaagaaatggtataaaattttaaaagatgcatacgtaatagtgccagtaaactttatacccatatctgaacagataaaagactgcttaggcatgcatttctacctgtccacttatagctaagggacagttggaacaacctcagccctttctcttcccctcccataaaaattacggaggttgaatctctagccattagtgacatattgaggcatatgggataagagtgagggcaatagaagatgagaaagtttctggcttagtttagtgctatcagagagagacaacaaaagagtggactaaggaatttttcaataaggtgagtttgaggtttatttggcatagtcagaaatgtttgagaggaagatacagatttgggatacctcaacatatataggtagttgttgtaacgtattctggtatttactttaagccaagttactttacataatctcaataatcttcatactgctactgtgaggtggatactgttagcttccattttacagaaggaagcagaaaataaataaattggtg

SEQ ID NO: 134125 - DNA, 1115 bp, Homo sapiens
agttcaagaccagcctggccaatatggtgaaaccctgtctctactaaaaatacaaaaattaatcaggcatggtggtgaacacttgtaatcccagctacttgggaggctgaggcagcaggatcacttgaacccaggaggcagaggttgcagtaagctgagatggtgccacagcctgggaaacagagtgagactccatctcaaaaaaaaaaaaaaaaaaaaaaaaaaaaagtatatatatatatatacatatatatatacacatatttgttttttatatatatttatatattatatataatatacatttttatatatttatatatatttatatatatttataaaactgcttaggagggcaaggtacaaggcttaaaaaatctgatcctctctatcacaatactttgttctaccctgttcacagtaagcaaccaaaacaaatatttagtgcatgaatgaaaaactcttatgcctgaaatagctgtattgcttccaagcatattctctgaaccctgctcaaaaaacctcaatgattctctagctaatgtattccctttgataaaagagcctttgacagattttaagatcccttgcaagtgtatgctcatttacgggaactacagtattagtattttagcttgtacctgcttgtcaaattttattacataacttgttctcacatttatctgctcttacttgaggtagacattttaaataatttctaggcttacttttttttttttaactttcaccttctaatcaattaccttttatttctgatttttctccaattaccctccttccttcgggatactgatattagtttcaataccaggttcctcatgtataaatgagagtggaactagatgatcatcaagatattctcttgcttaagaggttcaataatcacacagtgcctcacccaaataaaccatacaccttggcaattttattaaattcgtatttacataagctgatacattcatctagcacaaaaaaaccattttacagactaaaaaataaaaataaaatgttaatcccaaggttcaaactcacttgtccaaaaatcagccatattactacttttattttcacaaaatctagacataaatacacag

SEQ ID NO: 134126 - DNA, 1022 bp, Homo sapiens
ggagaatagagttatggtgtagacagaacatcagggagaaagactttcttgtatatttcataaacattgcattagtagtccaaattcagaattttcttaagtctcagatactttcactttttctctcttaagcagcagacagaatgcaagtaaatagttattaagcaccaaaaggatctatagatgaaaagtgggtgctttaacagttaattctgatttttaaatttatttacatattatattactggtagaaagtgaattatgatgggacatttatttgacaagttgtcatttctcttcaagttttattgcttattttacattttttcttgtagatttttctaatctttgctatttcaataggagtcatggcttcgaaagaactaccttattgattttaaacaccattttatgagtcgttttccatatgtcttaaaagaaataaccaagcacaaaaggaaagagccaaataaaaggtattatgattctttttcactgtataaccttgaaaagctgtttaacctgaaattatcaggaagtaattaaccttaatatggaactttctacactgctgtgtatttatgtctagattttgtgaaaataaaagtagtaatatggctgatttttggacaagtgagtttgaaccttgggattaacattttatttttattttttagtctgtaaaatggtttttttgtgctagatgaatgtatcagcttatgtaaatacgaatttaataaaattgccaaggtgtatggtttatttgggtgaggcactgtgtgattattgaacctcttaagcaagagaatatcttgatgatcatctagttccactctcatttatacatgaggaacctggtattgaaactaatatcagtatcccgaaggaaggagggtaattggagaaaaatcagaaataaaaggtaattgattagaaggtgaaagttaaaaaaaaaaaagtaagcctagaaattatttaaaatgtctacctcaagtaagagcagataaatgtgagaacaagtt

SEQ ID NO: 134127 - DNA, 1059 bp, Homo sapiens
atagctagtttttaaaatgaaattacagtttaacattagctttttgatttactgtggtttttagggtactgtattagtagtgtcagggtcagtattatgttataaaaattgtgtcttagctttgcatttaatgcttgacttgcttgctactttttctctacgtgtgtgtctcattgcttttatccttttgctgtgagggttagagtttgtaaccaaacactaatgcagtcatactttataaggcatttattcaaagctttattgggcatcaataaataatggctacttaaattaattaaaatttaaaattcaattcctcagtaaccctagccacatttcaagtgctcaacagctacatgtgggtagtggttactatattggacagtgcagatagatatagaacagtttgatcattacagaaaggtcttttgaatagtactattctagactctggggctacagagataaacatggttgataaggtgcttgccctcatggtatgtaccttctggtgggatctatagacagtaaacaaatatataatgtcagtactaggaagaaagatgaaagtaaaatggggtataaagagcatgggcaggaacagtgagggggagctattttagataggttgtcaaatgctctctgagaataagatatctgaatgtcattgaagtgaaggagcaagtcttgtcaacatctgtgggaagaacattcaggcataggaaacagcaagtacaatggctttgaggtgagaacaggcttcgcatatttgaagaatggcaggaaggcctgtgcaaatgaggtactgggagaatggtagaagatgggggcgaagaagagtgatagtggccagatcatgtgggactctgtggtccctggtaaggagtttggattttaacctgagtgtggcgaaaagaccactggagggttttgagcagaggagtggcatgatctgcattatatttatttaactttaatgtgctgaatttataaaaatagaacactagtgaactcccaggtgctcacagtctaactctagcaaccatcatctcttggatg

SEQ ID NO: 134128 - DNA, 1618 bp, Homo sapiens
ttcaagcaattctcctgcctcagcctcttgagtagctaggcttacaggtgcccgccaccatgcgtggctaattttttgtatttttagtagagacggggttttaccatgttgggcaggctggttttgaactcctgacctcaggtgatccacccgcctcagcctcccaaagtgttgggttacaggcgtgagccaccacgcctggcctagttttttcatttttagagagccaagaagtaaaaattccaagcttcttcggtgtttgattacatataagcactagtaaacttttgttactgctttgttagtagcatttgtatttagatagactagtaggaccaaaattcaaaatctgaaaatttattaattatgctagttttgggtcatcttatctggataacactaacaaaggatctaaatactgctttagttttatggatatttaaaatagtatgctttagaactattttgtgctattataacatgactaggcttattagcagctcattaacatataatggtaagtttaaaagactgcgtagactgttgaagatcagaatacaaattgagatactgtataaagctgaaataaataaattcagataggaataatatttaaaaacatccactggtagaatgctctaattcaccttggcagatttgtaataacttgataagaaccattatttatttatttattttttaaaaaggaaccattatcttagagacagagtataaaaatgtacatcattggtacaatctatacaaaatgatagattgttagtagcattctatacaaaatgacattaaaatgcacattctggtcttgaacttctggccttaaatatccttgcaccttggcctcccaaagtgttgagattacaggcatgagcctctttgcctggccacagcctaatctttaggaggaaccaaatagcattgcttggcattgatgtcagatcacacaccacaagctgaattgtaactctttttctctcagaaactgtatagatttttctattggtaaattgatgtctcggttagatatagtcttaggactactgactgtttgcttttacatgttggtgctgcagcttaatgcatttagtttgctagtatttacaaaaagtcaagaaatttcacttgtattcaggtagtttttttttttttttaaactttttagtaatttgaagctttgatccttactttgaaaagaagtctcagggtacattaagtcttacatgcagtggctgaatagtcagattctgtaataatcaactgaagttgtttatttctgaaatactgtgtgtatcttttttttttcctgttcatataaacagccatttattccagcactatttgttgaaaagattgttgttttacatttgattaccttggcactatttttcttttctttctttcttttttttttttgcattcccttacctatcttttttattttaaagtcaaaccttcagaaggaatacaataagcacttgcctacccccatctagttgcagcaatttctaacattttgtgcacatgttgaactactactgtatgtattcttaatagttagctagctatatccttgatataactagtttttatttatttttat

SEQ ID NO: 134129 - DNA, 4825 bp, Homo sapiens
attgctagagaagttcctccgaggctcttacgaagcccaggagcacaccagcagatacaagttacatctctaggaagtctgtgctgctctcctacactcgaacaaaggaaaacaaaaaaaaaacacatttcagaaggtttccctttagcatatagcttgacaaaaggttctgtgacccaaaaaactttgcaaaaccgtggcaagactgttgccttgttacagtattttatcactaaactgagtttttaatagttcttaacagcattttttaatattttgatctttcagcataatcagattcttgattacgattgaaataaatgttacagtagtatgtgttggaaagtgccttttttcataatttattcttgtctctatccattgcttttaattaattcttttcattatagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggtaaatcataaatcatgttttgacaaaataagattttctttggaatcgtgtagaatgttatatttttgtgaaaatttgtctaaactcttagagtaaatagtttgcctagggtcttagggtttattgatgtttggagtttatcttttacccaaagatctctcatgcagctgtgtctttccacttcctccagaaacgttcgctaaactaaatgcacagttgtttctccctggtatatttatttgatgatttatttatttatttatttatttattttgagacaggtctcactcttacaccatgttgagcacaatggggtgctatcatggctcactgcagccaggaccttctgggctcaagtgatcctcctacttcagcctcccaagtagctggggctgcaggcgagcgtcaccatgcctggctaatttatttttttgtggaggcaaggttgcaatatgttgcccaggctggtctcaaactcttggatgcaagcaatcctccagccaaggcctcctgaggtgctgggattgtaggcgtgaaccacggcacctggctgtatctggaaataattcttacatgtttttgatgtgtcaaatttttgatgaacagttttctagctgttttttagcgaattaagatacaatcctgtcattcatttttgaacccatacagcacatagtttattataggtttgtagtaaatacttgaagtcaattgaagtttgagaagtgttgcttaagaatctaacagctttatggagatataatttacacataattaaaatctctcatttaaagaatacaattcattggttttggtatatttacagagttatgctactatcaccttaatctaattttagaacgtttttatcactccaagaagaaaacttatacccattaggaatcacttctcatttcttccagccctaggcaatcactaatctacctctgatatctatagatttgcttattctagaaagtgcatataaatgaaatcatataatacatggccttttgttactggccttttacttagcacagtgttttggaggttcctccaggttgtatgtagcttgtagcatatatcagaacagtggtacattcctttgtattgtcgaattgtatttcattgcatgattaggtcacatattgttgatcactcagcagttgatgaacatttagtttgtttctggtttttggctcttatgaataatgctgttatgaatatttgtgtgtaggtctttgtgaggatatacatttttcgagttttgctttttaagctctgaagtttaaataatactaaagagttatttaaagttttttttttcccaaaggttacataaattattccacagataaaattgtcaggtagtatactctgaataaaacacaaacaccctgtgaaagcccatttgaaacaggcagaaacggcctgtcaagagtatatatatacaccttccatgatgtttggtacctagtaggttttcaataaatgatggtgtgattgctgtcactttatatcatagagcgcctaagcctgcatgtaggttaatgtaaagagagaaaattccaactgaaaattatgcaatgtttttattaagctgaaagtatttttctgtttctgatcctaacaaaagctaaataacatttaaaaagtacttattgaagcagtttccccaaggagtgtcagtttactagtgtagtgttagttagcatgtttacgtgaaattgatacatgtatataagtatacatctaaaatttgtatttttatttataggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtaagaaggatttcagttatgtccacacagttttgctgtattgaattataactgctaaccattgatgactgttggtgggaagacatgcagttgtctttcatagttttcatatagttactcatgatttgattttatttactgatgggaagagttatttgtatgttaatttatttatagcaaagcctttgagaaataaaacttgataatatcttttggctttgtcatcttagaatttcatttttcttactagttttgattgatgtaattatcagttcatggtgcttcattttactagtactttatatttaagatttaaattagcaagggataataaacattttttaatcacttaatttttttctttcttacccttattaggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggtgagaactaatggttctttattttcttagtattaatagccttttatcataaatggcaagattcgaaatcagctcattactactaattggttatatatttttctgaaaagtaccctgggtttaactgtaaacttgtttgttttgcacaaaactacaaattagttttctgaagttattatctgtgaatatatatatatatatatttaagtgaaatgcgtaactcatgcttggttccattagttttttactggctataattcatagtagtgttacagtgtattgtttatggcagattgattgtgtaggaacattctagtttctgaaaggtctcttacaaggtttaaaaagttgcttattaagtagtctctttcaatttattccacattgccaggtttagtagaaagggacaaaactgaagagctcatgatcagacttgaattgttttaagtgttgtgctatagtgaatgtagtgcatagtgtatgctacacttttcctttgcaaccaaggaggaacaagctgcaagattaagttggtgctaaatcaatacagtaacacacttgaaaagggtagctacagaagcaagacttcaaagctagaagcatctggttttcagaagaattgctgtaaggacttttgataaggcaggtgtgaatccttcaagtttatataaaactgagaaggtagttttcttgtttttgttttatttttatttcaagttgaagtttagaatgagtcagtatggtgcataagacgggataaattaagtagtatttgatagtcttgaaaagcattatagagttgtagtaaggtgtatattttaagagcgtgttctattgctgttaactcatcatctgtaggaatgttttgtcaattgctttttcaaataagatggcattttattgattacggttttgagactttgttttatgattcattgcatacattggcaaaaaattaataatagggctataatgtaagattttgagaaagcaaagcttgtttctcatatggcagttaatttgtgatgtaggctagagacagtaagaatgtatatagctcctttaaaaaaagtatatagtacttacagtcttgatctatgatcatctgaaaggt

SEQ ID NO: 134130 - DNA, 1055 bp, Homo sapiens
atgagccaccgtgtccggctccatccatccagttttataagcaagcatagtaatctggtagatttatttgacactatccccacccttacattctcatatccaatatattatcaagttttgtcaatgttatgtcccgcacatttctcaaacctgtctgtgtcacaccatctctaccagcaccttaatccaaacttttacctggattaatactatactcacctcaatttcatttttgtttgtctgccaatccattctccccagagcagaataataatattcttaatatgcaaatctaatctgccatttgatcctaacacctgtcaatgatttactttcatttcaaggttaaagaccaaaatccttagtgggacctacaatattgccctgccaaaatcttcactctattttactttgttctatccactttgtctttctgtcttacccactggccttctttcagttccttaaaaacacccttctaccacagggactttgcacatactattccccctacttcatgtattattttccttgttcttcatattcttagcaactacacatcctctaggtctcagatttaacatcacttcttaagagaaactatctctgactcccagatcaagtcattacaaagatgaattctgccaagtaagcgtgatcaaagtaaaagtgtgtgttcagaactccatttgctcctcctggtgcactcttcacgtttctctgccatgccttgtggctaagcaggctgatttgtgtggactacaccaacatctccctggcctccctggccctcagagcaaatgagggtgtcaaggtgtttatcccctgcacctccaagctgggtcgctgcacgctggctactccctcaaccaagtgccagctacagcttttgtcaggcagctgtctccatggaggtttctttgtctccaagttctaggaactgctgcctcctctcgctcctccaagctaaggggtaccatcaacagtgctatcacatactacattattacttctggttcccctaatccctgcccactcctttgtaaatagttctt

SEQ ID NO: 134131 - DNA, 4323 bp, Homo sapiens
cctctcccagttggtgatgatttgttaacgtattgtggaagatcaagggctggactcaggcactcctgtcctgagtgagtaggaaagacgtctgggagaagggtggtttattttgtttttaaccaggcattgaagcagagagtaggtgggtacgtagcgatggtgaaggtagggaacatcatgcatacttggaagagcaattgctttggagagatagacagtttggggtttgaatcctagctctgccatttcttagctttgtacattttttgtgaggataaaataatgttttttcacatatctggcgtgcagttcaacaagcactagtaccgtattccctgtccgtgataacattcattcaacaaatgtctgctgagcaccagtcatgtgctgagtcatatgttacatcctggggatacagcgatgagtcagaaattatgtattcccctaggaatttcccagtccagtgtgggagatggacgcaaagagcaaattgcaaaaaatatgggaagtgctacagtacagtcatgtacaactgtcagtgagctcatagaagagtaactcattctgagccagtgggaactcagggccaatctatatctaacaaggtgagtatgagaccttatgacacaggtttttgttttttgtttttgttttttttttggggggggacagtctcgctctgttgcccaggctggagtgcagtggcatgatctcggctcactgcagtctccacctcttgggttcaagcgattctcttgtctcagcctcccaagtagctgagattacaggcacctaccaccacgcccagctaatttttgtagttttagtagaggtggggtttcaccatgttggccaggctggtctcaaactcctgacctcaggtgatctgcccaccttggcctcccaaggtattgggattataggcgtgagccaccgtgcccagctatgacacaggttttgaatgctcctttaccacctaactttgatctcttttacctttgtcttatctttgccctgctagtctctcctctctctctcaaaaaaaaaaaaaaaaaaatctagttgcagtgtgtgtgtaatttgtaagctgcttcaaacccattttagaaggaagccgttataaagaaaataaacataacagactgggtattaattgaggaaggcttaacaaaaattgcatgagagttgggctttgaagattgaaaatgggccgggcgcggtggctcacgcttgtaatgccagcactttgggagtgagactctgtgtcaaaaaaaaaaaaaaaaaagagagattgaaaatgggcccttggtggccttggggtaaaggattccagccaaaggaagccgcgtgttgagtttggtctggttaggttgaaaatacatggagagaatgaggggctggtgggggtgctataatcaggaccagatccggaaaggccatgaatgccatgtgaagagttgggacttttatcgtttaggcagtgggagagacgtctgaggtttacaaggaggcctgtggcttgatcactgtgttttaggaagatccctgtagttgtgtggaagagggtatggaagtttgggagaccattttagagattagctctgtccacagacatgggcagtgagaatgggagaggagggaacagatgtttgggtaaaatgtaccataggtcttgttaattagttgcatgtgattgaagattacatttctgctttgggaagccaagttgatgtggctgacatcatcagaaatcaggagattttggtgtatggggaataattagtttggttttggctatggagagttggagttttctgaggtacccatagtggggcacagaggtggctgatagataattggaaatgtgtttgatgctaaggagagaggttgaggcttggaagagaggttcttccatcactgccactttattctttttctttttttctttttttttttgtttttgagatggagttttgctcttgttgcccaggctggagtgcaacggcgcaatctcggctcaccgcaacttccacctcccgggttcaagcaattctcctgcctcagcctcctgaatagctgggattacaggcatgcaccatgatacctggctaattttgtatttttagtagagacggggtttttccatgttggtcaggctggtctcgaactcccgacctcaggtgctcctcccacctcggcctcccaaagtgctgggattacaggcgtgagccaccatgcctagcctttttttttttttttttttaaagagacagcgttttactctttcacctaggttggagtgcagtggtgcaatcattgttcactgcaacctcagattcctgggctcaggtggtcctcccacttcagcctcccaagtagctgggattacagatgctcatgcctggctaattttttaatttttatttttagagatggagtatcactgtgttgcccaggctggtctcaaacttctggcatcaagcagtactcccccactgccttccaaagtgctgggattacaggtgtgagccactgtgcctgcgtccccactcccaactttttttttaaaacaaacacttactgtgaatctactatgtgctgaagatagatataaaatgtagttccatgcctcggagctcaccgtcagatagggagagccttcaggatatggatagatctcagtgcagagtaattctgagtgctgcaagaggtaaatacttggtacccttgtcctagagaagatttgagagccgatggttgtagctgaggtggtgggagtggaggagagtgtattcagtagacgagaaggaggctggagtgggaacacctacagaaggggaccttctgtttttcaacactgctttctgtggaagataccttaataatgattccaaaggcatttcagggaagccgtgggtggggatggtttaagatggagtgtggggaaggggaaggacggggttaggactttaagaactctcatctggtttatagaggggactgtgaggatgggaaagtgggggagacctggctttcaacacaaggctggttctgcatgcacacagtcacactcaggcgcagatgatgaaaataaacacttccaagttacatggctgcctggagtgggtggaaaagtggtagagagggaatgcattagagaaagcaagttcggtgctaggcttgactggaaagctctcgaaaaggaaagaaagaaggtagagaggcagagagagcttgggtgagtggccatcctgggcacacaggtatgtacatgtgcaggcaggtaagagtactgtccaattactctcacctctggataaaatgaaatcctgaaggcatcatagtggttgtgaggctcttaaaacattgccatttctaccttctttgaactgtaatgatgtttgcaagaaggaaacgattatattatgataaatcctttgtaagaggagaaatttaaaataataaaacatctagcaataatcagttaaaaaatgcaaatggcaagcaggttggttatggcaggtaattccacaaatatttattgagtgcttgatgtacaccaggcactcttcaaggagccatagtgaacagatcagatcacctgcttttgccatttcacctggaactgcttaacttgcacagttaaacctgtttaaaggccttaagcaaaataacaaggtcatctaaagtgctgagatcacttcattctgctgtaatgctctctttcattggccagtagctccaccagtctcataaataatcagaaaataccaactatgtgtctttggcagtgaactgtggaaattagattgcagaaaaaccattttaatggcagtgctaacatggatgaccagtactggataggactttagagaatacccccttgagctttataatttagagacgaggaattgacagcaagtaaagaagacgtgccaagacaaatgtcacaaaatgaatgacagagttgagagcagtgccctggagttttcaaatggtacagtcggggaggcttgagagtacctagcaaaaagggcatcttgatggtgagggggttctgaagtgggagaggggttggaaagcaaatgatgaagccttgatttcagactcttctctgttactagggccttgggaagccctgttttgctctgagcctcagtttcctcaactgtaaagtaagaggattagattgaggtccttctttaaatttatttatattttttctttttctaaagctccactctcagaagcagtggtagggttgggctttgaggccatgggtccaagcccatgtccttaacctctatattatactacctt

SEQ ID NO: 134132 - DNA, 1328 bp, Homo sapiens
atcccaacactgggaggctgaggcaggctgatcacctgaggtcaggagtttgagatcagcctggccaacatagagtgaaaccccatcttttctaaaagtacaaaaatcagctgagtgtggtgatgggtgcctgtaatcctagctacttgggaagctgaagcaggagtattgtttgaacccaggaggcggaggttgcagtgagccgagatcacgccactctactccagcctgggcgacagagctagactctgtctctcaaaaaagaaagaaacagtctttggtgtatacttcctcctttccaataacattgtccccactcagagtccaggccttctcttatcaattatttatctgatgatcttcttcaactctctccattcatatcctatacattcttaaagatctagctcaaatgtcctcttgttcatgaagaatgcaagtgaacctcttccctcttcttcatgctcaaggtgctttgtcctctcttctggtgtctgtttcagcgtgcctctcattttagttgtcagtttgtgcatgtcagcgctctttctaggctggagggttcagcctgtccttgtatctcccacatactctagaacagtgctgagcctttggcaggagttcattacatatttgttgaattgtgtgtgtatgaaataaagagccaataacttgttatatatacacacacaccatacacacacacacacacacacgtgcgcacacacacagtattattctacttttggaagcagtttaatatgggtgggaagagtagaaagaactaaaattgattgaagctgtagtctgtgtttctttattcacgttgcaggacttttgcgcagagggaatgaggcagggccgggatagcgggggagtaactccatttcacagatgaagcattagaggttgattgacttgcccaaagtcacacggttgggtgaggggtaaagtcaggatttgagcccgggttttctgcatccagtgtcttggttcatttcacctcactttaagatcagcagtctattaatgtcctgaagtctgattttccagtgccatagctcttcagtcatggtacccattctgagtattaacttcaaagaactcccctttccacaaagagcaagagatgtgaaatcttgacaagtttctctgtctttgctcaaactttaggacttagtttcacccttggtggacttaaaaatcactagatggtatattagtcttctcaggctaccataataaaataccacagattgtgtggttgaaacaacagaaattggattcttgcagttctagaggctgagaaggccaagatcaaggtgttg

SEQ ID NO: 134133 - DNA, 1261 bp, Homo sapiens
ggcgtggtgacaggcacctgtaatcccagctactcaggaggctgaggcaggagaattgcctgaacccgggaggtggaggttgcagtgagctcaggtcgtgccactgcactccagcctgggtgacaagagcgagactccgtttcaaaaaaaaaatgttcaacttttctttttttgctgttatataccagatagtcacagtatagccacaacaatccactttgaaataaaaccccattcctagtacatttctaaatattctccagagtcctgaatatcataattcaaccttaatggaaaagaaagtactgtatttcagacaagggaatcaagtcaggaattaagcttcagtgatttataggcattgtttttgctggagttggtaatcattgcttcaaacttccttttacaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaaggtatccgttcctgatgccagtgtgcacgctctcactgggtatctgtttgacattttaattttaaaaccctccactttgagggaacttctaaaaatgaaacttttgtatcaaatccaattttcctaattcaagatctcaggattatataggacattcaaagtcttatagaagtgggcgtggtggctcgtgcctgtaatcccagcactttgggatgctgaggcgggaggatggcttgagctcaggaatttgagaccaccctgggcaacaaagtgagacccctgtttctacaaaaaatagaaaaaattagctgggcatggtagcatgcacctgtagttccagctactcgggaggctgaggctggaggataacttgagcccaggaggtggaagctgcagtgagct

SEQ ID NO: 134134 - DNA, 1134 bp, Homo sapiens
cccattttcaaattctggggtgggatctagggaagttcatcccacagagttttttctctttctctttggaagaaatgatgtaattcatttactcataaacgtaatttataaattttcagcaagaagggaataaaggtacattctcagtgtttttcttatagtaacatttaatagtgactcaagtataaacggatttattttaaattggatgtttgtacatagatgacactggggacttccctttttgctggtgattattaaagcatagccaaatgctccttgctcctgtgtccaggtcccatctggagggtggtggagaaccttggtgctttgtcatttgggaagtgtgtccaaaggtaatctgttaatactagtaggtagggtactggtactctttctatacagtaaaacaactttgagttcatttcactcattttgcatttcagttttctttcaagaaagaaaaagaagcctggaattgtcaatcatcctttctgggacttggtaggaaaaaggtggaaaatctgctatagagttatggccctcattacatcttgtgtatttgacataaggaatgtgtgtgtgtgatctttctatttctaacactgtgctgtctaatacagttgtcacaagccacatgaggctcataggcacttgaaatgtgggtagaccacattaggatgtgctataattgtgcacaccacattttgaagacttagtacctaaaaatgtaaaaaaactcattaaataatttttatattgttacatgttgaaacaataatattttagatatgttggattaaaaaatatattaccaaaataaaatttcacctttttttatttttctaatgttgctctgaggatatttaaaattatataaatagcttatattgtatttctgttggacaatactgttccaacaccttacagggtacctgttacagaattaggtactcagaaatttattggaatttatgataaaactgttaaacaggatggactctaatagtattccactagaggcctccctgcaactactttttggtatgagatagtttcaactgtgtcatcttgatcactgtcccttggatatacttagctttgtcaacaactttctgaaaatgtccatctgca

SEQ ID NO: 134135 - DNA, 1049 bp, Homo sapiens
tttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgaggaagaaatgttcgtttagatttctacattctgttatgttggttttattaaaaaaaaaaaaaagacttgcaattttatagtcacactgtgtatgttttttaaaggtgctgccttcccagctgtgctccagtttttctcttctctctctagtttcctcccagctttgtactactgagttgatagttgcccttgcttttagtctttagctaccaaaggaaaggcccttccctcaccatgctcatggtgctagccagtagtaatgctttgtagctggcattacataattagcattgggccttttgaggatccattaccaacatattcggaaatatggattgataaatggatattttgactgagctgcagtatagcttctcctgtagcctcttgttaaaaacagccccgggtgttggggacagcagtagctggaagcagcaaagtgacacttaagtgccaaggcagatcagcagtttctgacagtgagagttcaaggccatgtggtggggaaggaggagtatatgtggcagagtccacataagtggtataggccttggagtcagggcctgaattctaagctcaactctccgtcaagttgccgtatgaatgtgggtaactccttttaacccttggtgtagtgtttcctgtccacagaacaagggagttgggctagatgacgttccaagtctgttacaacttcttggctatggtgtggt

SEQ ID NO: 134136 - DNA, 1036 bp, Homo sapiens
cctcggcctcccaaagtgctggattacaggcatgagccaccgcgcccggctggtctgtatagccttggatgagtactgcccacatcataatcagctggagagcatgggtcaatagggagaaattgtttactgcaatggctaaccttccctcctgcataattttggaatttggggactggggaccataagtttggtaaggtacacatatacttgctatttatgcacagcacacaaaacgggtatgaatttattttaaacaccgaattatattttcaatgtcttagaggaactggttatttgaagaaagcctgtgaagactagtcttctttgaaagaaaagatccttttgtaaggatttatgttcttaatttagtttttaccaaatggacccttttagagaaagaagcatcaggataaagtcccaatcttcagtggtttgtggaagagagaatctgatgattcatgccctcctaccctgttagaattaggacagggaatggcagaccctaaacatacatgtgaactgagcaaagattgcctttgcttcacctattgacacatttaagaacctcgttttatagagagtacggagtggggtctgagattctacatttcttacaagttcctggtttatgccagttctgtttgtctggtcaccacacttctgaatagcaaggtttcagaggactctatgaagtttttatttctcaaaaatttggcttaggtacatctttacatacagtggtgctagatattattctttcagaacttaaccatgcaacaatgcagaagaatacaaaaaatgcttgcacacagtagtgtattttaatggaactataaaagcattgaactgattcctaactttacatataaaggataattaaaccagcagcctaaagcaccttgctctactgttaatggtacttatgagtttataacagtagcttccaaccttggctatgcattagaaacagcattttataaatgattagtcccactgcgtcccatttccacaggattctgattcaatttacctg

SEQ ID NO: 134137 - DNA, 1962 bp, Homo sapiens
catgcagaaggaaggaaatgatgctcaaagaagaaccacctggtgtcaagcagatagctagcgaatggcaaagcagaacctcaatcccagatttcttgactccaaaatatgtagtccaaactgcctgcccttgtcccattccttgagctctatcatgaattggttttatcctgagagtcagatcacattacagggtacttgtttcagtgtctccatttgtgagcaagtatatcacaattcatttcacttttgagcagtttcttacccgaggtagaaatgcaataaccatttcttggtaggtggtgtaggggatagacaggtaaatattaagacacagttcatcatcccccaccttggcaaattacggacacagcccagtagggagtataagggttgtacacagctatcatgcgcttgatcagtgcatgtcttcaaagtgcacttgtacctcagcagagagctaagaagcatgaaggaagtcttcatggaggagatggcactggagctaagtcttcagagtcggcattttggcaggtggagattgggaaaccagaggaacttcactagatgcaaggtcctgttgaagattcaaggtaatgagacacataattgagagggagtgacagcatggggaatttctgagtttgggcagtaatgtgatcagaactgtactccaggaagaagagtagaagaaagaactgagtggagagaagactggagtaggggatacgtaggagggtttgtccctggttaggatgagatgatagcaggacccagaagaggttgcagtaaaaccaagagagacagccgggtgcggtggctcacgcctgtaatcccagcacattgggaggccaaggcgggtggatcacctgaggtcaggagttcgcgagcagcctggccaacatggtgaaaccccgtctatactaaaaatacaaaaagatagccagacgtggtggcaggcgcctgtaatcctagctacttgggaggctgaggcaagagaattgcttgaacccaggaggtggacgttgtagtgagccaagatcacaccattgcactccagcctgggtaacaagagtgaaactccgtctccaaacaaacaaacaaacaaacaaacccacgagggagatcagtgtgaagggcattgccaaagtggaatcagtaaggcttggcagttgaccttgtttgttggagagaagggataagattttaaagctacatgtctgaaagaatgatgctgctgattgaaataaaggaagaaaggatgcatttcgggctccaacctgtcctaggaaggcctagacctcaaacaccatcacctccatgcatttcctctttggctactatgtcttttccctgacttctgcctctccagctctctgggctgctgcttccacctgttcatctgacttagaccctccctgctgggtccttgttcacctactcatttggtgcttcgtctgccatcagtacctccattgcagctggtgggatgtcagtcaccatctcttatatttgcttcccactagaaagatcaagagaagttatttctttcccttgcgctccaatttttctctagacagttggtatccacaattttaaaaaatgttccatgttgtataaacaagcattcgctgagaggggctgttaatacacatcgtgccccttttataaaaattcatgcatggaatcctacattattatgcatcaaaatctccagaaatgtcttaggatttttgcagggagaatattaaatgcattgttttgctttgttttgaagagactagatgtgcagaggaagagaggtggcatggtgggagggtacatttgagttgtcaacagtctctgcagtgtcaggtcaattacatcagcacttggactggaccagggaaaggaatgattctgcttcctgggaatgtcagaaggacctgatgattatatttggcaaagccaggaggagtggct

SEQ ID NO: 134138 - DNA, 1058 bp, Homo sapiens
ctttctgttggactggttcccagagggtcctcttgtttgtccttgccctcgcttttatatcagttcatgttttctcttctgtcatcttccttcccagcgctgtttctccaccccctcctgctgcactcacaacagcttcccctctcctgtttagaggtggaagcatgtaagaatgcgtttgagggggatgcttgccaaaggacagcatattcaacatctggtatcaacaaggtaatgtttaaccttagactagccaaactagtgatgacctgcttccatgctgcatctgctgctttttgtgttgatgggactcagaaatcatgagaaaggtcttcagtgatccatgactgcaacaaattcttttcctaattgtgccgtatattatgcccctcaatacaacttactaatctctgcctcagtttctccatctgtgaaagtggtgtaatacttatctacctcccttgaatgttgtgaagattagtatatgttggtaaagcacttttaaaataaagaatgatataaagcattgaattgttgtgtttgggatgtgggtgccctcctgtagagaggctgccctgtaggggaagtatcccaggtgtaccatggtttaggaacacccagtgtacaaaacttccattacaaatacaagagtgtgattgtttcctttctttcttttttaacttcatctcaggctctactttcagattattttctttatgaaaaatttcaacatggcatttctttaaataggcttttggtgcatttaatatgagattcaatttatagaagtgatttatggaagatttaaaagaacacatctattgaacctctattacccaatataactgttgggtttgcaagctgattattaatctaacagtgaagtttatcatcattaggtggaaaacttggtttctgcattatccagatgtccagattgtatatgaaagttctctcactgtaagtactgattggaatggacagaatgtgatcttgttacttccgaatgagaggatctgcagttccacttctaaaatgcccttacagcacagccagtt

SEQ ID NO: 134139 - DNA, 1114 bp, Homo sapiens
gagggcggccccaggcagggatctgtgtgtgtgtgtgcagagtgcggtgggtgggagacggcgagggggctgggcggggtgagggcaggggagtgaccatgtgctgatgtgctggggagattcttccttaaggcactgggggtctcgggggtgggggtcgtgtggataaagggaacgggttgtcttgaggacgcggtttggcgatgcagagtgactgtgtgtgtgcgcgcgcgcgcgcgtgtgtgttctttgggttctgagatgggatctgggggcttagagtgacctcgggtctgtggatatgagcggggaaagtcccagggcccaggaagtgaccctgtgtttttgtgtgttgtgtgtgaagcctggggctcagttagtcaccctggggtatgcattgaagaggagggatgggtgccctatagcgaaccccatttatgtcttttcaaaggggaggaggcttgggagtcatcatcctgtgtagggtttggatgtagaaagaggaaattaggtctcagggaatgcccttgtgtagcaaggtgtaaccctgggttattaaagtgtggaaagagagaattgggtcccagggaagatgtcgtgcctgtgtgtgtgtgttttgcgggagggcctggattctggcagcagcggggagcaagggagtgacctctcccctctctccaaggccgcttgcccccccacagctgttggaaacaaagagcttgctgaggctttagtggataacactggggaggagggtcccagcagtaaagttcctcttcatttctaaaggggtcccagaggcgcacaaggattatggccctggggcaaagacaggcattcaggtctcattttttgagtggagggtcttcttggagctggcctagcagatgctagtgatcataagccacatccttgctaacttgcccttttatcaattctggagccttctcttgtcttctttaaaccaaggcggagtagggggaggagggaggaacataaggccactgggaatctgccggacaacctttatacttttgggctcttgaaggggcattatttctggaagagtgaggaaggagcaagagagtctcagcgcagatgcttatgctaccct

SEQ ID NO: 134140 - DNA, 1043 bp, Homo sapiens
atgttggccaggctgatcttgaactcctgacctcaggtgatccgcctgcctcggcctcccaaagtgttgagattacaggtgtgagccaatgtgcctggcctatttcgtttttttttttttttgagacggagtctcactctgtcacccaggctggagtgcagtggggtgatctctgctcacagcaagctccgcctcccgggttcgcgccattctcctgcctcagcctccccagtagctgggactacaggcacccgccaccatgcccggctaattttttgtatttttagtagagatggggtttcatcgtgttagccaggatggtctcgatctcctgacctcgtgatctgccagcctcggcctcccaaagtgctgggattacaggcgtgagccaccgcgcccggcctatttcagttttaaaactaaatacagccctcgattccctgtagatattcatttttggttttggaccatcatttcagcctactgtgagctttctggagctgattcggtcaggctgtgcgtgttgggtcactcacaggtttttttcacttgcaaatatgaagagcagttctatggcttcattaaattaatagaagttgtctagattgtgaaaaaggatggaaccctgcgacatattactggagactttctaccaacttggttgatgttgttacgttagtcaaccagatgttcaactagctatgcatcctgttagttgaatttaacagattttcgagcttctgctgttcaacattttcccattttgttcaccagcctattatttaaaagattctttcagattgtcttgttagattgttatgtgtatatatcatcctgtcatcctccctttttccattttagtaatcctgttaaataaaaagcacatgttgtatagcctgccttaataaagagctgatggtggctttctcattttactgtattcgaaaacttatttatccattttagaatttttcagcagttacatagcaggtttacccacagatgtttttctggatctgcattccgccttttttttttttttt

SEQ ID NO: 134141 - DNA, 1035 bp, Homo sapiens
tcttgatgaagatgaagcatagggaattggccctgttgtctcttgatattgcatcttccctaagcaatgggcctttggtttatctcttcttgttctcaacaagacttttttgtttgtttgtttgtttgtttgagacaggatctcattcctgtcgcccaggctggcgtgtagtgacgcaatctcagcttactgcagcctcagcttcttgggctcaggtgattctcagcctcctcagtagttcagactacaggtgcgtgccaccacactcggctaattttttgtgtttttagtagagacagggcttcgccatgatgcccaggctggaacaagacttcttttgttgtcctcttgccccagttctccacttattctggactttagacttattgagattaaaagaaaaacttcgattttatatcttttttatttatgcttatttttttttaaagctaacttaacagaaagttcccagttatccaaagagaaaaaaagcttggaaatacatgacatatgtgaagaaagataaacttgaatttaggagaccaggtaaccttagactgactgactttgtttttcatttgtgaaatgaagatgatgatggtcctttttggctctgggatatttgagaagaacaaatgagactaaccatgtggggcatttctagcttagggaatatggttaaagaggtagaagaacatactgagagaccagtaagtggcatttcgtgatagatataaggtagagaatttgaaatgggttttaactagaagtgggtcctctggattattatatggtggtaggaatggtattaatggacgatataaatgtcagattatgagaagtgccttatttgtggcaattcaggattcttgggaataaaagtgagtttttctaattaatggggaatctcgggcagggcttttatcttctagatccctgttgtgtaaaatgtggatggataataattaatttagcaaaccttgattgaatactgcgtagtgtaatctaatatactggatgttaagggaaatatat

SEQ ID NO: 134142 - DNA, 1112 bp, Homo sapiens
tccaaagtggctgcaccattttacatttctaccagcaatgtttgaagatcctaatttctccagcatcttctccaacacttgttattgtctgtctgtttgattttggccatcctagtgggtgtgaagttatgtatcaatgtcgtttttatttgtattttcctaatggctattgatattaagcatcttttaatgaatgtattggctatctgtatatcttctttggagaaatgtctattcagatcctttgctgggcttgattttgacatcttggagtaatcattcccttagtaaatcatactaatcagttcccacagcaagcacagagatgctcaaatgctaagttggctctcgtttgtcatttgatttttctgcttactaagcaagagtcagttgtatttgttttcaaacttatttataccagtggtaattatgagtataatttaataaatattactcaaatcgatgaaatatgaatacaaaaagttgtttttatgaaatgctttgaaaagacttgataaagacaagaagctgaaagaattgcctctgaacgaattaaattatggttaagacaactgaaacagagtggagaaaccctgtaaacttttggaaggatttcccagaaaacactgcaagtatttttaagcccctgttctacttaaaggaaaggaaaatggacattgtagatctaatggattatgggtgtgatttatctaaggaagtggggaactgtgtttggcagacttacactcaaaaaaaaggtcttggtgctacattgggaaatgaatgtataattatgtatttaagactaaaatggctaaaatagatatcattttaaatggtttctgccttaactgacttttttggttaatagatcaatgatcactcttgtatatgtttgaaaagaggatttccactgtacaaggtgccctgaggaagatacagatgtggtgtcatgggaatgtgtaattctgatttgtaggaatcaaaactggtttcatggagtaagtggcactcaagctgggctgtatggggagagtagaatatcacctagaaacaacagacgcacttttgcctgaggcctttgctgttgatgttcctttggcttggaatct

SEQ ID NO: 134143 - DNA, 1047 bp, Homo sapiens
aatttcattccttttttttgactgaataatatttcattgtctcgataataccacattttgtttatccattcagtatccattcatctgttgatagacatttttttgtttttactttttgactattatgaataatgccaccatggatattcatgtacaagtttttgtgtaaatacattgtttcatatctcttgggtgtatgtattccacctaggagtggaattcctgggtcacgtggtgactccatgtttaacattttgaagatttgccaaactgctgtccatgtaaaactctatgtttaacatttgaggatttgccaaactattgtaaatggttgcagcatttcacattttcatcagctatgtgtgaacattccattttccacatcctcaccaacctttgttattgtcttctttgttataaccaaccatcttcatttaagttcctatttgttatccttcattttccctatatatgtggtttctttaatggaatttaaattctcaatttcttttaagctggattgggagataacttcaacctatttatcccccttcattttttacattgttagaaacattgtcttaacttaactattttctttattcatataattctattattagcttcttgagcatttaggggcttggcatacttctcatgtacttggaaattctatacttaaatctgaaaattctctccgtatatgcttttagtttattaggtaacttaatttattgtaattcctttgctactattcaaattcatctattttttaaaaagtatcatgtattttccatggctcagcagccttgtcattttttcagaagtcatttaaggttctaaagttcttaacgtattcttgtacctttaaaaactttggcaggttattatattttcaaccacagctcaatttctctctctctttttttttttttgcaaatattctgagtctgtcttttccatggattaaaaaagggaaaaaacccacaccttttttctttgttataagagcagtatataatctgtgtagaaaatttgaggaatatg

SEQ ID NO: 134144 - DNA, 1145 bp, Homo sapiens
agtttgttgtaaaactcaattcagaaaaatacagaataatgaagaaagcttaaattctaccgagagataactgtggttcctattttggtgggtataccttccaggtttttaaaataggcattaaaaaaagtttgtgttacatacattttaaaaagcctgactttaaatgtgtcatgtcaggaaatgtagagatttttcatcattaattttaataaccgcaccataacagattcagtttatggtttgccaggctagtgtcagaaccccagagatcagaaacatccatgaggaagagagtgtcacagctctgagatctttggctaggattggcgaggcctggaaagaccctgggagacttaaccactcaactctgtacccaggccttttcttccatctgatcttacagtagtttttctccctgtcaccttgcctggagagtcctgatacaggcatttagaattaaagtaggcagcgggggaagattgcaggagtgggggtggaggattgacaggagcaatgtggtttaacaaagggtagttggcagtagtatgcaaaatggaatgaaaaatattggagtcagacgattgtgtggcatatgtgaaatttctttcgttaagtatagcttagagaagttttagccatctctgcagttgatgctttttaatattaatgtaaactgcttttggttttgtatcataaaatattaggtaaagtttctttttcctcctcatatctttatactagaagataactaatatgattagtaaacaagttgaagaggatttaatttctaatttttctgatttcctgggacttgaagtcaacatttgctaaatctattgcttgattttataccctgaaatgtattttcagtgatttgtgtcattagaggtgcccctcagattggttgggagttgaagtcatatctgggaaaagaaaaaaagtgaatatttgttgtataactacttgttttaggcacgattgcttttgaatacattatctaatcattacaatatcaaaggaaagtattattctaaaaggagaactaccacgtgaacttggcccttcctgatatctaaacttatgcttcgtctgtggtatagcaaactgtctctggggttgtctttgaaatcacattgaggttt

SEQ ID NO: 134145 - DNA, 1145 bp, Homo sapiens; identical to SEQ ID NO: 134144

SEQ ID NO: 134146 - DNA, 1145 bp, Homo sapiens; identical to SEQ ID NO: 134144

SEQ ID NO: 134147 - DNA, 1145 bp, Homo sapiens; identical to SEQ ID NO: 134144

SEQ ID NO: 134148 - DNA, 1015 bp, Homo sapiens
tgatcacccaaaatttattctgcataccaaaataattaagataatttttatctcatttaattaatattactgttaattctcattagccttaaaagtaacttactagaaaaataacctaaaatgttaaataagaaatagtaagattgctaccttaaggccttagaaggcaaaatggaaaaattccacagatttacctttggaaattatgttaagtcctgaaattttgagttctattttgagttacttttaggctcattactatgcaggattctgtttggggaatactgagcattttgtgtcttacagaatttctttttgtatagttatgtcttattacacttctgaatgggggggctcaatacattttaaggactttttcatacacacacacacacgcgcacagacacacacacgtaataaaaagccaaatatatatgtcaaacaatttttttcttttgcagaattaaatgtgagggagtctgacgtaagagtttgtgatgagtcatcatgtaaatatggaggagtctgtaaagaagatggagatggtttgaaatgtgcatgccaatttcaggtgaggaaacccagcctattttgaaaagttttatattcttcgtattttataattctaaattcttcaaattaaaaaacctaaaacaccttgaaccccataaagaaattggggtcacagcccctcagttcttttttgtcagatgatgccctgttatttgtatcttccatactgcttgcatggaattgagaggacagattgacaataatagatgtgacaattctttgaaaaaaatgtcaaatttctatttaaatgtaaggtataattgtcactgaaaggaaagaggtacaggttgaactagagtctcttattttaaatgttggcatctttttccttttcttctccttctagtctgtctctttcccttccattcttatttgttgctgtctcatctcttcaggccacagaacttgactgacttggagactcggggtaagtcaaggttag

SEQ ID NO: 134149 - DNA, 1684 bp, Homo sapiens
caccatggggcccagtcaagttgacatagaaaattaatcatcacaaccttgttattattttctacttgctgtattcagcatagttcctgacacacagtaggtacacaataaatgcttgaatggatgcagttccagagtcgtacactgctccatctttctaaactacttgaaatagctggcaacatcatcacattcttctagctaaagaaaaggtacaggggagagttcttcctcccaacaagggtggcaatatagaggagcagactttaggttagacttagaatccaccatcagtgcataagtcagaaatcgcatgttgttaaaattgtccaaatcccataatttgtccattagcataattagaggcttccaggagagacccatggaaactgagaatgaccaacagcaggtctacttctcccatctcacactcactcctaggtatatgcttgtgagggtgaatttcagagacattaagtcctctgctcagtgtcaccaagtgacagatggcaatacaccactgacttaacttgagtgtgtagtggttaaaatacatcatatgggaggaattgtggctcttccacttattagtgactattggcaaatacttacgactgagaaatgatactagcaatagcaaaatagctaatgtttattgagaatgtaccatggtcagatagaaatgccaaaggtagattatcttatttaatcttcataacaactttgttaggtaggtagtattataatcaccgttgtacaccattgaacatggtgatggtgctagcccatagtcacatggttggtgggcccaggatttgaattcaaacatttttggctttatagccttagctctaagcattcaaccatgtgcttcacatggtttatgatatttaagttaggacacttaaagttgtagactaatgcttcctggataaaaaatgtgaagattctcagccctatcagaattaatgcttcattttaatattcagtttctttactatccttagaagaaattcacggataaattaacctacataaacacatgattaaagaaatgaatttaatgcatgattgcaatgtaaaggagaaataaaagtaatttataataaaataaatatttcagaatgtaaatgcttaggtatgattaccatagaagaaaatacagtcatcagatgtttgtgtctgcttatgataaatgtttggattaaaaaaattaaaagcaggtcgggcgcggtggctcatgcctgtaatcccagcactttgggaggccgaggtgggcggatcacgaggtcaggagttcaagaccatcctggccaacatggtgaaaccccgtctctactaaaaatacaaaaattggctgggcatggtggtgtgtgcctgtaatcccagctacttgggaggctgaggcaggagaattgcatgaacctgggaggcggagatagcagtgagcctagattgcaccactgcactccaacctggcgacagacctagaccctgtctcaaaaaaaaaaaaaaaaaaaaaaaaaaaaaaacaactaaaagcaatttcataccaggagtacatgaaacaaaaatgtagatgtctagtagatgctagaataaaaaccaatattaggataagttataacagatcagactgatttgtagtattaaggaaagtcttgtcaaaattcctacatgaata

SEQ ID NO: 134150 - DNA, 1684 bp, Homo sapiens; identical to SEQ ID NO: 134149

SEQ ID NO: 134151 - DNA, 1684 bp, Homo sapiens; identical to SEQ ID NO: 134149

SEQ ID NO: 134152 - DNA, 1684 bp, Homo sapiens; identical to SEQ ID NO: 134149

SEQ ID NO: 134153 - DNA, 1847 bp, Homo sapiens
aacattgtcttgttagatattaagatttttaggttattgatattataaatttctgttggaaatggctgtaataaatgtttgtctacaagtttctgtcacattgatttctaaatgtgtaattctggatcaaaaactgtattcctttttttaggattcttgaaacatattctttaattatgttaccccaaagtagaaccaaaactggtgtagtgggatgtccacctaattgaattttttaatagccaattttataagttggaaatagcatctcatcttagtggacaaccctgattgctagtgaagatcaataatattttatgcattaactggccatttgtaatttttctgtaaacacttcatgtctgtctttggtcccgtttttattaatttgtatgatctattttttaagtaataataacttgtatcatattgttataacattttccccagattttaaaactttagtcatttatgatatttctaacatgtagatgttttcaggttttcctacatgcaggtccagtgtcatttctcaaacctgtattaccttttttcttcttcacctgtcttatttctactcatctttcagggctcagttcatattccactttctctgaggatgcttttcttgaatacttcagcttacaataataggtattaggcatcacatgcttactgatttggtacatgatctagctttgcagtattggttttttttcctactcgtatgactctctgacaagattgtaaggtttccaagaacagagatcatcctatatttctttgtgtcttctgtaccatttaccttgggactttgcctactagatgttttgaataatgatttttttctatttttatgattaggtttgaatgaataaatgaattttgataataataaaatgctattacataagtagcactctttacattgtcaataatttcctcttattaccttggtggtttttcatagcaagcaaatgaagtagatagagattttcattctcatttttttggatagttggtagttattttccttatgaatgtgaaaaaaggtatgaagaagtagcataattctttttaagccaaaaaaaaaaaaaaaccccagactattcagtagcgaagtatgtcataatgctatggtattgcattcatgaatgtgaaataaactattaatattcatgcctagttctgagaatttatttttgttgcttttgcagtgccatacaaattatattcctgtctgtggatcaaatggggacacttatcaaaatgaatgctttctcagaagggctgcttgtaagcaccagaaagagataacagtaatagcaagaggaccatgctactctggtatgtatgatattcttctgaataaattttggaaaatatggtggaatcatttctaaaagggggttttgagtcagaggtatatttccacaactgctgtgtggattggtggtggttgttgcggggagtaggggaaatcttttttgccctcatttcaggttgttgcttttcaaccccaggtggtcttgtatagacttatgttactccttactacattgttaaggcttaacactctttttatagggacttactttctttgcatgtcctttgccttatgatttgaacagtagacagaatgagctttgaggtggggaatgataggggatctgtcttgatgattttttaaaaagaggtgaggaaggtcgggtgcggtggctcacgcctgtaatcccagcactttgggaggctgaggcgggcagattacgaggtcaggagattgagaccatcctggctaacacagtgaaaccccgtctctactaaaaaatacaaaaaattagctgggt

SEQ ID NO: 134154 - DNA, 1141 bp, Homo sapiens
atgactcactgcagccttgacctcccaggctcaagggatcctcccacctccgtctcctgagtagctgggactacagacacatgccaacatgccaggttcattttttttttgtattttttgtagggacagggttttgccatgttgcccaggctagtcttgaacttgtgagctcaagcaatttgcctgccttggcctctcaaagtgctgggattacaggtgtgagccattgtaccctgatattcatagtttttattggggctcattatgtaagtataatttgatgagttggttgtgtggttaattgaagactctgggtccactaatactgtgacctgtaacccctactctactcttcatgattggtctttctagtgtaaccagccccaaccctaagacttagacgtggcccaacccccaacactaagttccagtgtggtcagcaccctcccttaacaaatatccttctatcaggtatgacgtaggttaccttccggaagcagagggaaaagacgagacctctcttgtaggaaggccaaattctttctatacacactaaaataatcacgtgcttggagaaattattatgtttttagtctagtagactatgatttggtgtggttcttatatacttctttaagtacattgtgtttcacaaaatgatctagaaattaaagaggaatatggaggttctttccagtctcaaattatgtttcacttatgaggagcatatgtctaagacagcaagtgttaacacctaatgttaaacattaggcagcaaagtggtagattgggagcactgtgctagggttacaagacctcgccttaacctaactccaacccttatttactgtgtgaccttggacaaatcactaagcctctctgagccccaattccttaacttgttaagtggatattatctcctggggttgttaaataaggattgaatgagcaaagttataagctgctatattgattttattttctgagtgggcagtgttttatgttatttggtcttttgtggatcctattccttgaactagaaatactattctcttttccttatttgaaaactctttttcttatgcttaaggttggtcttaagccttttctcctctgtgaaatcttccttctgtgacatctc

SEQ ID NO: 134155 - DNA, 1141 bp, Homo sapiens; identical to SEQ ID NO: 134154

SEQ ID NO: 134156 - DNA, 1141 bp, Homo sapiens; identical to SEQ ID NO: 134154

SEQ ID NO: 134157 - DNA, 1141 bp, Homo sapiens; identical to SEQ ID NO: 134154

SEQ ID NO: 134158 - DNA, 1132 bp, Homo sapiens
ccataccttgctttcaagtttttgctcatcaggaattttcatggtacagggttaaaaactccagagggagttgtgcatagaaaaaggaagacttgcccaacaactctcgtggaatttagagtttaatttaaacctttaacaatttcctatctatgtttttgattttattttacaaatatatgaattatttctgttgtttaaaagattaatatttggtaatagcatataatggagtttaaatgatcagaattgagattgactaatctatatcatagtctaatgaggctataattcttaatgagtatgtactgtataccaaataatgtttgagatattatggggtacaccaaagaacacccacttcagtacaattcacacttaatgcaaatggaaactacagttatgatcctttcaaaactgcctgaaacctcactccatacgtctacatttcatagaatcttaaaatttcagagttggaagggactttgaaggtctcctggagaataggagaactgtcctgaggagaaattcaaggatgacagtttcagctaaaaaaaaaaaaaatgattaaagctttcaaacaatagaatttgaagtagatggacatgttcaagcagaagctttataatcaggtgtgaaggatcagataataaattccagatcttagagctggaacagattttaggcgatcatgtagtctagcccctgtggtcaggtattcagttaggaaactgtcattgtcattgttcctatattaaagaagtgagagttgatctcaagatttgcttatataatacaatattgggctgggcgcagtggctcatgcctaaaatcccagaactttgggaagctgagatgggaggatcacttgagcccaggagtttgaaaccagcctgggcaacatagtgagaccctgtctctaccccaaaaaaaaaaaaaaaaacaaaaggccgggcacagtggctcatgcctgtaatcccagcactttgggaggccgaggcgggcggatcacctgaggtcaggagtttgagaccagcctggccaatgtggtgaaaccccgtctctactaaaaatgcaaaaattagccaggcgtggtggtgggcgcctgtaatcccagctactcaggaggctg

SEQ ID NO: 134159 - DNA, 1132 bp, Homo sapiens; identical to SEQ ID NO: 134158

SEQ ID NO: 134160 - DNA, 1132 bp, Homo sapiens; identical to SEQ ID NO: 134158

SEQ ID NO: 134161 - DNA, 1132 bp, Homo sapiens; identical to SEQ ID NO: 134158

SEQ ID NO: 134162 - DNA, 2850 bp, Homo sapiens
ttttttttaaactctgaaattagtttttatgtagttagaaagacaagtatgaaactgatgtgaggaaaaggtgagagttacattcttttgtggtcaggcgcttatctgctgaccagctttgcacaggctgattgcaacaggagggtaatcacaggacttaaatgtattgctcctgtctcttttctttctcccttattcagtgttatatggtaatttttcttaaaaaagcaattcattatcaaacctactgtgtagttctgcctacatagtttaagggatcatttttcagcaccaaaacttgttttcctcacaaaatatgttgtactcagtactggcaacatttttgaacttcaagcattggtagattttggaagtgactgttttcaagagctcaggtacattttcctcagaaacaggataatgactgctgaaaacatgaagcatatctggaaaggatcccaacttttggttgtaaatttgatttttctttttaaacagaagaggaagggtcaggggcagaagttcacagaaaacactccaagtgtggaccctgcaaatataaagctgagtgtgatgaagatgcagaaaatgttgggtgagttggttgaggggaagggacaaagttatttagagattaatcatcagtatgattatattgtggaaaggtatcatttacctggttctgtatcttttgtgtgttttcaaattttttttttgtttaatgctagtctattgacttttaaattgatataatactatggctatttaaatcagtttaagtgttataattttagaatgataatccatttatagttttctggttttatctatgcttttcttcctccctgtagttttatagttttatgtattttataccaagtgcttttctcactcatgttcagccttcattaaggtaggttttgtagctgacagcactgtctgtccaatttcccattcattccctgtaagaaatggtgttcttttttagaacagtaaggctgcagacatttatcaacagtcatgtttgatttttcctttcatcagtattcttatttatttccaatatcattcttctttcattttcctgtggtgctggctttttgcatatttgattctaaaagctttaatgttgactttaggacctgggagcataaatggatcttcttcacttcctcagttttcacttagtatctattttaaaacatttatttccataagatatttgtgctttcttccttacttgtacatatttttggtgtgtattttccagttccgtatttattcagcccgtaactgcatattcgagcctttcactgaacagtaataatatgatctaattagcattaatgtccaaagttagttttgcaaattaagaacactcaattttcagtattatgtacaaaatcagctatttggatggcacttggtaaaattgtattaatttatttggtgcatatttcaaagtgggtgagaactggcaaaagacaagtaagttcaataataaatgaactcaacaaaacctgaatttactgtttctgcatattggtcacatagattgacccatgtccattcatttcattcagagtggtttgatttggaagaacatgttttccaaagcagatactggcctatagaacaatagagaaatgatgagcaatatggacttacagagagaactgataatagatattatgctgtttcttccttttattttgtactaatgatatggcatgatgaaacaccttaatataggtatatgtgtcagtatttttccttagtactcttctgtattagtgttcagagtcaaaatagctgtcagtgattgattggcttgatcaattggtctgtttttattcctttcgcggtgcttctattcatccctattttatacatttttctattatcatttttcatgcctaaatttaaaaagatggaggtcttttgcttagaattgaaacatattccatctagtctcagaagtggctccagatgtgacatctgcataataggctgggtgcaatggctcatgtctgtaatcccagtgctttgggaggcttaggtgggaggaatgcttgaggctgggagttctagacatctacatgataaaatacatatctttatgtaaacacctcctcatagtgtaatatgtagcctattcccaatcagagcaactctgttgtgtttactaaattaattttttgtgtgtctatttatctgagagcttgccaccactattgttgcagataccagctctaagcataaggaagtggacatagaccatggaagggcttaccaatagtaaggagcatgcaggctcttaccagcaggctaaggagcacatagacagtgacaagcagccaacgtcaggcaaggaaattgatgcaacaagaggaaaatacgaaggaagcagttggtatctttatctagaaaaaagtgattaagctaaagtgtttgatccttctatggaaagagacaaaaggaaatgttggtaatatctaatcttttagtctgtaaagcacttgttactgattgcagttgttttaacagtgtaaatgtatctcagtggttatttttttttaacttttaaatgggccatggtaccaagaaagttatatagtggttatgtaactccctcaaagcaccttccatgtgtttttcatggttgctaaccaggtgaatagtgatgtatctaaaggtaatttttacctatccagctgggccgtttaggtctggaaaatggaaagctgcagaaatatgacattagccattaagtcttgatttttatataaaaacctattatttattaagatgttacataatttccttattaaaagataaacttttagttat

SEQ ID NO: 134163 - DNA, 2839 bp, Homo sapiens
acttcatgtaaaaaatacatttgcattgttatccagcactcctgtttatatacacatggtactaataaatattaagtcaaacaaaattctgtggaatagtacttacctttattaaatgcaatgtactctaatattttctatcctactttcttataaaatactggcagtgaaccactaaattgacttcataatccactagtgattatgacctacagtttgaaaagtattgctctatagtaaactataatagatgtgtactgcatgtatttttttaggtgtaagtattcatttaaaattttattgtatgccagctgtggtggcttacatctgtaatctcagaacctttagaaggccaaggcaggaggattgcttgagcctgggagatctaggctgcagtgagccatgattgcgccactgtgctccagcctgggtgacacagcaagaccctgtctccaaaaacaaatgaacaaacaacccagaaaatcaaatgtactttgtcttttctcaatttgaaatgtctttcctgtcagaaaaaatgttatccaacctatctgatttgcaaagagcagctaaaatctttctcttgcttttaaaaattctttctcttgctaatggttgttaaaaaaatctggcattttggtgaggggataagtgataccgtgtaagttaattttctgctattaagagaagtgctttttttaaatttagccatttaaatagaaattgatttaaatacattacatacttctttgccttcttaaacagaatatacagaacatgtttaacatactcttacaattacatatgtagtatattacagttttcagagcattttttacacataatatatttttaagctattctgagcagttctgtttggtagtagagcaaggaagtattatcctgatttttataggtgaaggtgagttcagaaaggctgaatggagaaccagaacataggtctcatgacaaggaatcagtctattgtgttgtgcatgcacatgtagaggcccatgatgtgtggttgtttcactgctgcacttaaggcttcatttagctttgtgttttgggttctatatctgttttttaaaaatgttttcttctctcttgtaaggctgttagctgctgcttctagatgctgtcagtgtgccttggcaatgagtttgactgtagatgccctcaatttttaatttgcttctctgcttccctggaataggaaacaaacactcgcagaaactgtatctaaagtaagaataagttctaaatgtaaaataagagtgtataggttcttctgagtgaagtgcgtgaactttattcattgtatgtgttttatctgtcttgtctgctcaatggctattgtaattcatttataatttaaattatttttgcttctaagaggcttccccctcacccttccttcctgaaactcactgcatttctttgatggcatcgtgggctttgcttgggtttgtgacagttatgttcgttaatgcttacctttcaaatttatacctagaggtgtaggtggttgaggctccaagaaatatgactccccacataagtgggtttcagtatttcactgtgaccactgtgaaacagtgcatagacttcctactgggtcttaaaacttgaaaacagccttcctttacagcaacttgtatttcttaaaccacatattcttagtaccacaccccctcactttctaaacagtatttctaatctgtccaaggccgaagttattgttgtaagatagccatcagctgcttctctggatagtggggacacataatcataggactccttcacttcagtaccttttatatacccgacctaaatccctgcccaggaatggtgtgaggagtctgtagaatcatcaggcctaatgccaatacaggtgagttataaaaatcctccagttattccttttgaactttgtctgcaatgcactttatggaaatagcccctgctcttctgccttttttatgtcagtctcctttttagagatgctgtttccatttatccccctgagtgatataaatatctcagagttgctcagagaatcatacaggtgcagggtatggcagacaacatggataaccagtttaatccacctgctggacatcttagtcatttgtggtaccattttctgttttgatgcagatttctggtcagtactacaatatgacgagtctctccctcagaaggtgcagtgatatcttttctcttgtgtaaacagagtaatgctacacatttgtgtcctgcaatatatcctcctttctggaagcttcatgtactttttaaaacaagaactgaagaagtaccttttctatccttctgtttttatttcctcctaatcagagatggcagtaatttttgtcatttagcactgccttattctggatattttaaaactatttttaggtttagtaagtccctactgtagccccttagattataatggaaaaataattttgtgttgttttttaaaacacaaacattattaagcattattttatccaaagtataatctggatgttagtaatgacaggttcctttatccagaaatatcttctttttttttttttttttttttttttgagacggagttttgctctgtcgcccaggccggagtggagtggcacaatcttggctcactgcaacttccgcctcccgggttcaagcagttctctgcctcagcctcccaaggagctgggattacaggtacctgccaccacgcctggctaatttttgtatttttagtagagatggggtttcaccatcttggccaggctggtcttgaactcctgatctcgtgatccacctgcctcggcctcccaaa

SEQ ID NO: 134164 - DNA, 2839 bp, Homo sapiens; identical to SEQ ID NO: 134163

SEQ ID NO: 134165 - DNA, 2839 bp, Homo sapiens; identical to SEQ ID NO: 134163

SEQ ID NO: 134166 - DNA, 2839 bp, Homo sapiens; identical to SEQ ID NO: 134163

SEQ ID NO: 134167 - DNA, 1102 bp, Homo sapiens
atatagggttaagaaaaaaggaagcaaaagtgtggatgtttttcagtaataataccattcagatgtgcacagtatttgatagatttcaaaggactttttacaaaatcttatttgatcctgtcagcagtgttttgaggtattatccctgttttaaagacttggagttgtgatttgccaaaattatagtgctaaatcatagaaggtattgaatttatgcattcatttatgtatgtatatatgcattcatgccttcgaaatttagtgctgccaattcaaaagcttaaaaaggctctagagtgaaaggtctcacttccacccctgttcccagtcactcagttgccttcactagagacagtcactgtgatctgtttcttgtttaatctcctggggtattttatgtatgtgcaagcagatatgtacatatattcttttatttaaaaaaaaaaaactaatggcatcacactatacccgtagttctgtaccttatttaaaatctttattgtaaaatgtatactgtatacaaaagtgtttaaacatacatgtgcaatttaaggaatacctgttaaaaactacctatgtacctaacacctagggtacaaaatagaatactgctattatttccagtaccttgtgttaacctagccatggaaggaaagggcaatagtgcccacttagagaggaaggcttacggaagacactttgaacagcctctgtggcagggtctggttttcagctcctcagagagtttacaaggttcccttttggggaagtcagtggacaaagccatgagtattggagtcacagggtcatggagaacgtaggctcactatagttgaggcatctgataggattctaatgtctggatcactggtagaaatgtgatcagaatggactgctctgctctgtgttgtttacttataatctccccatagctcatcttcagctgtcaggagtatgtcaattaactgagtgggttgagttgttcttgcagcaggacatggaggggagagcaggaacttcattatcttcatttatttttttttattatactttaagttctggggcacatgtgcacaacgtgcagatttgttacatagtgcat

SEQ ID NO: 134168 - DNA, 1102 bp, Homo sapiens; identical to SEQ ID NO: 134167

SEQ ID NO: 134169 - DNA, 1102 bp, Homo sapiens; identical to SEQ ID NO: 134167

SEQ ID NO: 134170 - DNA, 1102 bp, Homo sapiens; identical to SEQ ID NO: 134167

SEQ ID NO: 134171 - DNA, 1053 bp, Homo sapiens
caggagttggagaccagcctggccaacatggccaaaccctgcctctaccaaaaatataaaaattagccaggcatgatggcatgtgcctgtaatcttagctacttgggaggctgaggcaggcttggacctgggaggcggaggttgcagtgagctgagattgtgccactgcactccagcctgaacgacagagtgagaccgtatctcaaaaaacaaaacaaaactaaactaacaaccacaaagaagaaaatctgttaactttaccagattgctctttgaaattaattttctcttctcctttgcctgatttgaccccctctattctgctactctttttcacattatttcactgcagcttacctgtagccatgagaataatcattctcaaatattgtttttattatattactcctttaaagacaaatatatatttagatttgatatttaatatagtaatttggaatttggagggtattttaacaaccttcttttattttgatatattaaaaaacaatatcttctgtggaaacgagcatgggctctctcaaatgtagcagtgtgtatatagatcaggctatgtttattagtgctagaagcgtgtcatttatttcaaaagtaaaactaatggtatgtgtatatcaagaccctattgagagaatctgaaatactgttctttagtagaaaaaaataggttaaatctttgaaagcccatttctaggggtaatgtcttggaagtttttatgcagaccttgcctcatattgtagggctcaaaaaattttttaaatgaaagtggttattgcatgattttttctcctttatgctgagccttgaggaagaggaactgggaacaaaaaaaacgaagagaaatatggcctttccttggaaaattgagcagggaggttcacaattaatttaatacctcaagttttgtttaagtaatgggaaaagtttttgtacatttgtttaatataaaaagcattgtcactaattttggtaatgggcaagccatgatctttgagcctctgaccttttaggattacatttcttttaagtct

SEQ ID NO: 134172 - DNA, 1053 bp, Homo sapiens; identical to SEQ ID NO: 134171

SEQ ID NO: 134173 - DNA, 1053 bp, Homo sapiens; identical to SEQ ID NO: 134171

SEQ ID NO: 134174 - DNA, 1053 bp, Homo sapiens; identical to SEQ ID NO: 134171

SEQ ID NO: 134175 - DNA, 1051 bp, Homo sapiens
ggtgacatgttttgcaggccatacctacagagttgagtatatttaagaagttaagtatgtgtctaaagtttgatgtggttatcagaaaagttaatgcaatcctgcctgtgtttatgtaagcatagtgtccagaacagttaaggtaatagcttctctgtactgtagtccttgttttgttcttggcctcatattatgagatactgaatttggagggtgatgaggatgatataacaaatgaatcattgaattaacttcaggtgaaaacttatattcaatataatgattatctttgaatctttaaatgatattttgggcttattacatgtagattcagaggccagagttagagtcaatgggtggaaattaattaggatgcatgtttggggctcagcccaggtaataaccactcacccatgagatgtactgccttggtgagatagtaagctgtctattgctacagatgctctggcaggggcaatgtaacaataaggtcacaaatactgctgagaggagccctgcactgagtggaagatcagaatagatggctttctaaagtccttttcagcatggcattctttcaatatttgtttagatacagagatattatgactaaatgtttgtgcacatgttttcacccacgcatagtagattgttgttctctgcatttgtctgcgcccctcccttatccacaacttttacctgaactcaccttctgtgattggctaactttattttctttggttctttcacctcttgttttccagaaattaaatttttggtacaatatatattttttgactttagtgaatattcttatgaactaaaatttttttctgtttccttaatttttaaattataaaatatattcaaaagtgtatgaaaactaaaatatacacatttgattgaatgcgcaaaaatgaaatgagcttttgtgaatctacctcccaaggcaagaaacagaattttttttttttgagacagactctcatgttgccaggctagagtgcattggcgcagtatcagttcactgcaacctccgcctcctgggttc

SEQ ID NO: 134176 - DNA, 1051 bp, Homo sapiens; identical to SEQ ID NO: 134175

SEQ ID NO: 134177 - DNA, 1051 bp, Homo sapiens; identical to SEQ ID NO: 134175

SEQ ID NO: 134178 - DNA, 1051 bp, Homo sapiens; identical to SEQ ID NO: 134175

SEQ ID NO: 134179 - DNA, 1048 bp, Homo sapiens
ttttgtttttgtagttttagtagagatggggtttcaccatgttggccaggatggtctccatctcttgaccttgtgatccacccgcctcggcctcccaaagtgttgggattacaggcgtgagcctctgtgcccggccagaaacagaattttagcagtacagtcgtctgtcagtatttggggggaattcgttctgatactcccctcaaataccaaaatctcaggatgctcaaagccctgcagtcggccctgaggatatggaaggcagactgtacttcagggcctcccatgtctctctctaattgcatctgtctctcacccacatgctatactgcattttgcagaaattattcccttcctttctttatattttatcacatatgataggtcccttaatgatctataatctggcttttgattgcttttgtattttgtataaatggaatcatgctatatgcattcttcttgattttctcgtgcacagcattatgtttttgagattcatttatgttgatgcacatagctgtagttaattcagttttactgcttgttgaatttgattgtttgcctgtaccacattcttttacagtccattttactttcgacgtttggattattccagtcttttgttttcatgaataatactgctgtgaatattctttcacattttctggtatacacgagtaggagatattctttttttttttagacagagttttgctctgtcgcccaggctggagtgcactggctcaatctcagctcatcgcaacctccacctcccaggtttaggtgattttcatgcttcacagcctcctgagtaactgggattacaggtgcctaccaccatgcccggctaatttttgtattttagtagagacagggtttcgccatgttggccaggctggtcttgaacttctgatctcaagtgatccgcctgcctcatcctcccaaagtgctgggattacaggcatgaacctttgagcctggcctgtgtgtaggagattttcaacggccttgccttgttgtgaagttgttgggcgtgtgcaagtct

SEQ ID NO: 134180 - DNA, 1048 bp, Homo sapiens; identical to SEQ ID NO: 134179

SEQ ID NO: 134181 - DNA, 1048 bp, Homo sapiens; identical to SEQ ID NO: 134179

SEQ ID NO: 134182 - DNA, 1048 bp, Homo sapiens; identical to SEQ ID NO: 134179

SEQ ID NO: 134183 - DNA, 1081 bp, Homo sapiens
gcaccagccggccttgccaagtgcccacccgtgcctccccctccccacctccccgctagcagagggagctggctccggccttggccagccccagagaggggcccccacagtgcagtggcagactgaagggctcctcaagcagggccagagcggatgtcgaggccaaggaggtgctgagagcgggtgagggctgctagcacgttgtcacctctcactaccagcagaggatgagaattcccttagcttctcatccttgccagtacttgggttttgtccttgtttttgacttttgccaatttcgtgagtgtggatggtatctcattgtgattttaattttaagttttctgattcttaatgaggttgaatatcttttcacatatgttgttcttatatgtttcctcttttatttctatttttttgctcccctttcccattgatcacatatattatttaaaaaattgatttgtatttgtgtattctggatactacttatttgttgattatgtgggctatgtttatctttttgtttgtaacttgtcttcttattctctttatggggcattgtttatttcaaattcctcagtcttacgtttgatctcctaaatctttatagtttttgactttcacatttaggtcttcaattcattatgaattaaggaaatcatcaaacagaaaaggagaaaaatgatggacctctacccatttattcatcttcaaaagtctaattctgttacctttttttgggaagtatttaaagcaaatcccagcatcaagtcaccttacctgttaagatttcagttttgctgatattttttctgcttggtatatgagttgctgagagaggtgtgttaaaccctatcatggtggatttggcaatttcattttttttttttttctttctttctttcttttttttttttttttgagatggagtcttacactgttgcccaggctggagtgcagtggcgctatcttggctcaccacaacttctgcctcccaagttcgagtgattctcctgcctcagcttcccaagtagctgggattacaggtgcctgccactacacccaactaattttttgt

SEQ ID NO: 134184 - DNA, 1081 bp, Homo sapiens; identical to SEQ ID NO: 134183

SEQ ID NO: 134185 - DNA, 1081 bp, Homo sapiens; identical to SEQ ID NO: 134183

SEQ ID NO: 134186 - DNA, 1081 bp, Homo sapiens; identical to SEQ ID NO: 134183

SEQ ID NO: 134187 - DNA, 1844 bp, Homo sapiens
attttttaaccttcccagttatttggcaaggtaggttatttatttatttaagacagggtctcactctgtcccccaggctggagtacagtggtgcaattatggctcactgcggcctcaacctcctgggcttaagtgatcctcctgcctcagccttccaagtagtggagaccacaggtacacaccactgtgcctggctaagttttttattttttgtagagatggggtcttgctttgtttcctaggctggtctcaaactcctgggctcaagtgattctcctaccttggcctcccgaagtgttgggattacagtcatgagccatcatgcctggccattattattacctccattttactgatcagtaaactaagacttagaggaagaatttggatacaaatctggtaataactaggggtagaatttagatttgtgactattgactcataattctgtgtcctttacaatgtgccattttgctatttaattaatgtcattgatatttgacatctcctgattactttatctagatatgaaaattccagagaaaccactggattcataatatcttgatgaaattatctctaaatcctcacctaaaatttttttaggtatttactttgcttaagctttcatcagtgacttaaaacaatatattgacttctgttacagaaagcagaagaaagaattggtcttttttgctgttgcagcattgtgaaatatttttgttgtaaaatataggtaatttttgtcttttccaacaggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacaggtaaaatccattttatttattcagagacccatctttattattgtataaatgtaatcttatttgtacatttggtagtgtttcaaatttgtaaaatgagaaatcctcgaagctttatttttttattactttatatttcagattttttattactaatttagttttttttcattattttcatcttctcaagacataaaccatgcttcttggttttttatttagttagttcttggttgctagctgatcctaacatggaattataattattatttatagttctaatatcatctcaaatttggaatgattatagctatttaagagttagataacttattttaatttcagtaaaactatgttattgccatatatttgttaaacctctttttatagagcataatagtttactttgtttttccattatctgtatcattttccctgtacatattatgtatgatacagattttggtgtgaagttagagaatgtaaggaaaaattattgcctttagcttaaaattcttttcacccttcttgctttttgttatagcttagaaaccatgataccatataagaaagagtttttgttttccacccctactagaaatattcagtctctaaagccagagttcccaattttctttccccagtaatattcagatgagttgggaagatggattatttcctcagtcacatatgtggaccaggcacactctcatggactaggattgtatatctttcttgcttactggttcccttcttcctccctttttagacttattaaagggatattatgtttttatctgagctaaagggaaaaggttgtaagccaaaatttggtacattatattggtaacaaattatttgtgacacactacacaattgattgcagtacctctggtctaaactaccaaagaatacccaggaagctcatcagacaatttt

SEQ ID NO: 134188 - DNA, 3173 bp, Homo sapiens
agcgagagggaaatctgccccccatgatccagtcaccttccacaaggccccttttccaacgttggggattacaattagacacggcatttgggcagggacacagaaccaaaccatatcagtcaagtttgagagtttaattgaaatgcatcctttagagtgattgggccttaagttttgtcttagtcccctctgtaatttttcattcacaaacctaactatgtctttcgtttgcctcctccactagtactgggaagcttgtgcttctaaacacgtggttatggctcatttatagtcttcccagtccaggtgcagttctcaaatcaggggtcattttttatagtaagtgtttcataacacagcagagattccccatttatcttaatctgatatttccagggtaacagtggtaggagaaggtaaatcttgaggcagttgtcttttagagaaagaaaggtttaaccctttcttctcagagtaggtgttgttttagtttgcataggaaagagtttttaaaggaggcgacattggagctgaagtatagatgaaattggctattcatcatgcaaagagcacttatacctaggatgcctagaggcctaagacagaaatgacataattgatttagagaatggtagacaacatgagcaggataagggggcagaggttaagaagaacttggaataatttggaattattgggagtatcatgatatgacttaaccattgtatatattttaatttgaaaaccgtcttctcttacagatacagatgacactagtttgttgggaaagaaagatgatggactacaatatcgaccagatgtgaaaggtactgaatcatgcatctccaaattttggccagctatggaaatacggtcactagctgtccttattagttctgtttccattataacaacacctctaactttgctctctatagtaatatacctaacacagttaattattagtattaatagtaacagaaacagctgaagttcatctcattttataaggtactctcatatgtgctttctttgattaaagtctgtattgagataattttagatgtacatgcacttgtaagaagttatacagaaagatctctcaatatgttttataaaaatcctctttactcctctagaatctcctgttaacacttgcccgatgcccaggtctttgaaccttgttcctttgcctgaaactctttatttcctttcctgattaattccttcttatccttttaatcttagcttggaagtcattttattttgggaaatatcccttgaatctgaagtctatattagatgcctttcctgtatactcccctctctgaacacttagcccactctattataactgcctttttattcatctgtaacctcctctaggctatgagttctgtgaggagaggagaacctgtctgtcatgttcactctgtatccctaaccctagccgaatatctggtacataagtaggtactctgtgcttgtctaaagagtggatgtggctcaaagaagcagtaggttttatttacacaaggtctcatgtagtaaaggttggagcagaggctggattccaggtcccttgacttcaaggccactgctctttttgcttgttttcacatccattattttgtttgattcttataactgctctttgataggtaaggaccaatgggaagattgaggatcaatgaggttgtatctggttaactgaaacaggtctatatctttggccttctaggccaggacctctatataattgctgaattacaagtgcatcatctatccatttgtttggttgcaccattaaaagatatgtgatctatcttttatacctaatttctaaacaatatgtaaaatgggagtgataatagtacctgtttcctagagtttcataaaaactaaatgagataatatatgttaagtgctttgaacagtatcggatatacttgtaagtgttcaacaaatggtagctgttatcattgagtaatttgttacttctcttacttgaatcatatgaaacctgagttagttataacccatgagctgctgaaatatgtctcctatgttgaaacaaaatgctgtatttaaaatagaaaatttcctgtattctcgtaggagacaaaataggtcagcttcagttttattcactatattgatagtacttgactagaataggaaggccatttttcagtatttggaagctcatacttagggcagtttggggaattgtgtgttctaaagcacttgtgtgccattgataatggataatttagagcctaggccacttttgagatactgaaaatgttttacacataagaattgatctctaatttaaatgaaattatcatagtagaaataatttattatgtacctaatttatactggtcattttactgtttgtagttaggaagatatctaaaatatatgcatctttaaagttcttgtgatgtagtaaatgcagataaccaacttctaacaaagtagaaattgattattgctataagtgtatacagtttaaaagtgcaatgggaattcagaaaagttgagattaatttttggtggggaacagtgggaatctgtgaaatgtcttggaagaagtggaacttgagtgaaccatgaaggacgaacaggagtcagaaggatatctaaggaggataggagagcatgagcatagatatgcacacaatgttatgacaggatgtgttggagaaaggtaaggaatcctttgggctggagaataggaggcttaagaggtagaagtagaaggcaagactagaaagacagcttggggccagattgtgtagagtgttgaatgctatgctactctagggaatttagactttatttgtgggcagtggggaatcattaatatatttgaaaaaagcaaggctacaaagttaaccatttgaaagaatgatacctggcaggaatattgtgcatattgtatacattggaatggaggcagggatatcagttaggtaaagtcaaaaggaatagacatcttagatatgagagatagagagttaaaaatgacttaagtcttcaagctcagatgacttagatgatgaattctgttcacagaactaaggatattaggtaggtaaaggtgtttggaataaagtaagggaggagttgatggtggagatgattgattgtattttagagtttga

SEQ ID NO: 134189 - DNA, 2463 bp, Homo sapiens
aaaggtgtttctctgggcacagtgggcaggctaggaaaggaggaatcagggctggtgtggaggacagtggggtttagaattgggagagtgggaggcattggagtgcgggtaggagtttatatagtggaagataattccttaatggagtccaagcagatggtggttagggaaggatgtgtggagggatatgttagtggcgaaggctggggaggtgcagggtagtataggggaagcaagacagaatattttgaattttttaactgtagagatttatagaaataatgagccctagggttactgatgcagtgttgatatagttgtggcctcagtggtttaccttccagatacatgtctccattgctaatagcaactcctcatgctttattttggttgtacactgttggaccaggacagatagccagtggaacaagcctttgcagataagccatctggtactgggttttttcataacatcatcccttagaaccacaactatcctttgtatttgaaaacactgcagctggtggtggatttgtttctgaatgcctctgtgggtgaaaggagccatttggtgaccaagtatactttttatattgtacacacagacacacacacacacacacacacacacacacacgcacacacattgttgcagttgcaacagactagcagttgcagttgttgttcttggagcctgtcaccacttagctaagggcttgtttaggcaggatcattctgtgctcagttcttactgtgtgcaggtgacatctctgctgttgtttccgaaaccatgttatgttacatcttttgaggctttttatctttcctttttgaagttggctaatttacttggcctggagagcaggtgcttggccattctgctttttatctgtttcctacacatctcctaggatagcttggagaaataatactgtaatggctaagagcttgctctctggagtcagacttggtctatatctaatagctgtgcgtgttgatttctgtgagcctcactgatcacatctgtaattagggacagtaatatctactacctaagatcactatgaatattaaacactatgttactgagttcattatcagtgttattatggttatttttaatacttttgtttcctagtttcatgttgagtaacctggctgtgctcaacagtctcaccattggtgagatagttatctgtcttgttatttaatattatggttcataagtgacatcagtaggatattctttcatttaatagttattaattgagtgccctactatgtgccaggtgctttcacatatttatgttatttagtcctcataacaaccaagtttaccctcattttgcagatgaagaaactgaagctgcaggagttttgcccatatagaatggcagaacagcgactggaattcagcctttctgaccctaagtgctgctccttccctttgtaccatgattctagaattcttttctgcttccttgctttcttaattaccttcagatatttaatcccctctgagctattactttggtgaaccttaacacttgttctcgagcctggatcttttttcaagcactggtttcacatattcagttgcctggtgggtccttgtacttacttgtttgttttgccattgcttcaaacttctggaactaccatagtgcctggaacgtaatagatgcttaaaaaatactttttgaatgactggagatctaaacttgatctcagcttactacattttctcttcggaacccccatcattaggctcacatttggagtcatttttacataattctgtattacaagcatcttcaataaagaggacagtttggttctactaaactcttaaatgtgcggggttagtgctgggtaccactcttcaagatagttgtaaattgtttgagtaggggtgggactggggaaatctgagcttaaaaataaaggattggttaatagaggggagagggtaaacagatgtggggaagtctacaccaagttgaagcgaggtttcattcaacataaagaaaatctgatggtattagaataaactgtattatgagttctggaagtgttcaagtagacataggctctgagagttataaaactaaagagattcctttatcaaaccagatggcctccaaggacccttccagatctgagtttctgagctcattcactttccaaaacatcttcaaaccatttttattttttctgtgtgtctagtatctactcctattgctgagatttagcttagcttcttgttgccacaagtttggattatgtactaaccttcttatttttttgagacacagtctcgctctgtcacctaggctggagtgcagtggtgcgatctcagctcactgcaaccttccacctcctgggttcaagtgattcttgtgcctcagcctcctgagtagctcggcttacaggtgtgcaccccattcccagttaatggattat

SEQ ID NO: 134190 - DNA, 2463 bp, Homo sapiens; identical to SEQ ID NO: 134189

SEQ ID NO: 134191 - DNA, 2463 bp, Homo sapiens; identical to SEQ ID NO: 134189

SEQ ID NO: 134192 - DNA, 2463 bp, Homo sapiens; identical to SEQ ID NO: 134189

SEQ ID NO: 134193 - DNA, 1072 bp, Homo sapiens
gtctcacctagaattcaaatttttccataatctagttttagcctacttttccaactttgacatatacccttcgccagtctgaatgtatcactctacctgggttgctactgtttattcttgagaatgccatgtgcattataccttccctttgccttccaccattcctctgtctaaatctatttatgctctgagtcttaacttaagtcctaccctatcaataaatcctttagcctacagtgaattctcctttcaatttgaacttccatagcacctagtgttataaaaccatcttttgccgtttaattgtaaactgccacatgggaccccttccccttgtgttattcagcttttcatgtgtatatgctgattttctaaattgactataagcttcttgagggcaaggaccatgcatgctttttttttttttttaatatcctctgtagcttagctgagcatgtagctatgtccagaaatagtatgtacgtttaatgggatgaataaagttggcattgagcggaatattagactctgtgaattcggacgttgtcacaggattcaaagccttattagacatgttcatgttttatatagcctcactttgcctacagcttgataccacattctttcattaattcattcagtatatgtttattggtgccatacttttcttattaatttctcaaaaccttgtttttaatttggttaacttcctctgactgctttcacctagctgagttctcttatagctttcagctctgcattattcttgaaattccttgctgtttaaagaacttcttatggtagattagtacattaccacagcctctacagacctgcaccgtcctattactaggactctatccttataggactttattatcataggttggtgcataacgttattctctatagtcccattgttataccctttcatgaccatgttctgagaaatgctatgggagatgaccactttcctcaattcacttatggcctgattgggaatgtagagtggcatttttagtttgaaactgtagcaagaaaagtatatttgatctcagttatttggcttctg

SEQ ID NO: 134194 - DNA, 1072 bp, Homo sapiens; identical to SEQ ID NO: 134193

SEQ ID NO: 134195 - DNA, 1072 bp, Homo sapiens; identical to SEQ ID NO: 134193

SEQ ID NO: 134196 - DNA, 1072 bp, Homo sapiens; identical to SEQ ID NO: 134193

SEQ ID NO: 134197 - DNA, 1331 bp, Homo sapiens
aatctgattttgaagaccaagttcctatgttttcatctttcctgacctgttccatctctccttcctgactctcttcattttcttcacttcagttcagttcaaatcattatacttaagtctgagcagatgttcatcaacatgttgacagtgttttatttttggagagcgaaatctcaggttattttgaatttcttttttaacctctgtattacttgaatttttaaaataatgaccatatactaagaaaaactatatgaaaagagcagcaaagctattttcacttgggaaaaaaatcaatgtgcttgataattttcattccaaaaataaacctttaaccctaaaatttcagagtcccttaatttgctctctgtcattcagtgttctttggcctcaatttcatagccctcaaataaatgattaagttcattccccaaaagccaattctatgtacaccatctgtctgtcacagaggtgaactttcttttagagcatttatttctttagcaaaggtgtttagttttctttgccagattgtttttaaacaacagtaactcctagcagtcacattctgcaaatatttttaaatgctttgaatctaaacagtttacctgctgtgtttatggcataataggaattagaagagaccctggatcttatctaaccccctatctgataaattttcttttcaaattgccagtaggtggttgacagtgggtgaattcatttgctgtttcagaacatttgaaaagtccttatttttcagcttgcgtttcattgttgaacgatctggtttatgttcttttaagatgctagtgatcaaagagaagatgtttatattggaaaccacatgccttgccctgaaaacctcaatggttactgcatccatggaaaatgtgaattcatctattctactcagaaggcttcttgtaggtaagtcagcgcttccagatcagtggtgagcattttttttcatcaatggttgttgctctatagaagggaatgaaatgtagactaaatattaccagaaagtagtgtttatttgcagtagacaagtaaaaaacaaatcagcagcatcatttggaaaaaaaaactggcaagtaatatgcagaaaacaaaaatcttttttttttttagggcttaacattttaaatataatactatacatttttaatacaaaaaataaatgtgccacattccaacactattttggtttttaggcaatctgtcacaaggtggctgagggactaaagactgtattaagaacagagaacatgtaactcaaataaaatatgtgctaaaatagatttctaaaaataaggggatggggacga

SEQ ID NO: 134198 - DNA, 1011 bp, Homo sapiens
tttgcatagcagtaaacaggcaaggataaacagcctttagccacagtcctattgttaggttaaaatcttctagcattatggtaccactgatttttcgttttgtttttgttttgagatgaagtcttgatctgtcacccagactggagtgcagtggagcaatctcggctcactgcaacctccacctcccaggttcaagcgattctcttgcctcagcctcccaagtagctgggattacaggtgtgtgccaccatgcctggctaatttttctatttttagtagagacagggttttgccatgttggccaggctagtctcgaactcctgacctcaggtgatccacctgcctcagcctcccaaagtgctgggattacaggcatgagccaccgcacctggcctgatttattttttgattgattgattggttgattgacttattaatgccaaattctccctgatattggggtgtcaaattcaactatgacagagatccagggatcttgcctttaaaaagcatacaacctggtgaaagagaccgacaaataagtaattataatatggaaaatgctatcatacacagctatacatgaggcgatttgggacttcagaaaaggcacatcagcctgaagatgggtgggggacattgttggaggaagggtcaggtcttacaggaacatttgggccatcccaggagcttggcttttattttaaaggcagtgagagacgattagaggattttaagtagcaatgatgagatcaaatctgaaagccactctggtgacattgtggaaagtagattagaaaatttaggagacttagtaagaagtaagggcctgaattaagtataaaggagttgtgaggctgagaaaataaatggattgcagagagatcattaggtggttgaactcacagatgttggtgaccgacctgttaggttggatatgagcacgagaacctggggattggtggaggttagtgggattaagagtcaggagagtctcctggctttctggct

SEQ ID NO: 134199 - DNA, 1011 bp, Homo sapiens; identical to SEQ ID NO: 134198

SEQ ID NO: 134200 - DNA, 1011 bp, Homo sapiens; identical to SEQ ID NO: 134198

SEQ ID NO: 134201 - DNA, 1011 bp, Homo sapiens; identical to SEQ ID NO: 134198

SEQ ID NO: 134202 - DNA, 1846 bp, Homo sapiens
gttttcactgctaataaagacatacccaagactgggcaatttacaaaataaagggtttaattggacttacagttccacgtggctggggaggcctcacaatcatgggggaaggcaaagaggagcaagtcacatcttacctggatggcagccagtaaagagagggcctgtgcagcaaaactccagtttttaaaaccatcagatctcgtgagactcatttactgtcacaagaacagtgcaggaaagacctgcccccataattcaatcacctcccactgggttcctcccacgacacatgggagttgtgggagttactattcaagatgggattggggtagggcacagccaaaccatatcagatagtataaccaaaagtcagttggagaaaatgatatccagggagaactgcagggatgatatatggcctattggttctttttgatactctgattttaatctttggcttaagccaaaccattagagagctgcatatctaggacattgttacagctccttatggaactgtttttatattactgagctttgactattggccattagcctaccatgaaggacattatttaaaaaatcccatgagacttcattatatcattgaatttactgcagctgtgttgttgaggataatgttctttatgttagaaggtgccctctttaaatgaggaccaatgagattaagttcccttaagtttcataacagtaataactgtgcttcttttgaatgacttgtttgattttattttatggagattgtattttgtgtcaactgtcctccctccctccttccttccctccctctcttccttccttccttctccattggtgtttaatatatgcacagagttgtgcaaccatcaccacaatcaattttagtacattttcatctcctcaagaggacacctcataccctttagcttttactcccaaatcccctcatgctctctagctctaggcatccgctaatttattttctatctctatagacttacctattctggatagttcatgtaaattgaactatatagtatggggtctcctgtgtctagctttttttaacttagcgtaatattttccaggttcatccatgtcataacacatatcagtacttcattcctttttgtggctgaatactattccattgtatggatgacaccacatgtttttaatctactcatcatcagttgatgaaaatttaggttctttccactttatggttattatgaaaaatgctgctctgaatgatcatttgcaagtttttgtgtgaacgtgttttaatttcacttgggtaaagcttagtggtagaattgctgggccaaatggtaaccctgtgtttaacattttgaggagctgccagaccgttttccaaagtggctgcaccattttacacaccctacagtacctttgacaacacttgtaattatctgactttttgatttaggctatcgtagtaactgtaaaaactggcatatacggtggctttgatttttatttccatgatggctaatgatgttgagcatcttttcatgtgcttattggctatttgtatatcttctctggagaaatgtcagtacacatcctttgctcttttattttttggctattattgagttgtattagttatttatatattctagatataagtcccttatcagatatatggaacttactttttttttccattttgtggcttgtcttttcactttcttgataatgtccttaagtacaaaagattttaattttgatttagtgctatttatcttttttgttgttgttgttgcttttgatttttggtgtcatatctaagaaactgttgcctaatctaaggtcacaa

SEQ ID NO: 134203 - DNA, 1846 bp, Homo sapiens; identical to SEQ ID NO: 134202

SEQ ID NO: 134204 - DNA, 1846 bp, Homo sapiens; identical to SEQ ID NO: 134202

SEQ ID NO: 134205 - DNA, 1846 bp, Homo sapiens; identical to SEQ ID NO: 134202

SEQ ID NO: 134206 - DNA, 1051 bp, Homo sapiens
tgcccaccactcacctcctgctgtgtggcctggttcctaacaggccatggaccaatatctgtccatggcccgggagttgggggggatccctgttgtacatgataaatatacgtaattttatttgtcaatttttaagcaaatttaatttaaaaagtgaaaaaaaggagtaaatctttgtggctttagattaggcaataatttcttagatatgacaccaaaagcaaaagcaacaataacaaaaaaagatatacattaacaatattcagcaactttaaaattaatgtgatataacttaggtgaaagacgcaccatgtaggcatatcagaaagacagtagggaaacatacaaatgacatttttcccccagatggtaggaaagtgcatgatatcctattcctgtttaaattttattactattttgtattttttaatgtaaaagcttgggagtatcaaaatttgtaattttcataggaatatatatatttttccttttcagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaaggtaggtaatgatgtaagaaatatcaactttaaattagaggcaggcaactgtttatttatagatgctttgaggccaccagtctattaggaaaaatcttatgatcagttccctgaggttttcagtggtctctccctatccttcttctttaggatacgggcagggactaattcccagtcttacaggtatatctgggcgacaagcagagagggaatgagaatagtcaatgagataaaggaatttagggatctgagaactgtatacagtctttgaacactgtattctgggaaaataatgttagtagcaatcttttttttttttttttaagagacagggcctcactctgttgcccaggctggagtgcagtagcaattagagctcattgcagcctcaaattcct

SEQ ID NO: 134207 - DNA, 1048 bp, Homo sapiens
tataaataaaattattcgtcataaattaaatgacttatttggagtgcagtggcataaaatgggtcttttctaaactgagtagaaatacataagtcagactgaactgggcctgagaaaagtcagagtaaatccagcaagttcgtgttgtctttgtgcttcccagtctaatgcttttcttcctgcttacctctttctttaagcttcagttcagaagtctcataagcatcatttctccacttccctgcattattctgggcagagggttgaagcatatcaaatacagatattggcaggccataatggatttgtggcccttctatccaaggtctggatagaagccagaccttcagtagtctcagccatctggagctgagatgataaatctagaaatgataaaaaagaaaaggttctccaagtaacagatatttttcataacacctaggcatgaaagtcagtgcgctttatttcacagaacagatgatctgcccttaggcaagactactgaatataaaattggacggtagatcaaagtagggacataatcatgtaacaaataatgataacagaaagagaagatagggaaaacacatttaacagcatgactggctgtagccatttaatatagactcagaggttaagtaatttgtctgtggtcatccgactagtaagtggaattgtctggatttggattcagtttgattcccattcattctttacactgaaaggttccatgttgagtcatcttgggaaacatgtttgcccagtatgaccattgcatgggagcagggttcaaacttgattttgtagcagtttagggtttttgagcaggggaaggacttggtataaaccatatttttcagagtattaatgagtcatctgaaaaattcattggagtagtgaacatatgaggtagggggaagaccatttaagtcattattagagttaaataggagtgaggtaatgaatgatttggaaggcagaaggaaaattaaggtaaagtaaggggagatgtttgaggcctggagatagtgcctttatttgagacagg

SEQ ID NO: 134208 - DNA, 1048 bp, Homo sapiens; identical to SEQ ID NO: 134207

SEQ ID NO: 134209 - DNA, 1048 bp, Homo sapiens; identical to SEQ ID NO: 134207

SEQ ID NO: 134210 - DNA, 1048 bp, Homo sapiens; identical to SEQ ID NO: 134207

SEQ ID NO: 134211 - DNA, 3114 bp, Homo sapiens
cttgctggcagagattttggaagctagtccaactcctaatttattttttacatataggagaattgaggttgcacagttagttattagcagagcccagaattcgtcttagcccccttactccacattgcatagcacagcatcttgtgtttgcaatctagtgtgcaggcacaagagcagttccaacccagtgagatttgtactgctgttgagaaacgtggtaaaatgagagcagagttaaagaatgtcccttatcctcagtgtggcagttccttatgggcttctgtggtttgccccaggagggtgtggacagcttcttttgagtcattgtctaaaatcagtagacattcctatgtattcatagctgaggttaataagcacacttcttcctgatttctcccttcatctaagctcttcttgtcattttagagctgtcttctcataatgcacagggaaagtacataggccagagtcctttctcctgtcaggggtttcatgttatcagtcactgtgactagggagtttctaggctggaggaagggtgggatatctgtcagggatgcatacatagtagcatagacactggtaatgagttttgcttgtgccagtacctatattacatatctaatcctctcaacttccaggtttgtagaggaggtagcagtctgaattgtgttcatcttcatcttgtcttgcaacagataccatctcatttccctttcatgtaattgcttgcaatgtggctttatgtgcaaaatgtgtattactttggaaacatttgaaatatcctgaacaaaatcatcaaaacaatatttttctctctttctttttttaatgcaacagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactatatggcctctgttttggtgtgtttatttaccaaattttttgatattggtgtttcagtatatttaatatgtgaaattagtagaaaaagcagatttcggttcagaattcccctttactgttacaaatactgattgaaattatctaaaggcaaaagctttacccaacatttggagtttgcttttttgatcatttggcttctaggtttaatattagttacatggtggctttagtgaacttttttaaaaagctttactcttctacccacacagtcttatttgagtcccttagtcagtcagcaagcatgtttggaacagtccccggtgctttgcaagggttcagattgcagaacagtcacatatgggtatttgtagttataaatacttgaccgttctctaggggtggggtttccaactctttaaacaaccctgttgcctgttatcaagctgactttttgctccaagtgccagaattgattgtggttaggacatcttacgctgagaaataaataaaatggaacataatgggtctgcttcaaatgctgataaaatccaccagaatcgcctgtcgagtgttacagaagatgaagaccaagacgctgctcttaccattgtgactgtgctggacaaagtagcctccatcgtggacagtgtgcaggcaagccagaagagaatagaagagagacacagggaaatggaaaatgccataaaatccgtccagattgacctgttgaagctttcacagtcgcatagcaatacagggcatatcattaacaaattgtttgagaaaacccgaaaagttagtgctcacattaaagatgtgaaagcccgggtggagaagcaacaaattcatgttaaaaaagttgaagtcaagcaagaggaaataatgaagaaaaacaaattccgcgtggtaatattccaggtaagcttgcacttgtgttcagcttgcttgttctaatctcttgcatcttttaattgccaaaagtcatatcagaggtttccagtgtcacatcttaactattgtatatattaatacaatggagttctgtattagcagcaatctcaggataaaaccatttctctgttaaccaaagtactatctgtcatttcggtattttgagcttctcaaccatttcatgtaatatgaactgtggctcata

SEQ ID NO: 134212 - DNA, 1692 bp, Homo sapiens
tgctgagaacttttgtgcaaagcagtggactaagtgccaattaagatttacaaaagcaagagcaaagaagtttctgaaaagtttccattgactctgttgattgacataactcttctttaaactttaagatgtttctgtattcacctgtttagtccctgtaacttactgctaattgttcctttctttgatcccttgtagttatttaaagcaactgaagggtgctagtttagggcacatctcttctcttgtaagaaataatgccatgaagattctgcataattaagttgttcagagtagcagcagttcgtcaaaaagtaattgctatcatttataatggaacagctcgtagagaaaagaataatggacatagaactctgattcaaagattcattagatgttagaaagctgtatacatggtcacatggttattcttagcagttaaaattagttataattaatcatcatagttaaggtatataaatggttatattgagattgctccttctgctaaaattaacttgaaaccaagcaattcagccatagtaaaaattacctgctatttcttatacatttattatttcttttcgaacatactatatcttcactaataagcctcagacttttgtatattcagaatttccctagctatattagtttgagagcttgtttggaagttctagcaggggagtgcagctgcttgtatacccttgaccaaagactggtcctcctctatcgtggatggtcatcctcttcgaccaagcgtgcggcttcgagagggacacacatggagcggtgagggaggaaggggacacccacttagcccagccagatcagctgaatcaaccctggcaatcagtgggttaacagatgttgcagccaatcgccctcacatcccatagctatattagtttgatgttcaatccagcccacagtactctgaagcacagtattcattctgttacaaaaatggtctttttacctggagttttatattaaaagatacaattatatttggaagtcaactataattcaacatctacaatcttcagttattataacagtctattcaccattagctcatgatgtcgctgtctcattggagttgcaactaatagatctgcgtaacaagtacttttttctgactctactcctgttttgttttactttaaagcctgattttatattatttgttgtgtacttaaaggagggtatgtgattcctgggctaagctatatctgatttcttcacagcaagattgtgttttttcccctatctaacagtaattaacttttggctctttcgttttctaattataccctctcaggccgtgccaacccacattgtgttgctgaagctactccctgcagcaggtgtcaggaaaggagaggaataatttcgctgcttcaaactgattcatcagagagctatgagacgcccacccctgccttttttagctcctagactctctaatcctatagccaaagaatttaattttaaataagtatccaaagaaataaggttccagggatatcttcttgactatcaggctgataggttttggaatatgcataaatgtgttttgtatatatttatatattttttgattgaatagatttaatctggatctcacgtgggggcacagtttcttttagaaattttaactcgtggttcagttaaaaatctcatgatttt

SEQ ID NO: 134213 - DNA, 2225 bp, Homo sapiens
tacatatttttgagtaaagcttcaattcaaactgtgctaaatgttataaacagaggtatgtatgtgtaaatttgagatagagttagccacttgaggaagttggggacacttgaattgattattgaagaaagatttcatttacaaagccaaaaagaggtgaaagggaacctaagatgtcagaaacttctgggtatggtagcatgtgcctgtagtcccagctacttgggagactgaagcagggggattccttgagtctcgcagttcgagtccagcctgagtaatatagtgagaccccgtctttatgaaaagaagaagataccagaaatcacatatacataggcgtagagggatgaaaacatcttgtgcttgaggaattgagagtgattgtatgtttctgggctggaagagtgggaaagtaggtttagctaaagctgaggagccttctaatcatactgaagaatttgagctcttcgttgagtattggtgagctctccaaagtttaaagcagagaaaagatgtgatcaaagctatgctttagtaatattctcagaaaatacttagttgatgttctggaggtagaaggatcagtgaggaggcattgcgcaagttcaggactgagacgacaagggccggaatcaagacattggtagagggaatgaagaaggaggagggaacagataagttgttaggcagtattatcaacaaagcttggtggctggttggatatggaatgagaaggagaggaaatatttgggattatgattcaggtgtttctatcttatgtggcacctggataggtgttagtgctgagaggtacagggaaagaagtagaaatggagaggatggtggatgggccttgatttttagacttgctaagttcaagatgactgtgtaacctcaaactgtggagcagtctgcccatcattcacacatgtgtcttcatcttaggagagaaggaaagtgaagataaaatacatgtgagtttacttacaattggatctgaaaaatggagtggttaaggttgcccagggtaagcctgggagatgaagaagaggaaagggccaaggtaagagaaaccctaagaaatggtaacatttaaggagcaggcagaggataaacagcccatggagatttacaaggcatggccagaaggtaaaagagctgctctatagtgcaaaggaagcactaatatgctttgttttttctctccttcaggagaagtttcggtgtccgacatccctgtctgttgttaaagacagaaacctaactgagaaccaagaagaggatgatgatgatatctttgatcccccagtagatctgtcttcggatgaagaatattatgttgaagaaagcagatctgccaggcttaggaagtcaggcaaggagcacattgataatatcaagaaggcattttccaaagaaaacatgcagaagacacggcagaatcttgacaagaaagtgaacagaattagaactagaatagtgaccccggagaggagagagaggctaaggcagtcaggagagaggctgagacagtcaggggagaggctgagacagtcaggggagaggtttaagaaatctatttctaatgcagctccctcaaaggaagcttttaagatgcgcagcctcaggaaaggtaaggaccgaacagtggctgaaggtgaggaatgtgccagggagatgggtgtggacatcattgccaggagcgagtctctgggccccatcagtgagctctactctgatgagctcagtgaaccagaacacgaggcagccaggccggtgtatcctccccatgaaggaagggaaatccccacccccgagcctttaaaagttacttttaaatctcaggtgaaagtagaggatgatgaatctcttttgttagatttaaagcactcatcgtaaagaggaattaagtatatcctaaatatgaatctcctaatcatgcagttttagtttgaatagtgtagtcgtctacatttctgtgccatgtaggaaaacataaatgtattttttttcttatatttaaaatcttgaagataatataaatattattatcactctttctcatggcagctgtggattttttagttcctttctcttgtccaccagaaaaatagtttcctaggttgggccagttacgtgtttggtaagggcaactttgcggccgtcatttgcaggagaactctaaatattggttaggattaatattgtggccagcctcaaag

SEQ ID NO: 134214 - DNA, 1088 bp, Homo sapiens
ggctctagtatcatagctttacttataagaaaaccctgggcaagtcatctgcttattctcatcagtaaaaatggagagggttggcctctgctgcctgcctcagaggactgttgtgatgatcaaaggaaatggtacacattctgggggaacaagaagcacacccagagaaaacaagcctcatcagttcctccaaaacagaatggaaagagttacaccttctgaaaaagccctcagcaccaatcaataaggtcctaggttggagagaaactaaagctggtcttcagaagccttttcacagaatcaagagtgaaaaataagtaaatgtttgggtgaccactttttcatcagactaactatatcttgggttttagttgggtctcaaaatgttccccagccagaccctttctaatttccttttgattaagatctttggtggactatagcactaaatttgtttaagcagtatgaggcataaaattgtgactatgtttctaaagtcggccctgatgcattgggtttggaaatgaccacaaatattcctgttttcctgagtgtacccttcagggtccagctgtccaaaacagtgttgataggagttcatcatagctgctttgggaggaagccagattctccttatcttttagctttagatcgtggaatccaggaagtagaacaatgtctattgttgctaaagaaagaaagaaatgggccgggtgtggtggctcacggggagtaatcccagcactttgcgaggccgaggtgggtgaatcacctgaggtcagaagttcacgaccagcctgaccaacatggcgaaaccctgactctactgaaaatacaaaaattagctgggcatggtggcatgcgcctgtcccagctactcaggaggctgagacaggagaattgcctgaacccaggaggcggaggttgcagtgagccgagattgtgccactgcactcaagcctgggcaaaagagccagactctgtttcaaaaaaaaagaaaaaaagaaaagaaagaaatggtagtactgattctgtacttgaaggatgtttaatgtagcatggtgttgtaatagagaagaaatgatgaa

SEQ ID NO: 134215 - DNA, 1093 bp, Homo sapiens
gacaacgatcagctatcccactttttttctcactttcagatcagtttttggataatcatatggtagttaaaataataagtgtacacatatacacacaggcatacataaatcggctttaaaatatttgactcagttactcagatgtttgggtttgggagtctgattcagcatcatttcctcttcaccttgcatgaatacatgaaatcataatatcgttcatgttgttacctttttatattgaaaactaaagtgtatacaacattggataacactttcaaatgaataattttaaaatgtttttatgacattttggaaagatcttgggtgcctaatcacatattttcttaagaaccataataaatttgaatttaagaaaatgttattacaacatttgatgtttgtgtcctataaatatttttactaataatgcaaacagtgaatgtaaagaagttacaagctttttcttttttctagccctatgcagaataaatatcagttgacctgaaatatttttctgcaaacattactgtcatggaatttttgtaaagtcagtttgcttactgattcatatataaccagacttgacattttatggaacatttcacatatagctgtatttgaattttgatgaggaaggagttataacctggtcagctcttcatcatggtagactttgtgcaaccccaaaacactaaacagtttcatgtccctggaggtttattgtaaccttgtactgctttcttggtactaggattttccctccatgttgctctgtttctctacatttcttcccatatttgggacattccaaatgctacattcataatttattattcctttaacttaattttcttggtataaaaataatgggctgcaaagtcacacgtcccgtttgacatcaggaatattctagtcagtgtttgtatttttaaagtttcagataacagggacaaattattttacctattcatgtgtattttagaaattatacataccagattttaaacagtgtattcaaataaaaccattggcaagattccttgctctgagatagaacagtgtagcatctatagacaccagggggcatggagcc

SEQ ID NO: 134216 - DNA, 1063 bp, Homo sapiens
agtccattttctcagctagcagtgaagcctgcaggctggcttacatcctcagccagggagagcagtggggatggagtgccttctctctgtggtcacctccaactcaagtgagcaggtagcaaggagaggggaggttgagaggccagggcctctgggtcagaacatggggtccagtttgaagccacagcctcgtttacacttctcaggcctactatgcagagttaaacagagcccaccgaacctagcttctccatgttgagcatccctaatccaaaaatccgaaaactgaaatgctcctaaatccaaaacttcttgagtgcagacaagacactttaaggaaatgctcaacctgtataatgccagattttaaaatccaaaaaaatacctgaaacacttctcccaaatacttgttcccaagcattcagttacaggatactcagcctgtagtgcttctgaggcctgttgtggacacactgaattgaggtatgtgtatcttcagcggggactaagtgaggaccaagtggaaggtaggcaagttggatattacagatcccagcccagagatgaaggctggataacacatttgttgaagtataggtaagtgcaattgtgagttttcatgcagtttgaaaggagtggataaagatcttttatttgtcaaacttctaaaatattcttctgaacaattgttcttgggctcttatttcaaaaattatattctgccgatcagtctgtgactgtcattacctttgaaagggcaaacagtctctatcctcattctggtttctagcccctgacagaatcactttaagaggaacattacatattgttctaagctgaaatttagaactacaatgagcaccccagtctgaagagtttggctcagtttgttactgtgaatccattgaggtgttactcctggctgaagtttgcttagtattataaggcagccaaggtctcctaataatgtcatgggccaatattcataacttaccagggtctaactaggctttttatctgaacaggctttaaattcttaacaaactctggttatgtaaatatg

SEQ ID NO: 134217 - DNA, 1084 bp, Homo sapiens
gattttttgctgctctgcatatgtccaagaatgattgggaaagtgccttgagtgttattttggggttacaagtaaactgtagcaaataggcaatttcaccaatatggaatccatgaataatgaggattgactgtatatgtatatataatgataaaatatatactatataaatatattttacgtatatttatattttatatataaggtctatataaaatacataatgacctaattgttaatatcttatacatagtgttccgctacttggcaatatattgtatacaggtcaatactcttttacaaaatatattccaaaaagtgtttctcaggccattgttaagtcagtttgggaaatactgagatcaaggaatcctctacgcctgtggcatctaaaaaaaaaccagcgcctcaggttcttatagttatgctttaaaggggacagggtcactcgtgccaaaaaggaagctaaaatcaatatccctcttgcactagcatattttgcctgtgttttgttactttgctttttctaactcttgtagccctttttactgtatctcattggatgaggcacaattggatccctctgacatcattatatacctactcatgtgagagggtattaactattaattttgtaattacaatttttctcttacatggcacagattttacatgtagctttcttctgaaaaggtgcaatgtaaaagttttagtgaagatcttggctctgtcagtgcctcagcatcaattcattcaattttgcattcctacaggcctgttctgggcttccacttcattctcgctctctaggcattcaacaagagcttaatttgacaagaagccacgggttatcctcagttcaaataatttcaaaatctcatatcagatggctcttttggaaatgtcaacaatttctaaaatgtcaacgctacaatataaacaatgctacatacattgttaataggagaagtaatttctaatcccaataaaacagaccccagggaagtttgttgtgatgccgtgtttttcgcttgagatcagtaaagacccagctgcagctggtgcctgtccatggcctgggatt

SEQ ID NO: 134218 - DNA, 1048 bp, Homo sapiens
tcaggagagggtccagagagaaccacttgaaaaagtctggccagtccctggccctgctggttaattcaggcgagtgcacttgttaagcttgtgggctcaagagtcagatcaacaggtttatatcctggatccgccaagtaacacctatgtgaacttgtctttttaaaactcagttatgttatctataaaatgagaataatgatataacacacctcatgtaaagctcttagcaaagttttggaacctagtaaattctccatgatgttagctatacatatgctaatgcaattattttattattagttccatagtgaaaggagactattatcagaatccattctaaaattttatgacttttagtatattagtatatttagtgaactgtatctcattctcattacaaaatgaaggtttaagaattccccacaaatccttttatactctttatagtgttcctaagcagaaaatccttagggtgttattctacattgatatctactacagggggccctgccctgactattggactggccagagtggaaaagtagagtcatataagcagcccccttacagaatgcagacttaacaaagcctgtttttgtctgaatttgttaccagttaacttagtttgtatctttatgtgtccctcatgtgtagtgaggtagcatctgaggatacagtgaggatacagtgacaaagcaagagactgttcccgtttactcattcatcatttattcattgactcatggagtcattaactgattgattcattcatttattcattcaactatggtgactgaccacctgaaatgtaccagtcactccctgcactagtattataatctctgtttttaagaatttcacatccagtagaggtgacagaaaaagcaagcagggaaataaaatatagtggtacttgttacatgtagtgacagtgaagacatctggaaacaatgactagatgaaggtggctcctaactgtaatgacaggtcctgggcaaaaattttgcttgtacagcaaatacttgttgactacctactatgtgcc

SEQ ID NO: 134219 - DNA, 1034 bp, Homo sapiens
actttcaatggcaaaaaccacaattacttttgcaccaacctgataattagaaactgtaaagaggcttgtaatatttaatgaaaagaaccgccaaaaagaaacagaagtacctgcaaagcagaaaggaagcaaaccaaacactcagcagttccaagggaaacaatggatcaccgccaccagggcttcagatacagatatgccataagtattaattgctatgttagaagagaaacagcctaaaaatatgtgaacaaggctgggccctagaggtactaatggcagtggaaacggttgccatgacaacgacaaggaaaagtcaaccaaagggattactaatacatatgagtgtaaatgtgcctgacattgaataatgtgagccaattccttggcagattccagcactatttttgaatctgaaaaaaaaaatgtttcagcatttatcacatgcaggttttattgtgtggattttatggtaaggggtaactaactttttcataagaggtgggcttaatcttaaaaataacttttattataagaataacctaggaacattaaaggatattttcaaaagacaaaagaaattgcttgtcatcctcatcaatacagcagcttgcctttttcttctcttctctatatccaagtgcatttttatataactgtaatcttagtattctgacatttttgcattctgcttttattatttaacctcatatctgtagcattttccgtattttaaattcagcttcataattatcagttaaaatttctgcacagtagtcaattgcattatgtcatttacccaaccattcaccaattagaaggtacatatgtattattgacaaactgtgttataggcaatgcagagagaaaaggtagagtttagattagcattactgaaatgctggctcttaacattacagagagttgagcttgtgtttgggccatcatgcattacaatacacaaatatctgtgagtcggagggtgggaggggtcagcagttcttgattattaggtggtgccaacaattaatagg

SEQ ID NO: 134220 - DNA, 1041 bp, Homo sapiens
gaaagtgtaaaagctgctaggtaatgcacgaggcacttccttgaactgtatacttatttcttttcatttaaaagaaattctaattttgtgaactttgttcttctggaccaagctgaaggtggaagaaatgatgggggctgccccatgcagtcattcagggtctcacggtgaaggtgatatggcatcctcacatgtagtttcacagatcctttatgtgtcaatcagtgtccagctggcgcttaagcagagagtggagaggttgtgagtacccttctagtggtggcacttccacccacatgctattggccaagattcagtcacataactatgcttacatgcaagggagaaggaggagaaaataaaatattttactagaaagccacttctctaattcagctcctcaacacagaatagacattctctggtagaacactagctgtttcttccacactcctcacgtattaagctccatccaccctgacttttaccctgatcctggcatatttacatctcagggcctttgtctatgttgttcctcttctaggaaaatttctgctgcccttaacttgtctggtcatttttcttttcaatcttaaggtttttcttaaacactatccccatcaaagacacctttcttaatcacctgtcaaaagtaagattgtcccaagtaccttgttggttttctttacagcgcttaccataattggccatcatttgatctgtttacttccttttgtttgtttctcccactagagtgtaagctcatgaaactaggtatatgattgtcttttacactattgaattcctaatgcttgtcacagtgcttgacatatagtagatgcttaacaaatattttctaaattaaagcagaaggctctgggttatgagtaaataattgtagtattaaactaaaacaccattaccattaatataaatttatagatctatgattctatagacaggtttgacaaaacacagtcagtgcatcattattaccctgtactgacactttatattaatccaactcattcttgaattatt

SEQ ID NO: 134221 - DNA, 1223 bp, Homo sapiens
taggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcagacatatgatgtaattttaaagggtttacatttttaaaaatttaatgattgctacataaaaagggtatcagttaactaattttacttagatggaacttctgtaagcttagtaggtatgcttaaataaagcctgctaataaaatagagattcagactcaatagaatggttttacatatgtaatatatgttttaaactgcataaaataaactcctccctcctttcttaacgtgtcatttttctgattacaaaagtagcacgttctttttagaaaattgggaaggaaaaaagcaaaaacaagaatgaaaaaacaaaactatcttgccgctcataattacttaacattttggtatatttccaaatgaaaacaattattttcctgtattttacaattactatggcatcatgctccccttcacattataagcatttccccatgtttttaaagacaagaataacaaatttgattaatagcatattattgtataattagatgtca

SEQ ID NO: 134222 - DNA, 1013 bp, Homo sapiens
aatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgt

SEQ ID NO: 134223 - DNA, 1048 bp, Homo sapiens
tttagccttgactttcttttttttttttttttgagacggagtcccgctctgttgcccaggctggagtgctgtggtgcgatctcggctcactgcaagctccgcctcccgggttcaagtgattctcctgccttagcctcccgagtagctgggactaccggcgcccgccaccacgcctggctaattttttgtatttttagtagagacggggtttcaccgtgttaggcaggatggtctcgatcttctgacctcttgatccgcccgcctcggcctcccaaagtgctgggattacagacatgagccaccgcgcccggcccgccttgacttttactctacaatttaattttttttttttttcctcaaagagaaatatggagatggttgtggaattaatggatccaggttaaagggttggccagaaaagttgctagtttttactctattgttttactctattgttgctttgcttacatatattatgtcagtttctgcctttttttctatcaggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggtatgaggaaacagtgccatgaaagtgtgcttgtcttctgtcagttgcaacttgaaactaaaaattcatggaagctttctggagtatggggaagctatttgaaaagaagagggaaataaaacaggctgaaagtaggtaaaatgatgtggtagtcagttctagaggagaggtagattgatagttgttctttgttttcaaggtgtacttatattctttcgagaatctgggaaggtggtgcctgatacaacattaactataggtatttagcagtgggaagatacacatttatttttcattcactgaaaaagtcagtaccagattctaagagacagtttagcaatcattgagagtatggtgaagagtgagagtctgagaccagattgcctgga

SEQ ID NO: 134224 - DNA, 1264 bp, Homo sapiens
ctgattaggtgctgctgatgtgttctcattcaggtttcagttggaacaaggggaataaagggaggactgaggtgttatatttaataatagttcactggagataccaaaacacctttgttggtgaaatagtggggatggcaccctgttttcagtgagcttaagagaatatgaggggagaggaattaggaaaaagagagtagagacaatgctttataaaggagtatcgctgtaaagtagatgactatataatgactgatcatggaatttaagttcagtaaagaaggaggtgagagaagtgaaaggtataggaccaatggattgtagatcctggagaggttaaagaatttttggagtaaggaaactggagagagtgagctggaaaaatagtggtagttgtgaagaatgaggtgtttgaaattgagcttatagaggacatgtaggtacaagtaagactaaatgtgggagttggtggctgaaggaggtagaagacaagatcattggtgaagaggaggtcagtgacttgatgattcaagtataggaaaggttatctgtatgggtattgaaatcattaagaatgatgacaggaaaagtattggagagtgataataaggtaggtgctaagtctttgtgaaatgtgaggaaacgacgtgggcatttacagatgaattcaacagagcatggcggcaggtggtataggctaatggcatgagctgcagaggtaggaggttttagggaggaaggtggggtaatggcctggaagtggcaatggaaaataaggaggatattcatccctctctggcttcaaggggtgtggaagagaaacagccaccactagagaagcctgcagggaaacagtttctcatccaagtttcagttagagcaagaagggaaaggcaatgttcagagaagagtttgaggatatagtttattaatagtgttaataaactggtacagtgggaaaactgttgactactttggcatattaggaatgttttaattaaagtggaaaagagaaaaatgaaacaaaaattggtggtgtaataaacaattgtcactttaaaataatgatttcattaattcctcagaaaagtaagactatttttccacatgctggttctttgcttgttatatcctccaatcccacctcccaccaacccctccctggtttgtcctagggaaggagctggagagagaaaaatattgagagggatgtgaaattactaatggagtgagggttttgtagagacagaagagaacaggatcc

SEQ ID NO: 134225 - DNA, 1584 bp, Homo sapiens
gaagtctttaatgaaggaaggatggtgcttacgagatagaagacagtgttgattggagtcgagggtgatctagctggatggtggccttaaagcagcattactttgtagatgtttatgtgactagaacagcgagatgggttgaggttctggtgtatttgtgtgtattattctttcctcacaccatcatatacctgttgtttatctcttctgcttctacttcttaattacttgtaagattttttaaaagtcaatagctttattcatagaaaataactaatgaataattgtgaccttgttgagtttaacggctcatttttcttatttctttgtggagactaatacgattggtttactgggcaggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcaggtagctaacttgtttatttgttcagatttttatttgaccaatttagttctccttactgttctcttcatttccaaagttgtgtcctttgtttcttcataattgtacctacccttctccagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggcaagtgttcgtgatggattctatcactgcatgctatctgggtttttaaagtagagctctgctttgaggctttccatttgagggaaaaaaaatggattttgttatttccagtttataattttggggggcttctttttttccccctgtgtcctcaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggaggtgaggcaagaccctggaggccgggagtagtggaggaggaataagaattcatttttgcatgctaatttgtagtttgcaagcttacatatttatttttatttatttattatttactttttaagagataaggtttcactgtgtcacccaggctggaacacagtggcaccatcatagcccattgaatcctcgaactcaagcaatctttctgcctcagcttccgaatagctaggactataggcacgtactaccacacctggctaatattttaacctttttgtagagaggaagtcttgctatgttgcccaggctggtctcaaacttggcctcaagagatcctctcttctggcctcccaaagtgttaggattacaggcatgagccactgtgcctggactatatattttaattaaatttttagaaattctaaccttcagtgttactggtaatgtcttc

SEQ ID NO: 134226 - DNA, 1028 bp, Homo sapiens
atatactctattaatgacagttttgtaaatagcagaattaactttattatttaataaacagctctaatatctggatctgtttatcgtgtatgtaggctattgatttatagtgataatactttattttaaataacaactatattatttaattattagttacagaattttgacttgaaaaagttaatttttacttaacttatttttcattatcgctaatgtttttaaaaagagttggtgcaggttttagagttgacagatgatctgtatggttaaaaggattattagaaaatattctatggatgaaagagtatttgaaataaaataattatttgggataattgtgttactcagagttaatgcaaaaatttaaatttgtacagtaaagtatttgtgtagctaggttacatctttagtcatttgtggcataaataccttgctcaaatgcaaaaaaaatgccttgatttcatgttttcaataataatcatggtctagttgtaatatcttaatttccctgcttatcattaagatgtttaacctttcatttctgaaggaaataagttgaatgtaatggaggttgaaccattggatgagcatataagaattgtattattctgtaattttgcttttaagggtaattgggctaagttgtcaacagaattaagcagcttgtagaaggcctgtgaaaatttggtcacgggtttcttttgcttttccattagattatgcatttctgtattttattataaggaaaacagatacttgtttaaaaatatacaagtcagaaatacaaataagtagactacaaaagtttccccattctcatttctcaaaagataaccattctaaacaatgtgttttatgtcctctcagacttttgtacttttgtattaatatcttacatctacttgcatgtccccagctaaactgtgtcttggttcagtagtttggctcactcttctttgtttctctagtttctagcactgcatctggcatctagcagatgtttagtcaatggggaatgaatggat

SEQ ID NO: 134227 - DNA, 1060 bp, Homo sapiens
aaaaaaaatgacactctagatgctaaattaaagtatagttcttcttccccagataatctgatagtggaggaagcagtgcaggagctgaactctttcctcgcacaggagaatatgaggctacaggaattgacagatcttcttcaggaaaagcatcgcaccatgtctcaggaggtacttaaccaaaaaggagagatggctgtgtctagtgggctgtggcagatgttgacttacaattctgagcacctcaaagattaccttactctagaaggcctatcatatcataggggattttgtaaaacacaacacaactccaaacctccaaataatgaattaccctaaatataaaagactgtatagtgttattgaggaatggcgtggtagaaattccacagggaatggggaagtagaaactactgtattgatgatgtcctaggaatttgaggaatgtcaattttcagtctaaacttgggtgcaaataatgccatgattaaaccatgccaagatttggacatttatttatttacacaaaatgatcaagataaagtgatgataggccttaaatgacttttctgatacttctgatgatcattttgatttagttcaaaatatattctactggaatttgccccaccttagtttggccactgaattcttatgctaattagtaatttagtagttgccatttacttagtgcctagaatttaagcactttatgaatgttatctctaatggcaaaacaactcccattttattgccaaagaaacaaattcaaagaggttagtgattattctgagggcacatagctagaaagtgattgagctgtgttgtgactgtaggtctgtttgacttcaaagctcttgttcttcatatgcctttgtttactaaaccccagtgttaaggtccatgctggcctggttgcatgaatatcatctggggaatttattaattcatatggattatcctggaccttcaaaggggttagaatgtagtagcccttataaataaactggagtctagtaagaaaatagaatatttttatcatgttttaagacattgacta

SEQ ID NO: 134228 - DNA, 1146 bp, Homo sapiens
ctataattcattttggttcacagcctggatgtttgttttttaactcaagttgaccagttttgttttcatcttctgagaaggaatcttttatttggtaattctccctatttctcagtgcctcctgatgtgttctgttctttctctccttgtgcctttgcccttaccacggttcctcataacattgttgttcctgtatttaaggccctataaacagggagatgcgccacctcatcagtagcctccagaatcacaatcaccagctgaaaggggaggtcctgagatataagcggaaattgagagaagcccagtctgacctgaacaaggtaaccagagggaatagaataaatatcatttgctattaatgtcgtaaagctgcttttgaatgaggtcggcaatgtggttatcataagagatgtgcatctttcttttctttattctcccagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagtaagaaccacatttagagtaacagtttcgactgaaaagctaagattaagacatcatgcatgaaatgtttggttgatggcatggcttgtctgatcgttttaatgttttagattgtacaattaatttggtttcaagtcgtgttcaagtgcacagccaaaatggcttgcatggctatttagtactttggttcagtgatcgagtatcagcaaaccgatgatggtagccttatttttatgaatccaaattaaggaaaaggatgtcatgattgaggtaatacttctgagaattattgggaattaactactgctcttcactggatttgagcagattgc

SEQ ID NO: 134229 - DNA, 1520 bp, Homo sapiens
aaaataagtgtttaagtgcaacattttctgccttttcaaagaccatctgaagtagagattttaaaactctccataggatggtaaaatatatctgaattactggggttatgagtaggctttccaaagtatgtattccttgtttttcctatgtaattcattgctacagggataatctttttcattacttttgggaggaatgtcttatgctcttaaaattttgaggcctaaaaaaaaggatgggaaccactattctaaagaaagttacctgtgcacttctcaaaagtgttgcttatagaagcatgtcatagtagaatggagtgatgttaaaacagatggtgttatgtaatgttttagtatattatgtaccttgttctataattctgtaaagactcttttggtattatgaaccttctatctttgcacagtattaattgatttttgaaaatgtgttataactttttatttttgtgcaattcctttcctcttatagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggtggactcactttctttatttaattgactttttgagtaaatgttacttgacaataagttattgccagtgaaatttgcttttttattttggtctttttttgattgttaatgtgtatttttcctttttgtgtgtgtgttttaattcttaccttcaagtcttttatctttctgttattttgttttgtgtatttgtgaggcaagaaatttacttttatttaaatggacatttattgaagatctagtctttctctgctgttgttcagacagttattgaagatctagtctttctttgctgacctggaattaagggttatagtgaatataaaatgaaaaataagacataagattttatatacattatgattacaaatatatgaaactaagaaaactatgcttataaatatatatcattatatatttctatgtagtacatatactacacagaaaaactatgcttataaatatgtgatttatatataataaggatataatctattaaccaatataataacattgattaagcagtatgttaactatggctattttggggtcatagaactatagagattgttctcctccttataatgaatatgtatgtatttttaaatgccagggaatttttattaaaattcaataataaagatactgaaaatgcttgaaaaaaccatatatgtattctctgttagtacaccttcattgtttctaagaaatagcaaaataacagtgagatggagtaggtttaatggtaagttgatcatgaagtgccttgaaaagaagaacttcattagatcctatacacattccttttgttaacaagtgtaattttgggctgggcgcggtggctcatgcctgtaatcccagcactttgggaggccgaggtg

SEQ ID NO: 134230 - DNA, 1170 bp, Homo sapiens
cttaaaatgagatagatataaagtaaagctattattagataccagtcttcacctatcagattgttacaaggctttagatgtttgcaactgctggaaatcctgtagatccagtattttaattgtggaaaagcatgagaaaatgtgagaggttatgatggaagtactcttaaccaattgctgcttgatccgtttgtctagattaaggtaaatacaattattgtctaatttaactgacgttgagtacagatcaactaataagtatcagaccaacaattggtgccagtgacttcagataatagagcttctgtatgcctagtgacaaaacacaacttcttaaaactctgtcactaaattaatttatatctaaatgaacagtgggaaaatttagtttcctgtgctcttccattgaagttggaagattcttctaaaatcaaatctcttccttcatcctttaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggtaattaggatgagtagagctttctattctgttgaaatagggtgctttctacatgatgatataagtaaaagaatgattattgtggcacatttttgtgattggaaaaaaatttgaaaactaaatgttcatcattagggtattggtaaataaattatacatctctactgttattcctacaaaagagtacagtgtacttgtcaaatatggatctgctaatatggaaacatgtctgaaataaaatcaagtgacgtgttttgttatcctttttgcgttaaagtatatgtttacttgtgttcctgtgctgtatattttaaaaatttctggaaggctgcatgagaaactgttagaattgttacttctggatattgggatgagttgtgggtgaggttaggaggtatgtgtgattttacttttttttttttttttttaaatttccataggttttggggaacatgtggtgtttggttacatgaataagttctttagtggtgataccaagatt

SEQ ID NO: 134231 - DNA, 1692 bp, Homo sapiens
taaccagagaatggtttattttggaggttggggggaaatgatgctctttttttagtgccttgtgggttttcttcttggttgtgtagtatatgagagccatttggatcataaactttcatggttgttcaaactctgacatcttttctttttaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtttgcatttgtgtttatggtttttctttgaaacttttgtctttattattacaagttgattttatatctgctgttatagaattaaattttcttgcatggaaataatcagcttaggttaagaggttggccttgtttagagtatttagatctttgcttaattgaagcacttttctcccaattcttttattgagtctattctatggagaaattatacctaaaagattaatttatttgactactcagttatctttcatagttcattaggtggggtaagagactataatttgttttttgggggagcatattgctgcctctagctttagggtgagagttcttgcattatgtggtgggttttttttttttttttttgagatggagttttgctcttgtcgcccaggctggagtgcagtggcacaatcttggcttactgccacctccgcctcctggg

SEQ ID NO: 134232 - DNA, 1006 bp, Homo sapiens
agattttgtagggatggtctctctctctcttttttctttctttcattgttaccttggaaatttcttagtgactttgaccaaagtcaggtgtgctctgaggcatgcataactacatggcttggatcttaccttcttacttactatagggatctttttcaaaggtattgagctgtttctgcaattgttttcttacatgaatttccattgcaattccttttcctttttctctgtccagatccgtaggcttccttgttcttcaagggccggaatttgatgcacatagtttaatgtacatgccactagagtgatgactgtgatttgattttgtgaagattctagacaataaataatcatcagtcttctaaacctactaggatggtgatgcttacacttgccggaagcatatgctactctcatctttattcccattgtcatttgctaggatgtggaatgccgttacatattgttctttgaagatttatctgaggactgccagataaacccatgtcccagtggatctgcagaaaagttttgattagtcattattgcagaagtctgcttttctgatgttaagacagatacactgagattagtagaaaaatggtggattatgtgtaggttggattgggtttgcacaataggaaacccatgacatagaaatacttacaaattttctagatcttaaagtttggaaatacttaaaagtggtcctatcagaaagaatgagctttaccttctgggattcctgcccatgtttggtctgttccaaatgttagctattaaggtcttacttatagcctacttcacaattactaaaggacatgaaaaggacaatgtcttaacagtctaatccctaatatctagcagaggcacatagtagtcagtaaagtttttcatgattaaattaattctgcttcatggttctgctgccagatcttccgaagtctgctttactgggccaatgtgtgattcaaaccttattactctttctttttttcacccccta

SEQ ID NO: 134233 - DNA, 1020 bp, Homo sapiens
ctattcggaaagaatgtgtgtgaagaaggcaacaggctagcagattcatgaaggcaaatttgcctgcagctaaaactgcttgggttatcagaaactgcccatatgtctgggactgcagggctgctgctgatttgtaactgtgtttgcatcagttcttggttgggctagaaagcagaaagaaaagatgctgaaatgctatttttatgagacataggtattacagtgttgagttaaatggaccaatgaaggtgcagttacaatatccgcttctctctctgttctgtggagctaggggccaggccgaggcatgggaaagaagcagtaaggcagaaagactaaaaggggattcaaggaagaatagaaaattgtgaggcagtgaccggaatcctgtatggttgtacaaatctctgttactattactagttctgcaaccttgggcaagttacatagtttctctgactcttgtttttttatctgtaaactggaggtctcatttacctacttaagactacatctatagtgcctatcttgtggggttgttaagattaaatgagatcatggtttataataagtacccaatatatgttagttgttacagtattacctgtttataggttgtaaaaaggtcagattgagggtgggcgtggtggctcatgcctgtaatccccacactttgggaggccgaggtgggtggatcacgaggtaaggagatcgataccatcctggccaacatgttgaaactccatctctactaaaatacaaaaaattagccagacatggtggcaggcgcctgtagtcccagttactcgggcgggaggctgaggcaggagaatcacttgaacctgggaggcagaggttgcagtgagccgagatcatgccactgcactccatcctggtgacagagcaagactccgtctcaaaaaaaaaaaaaaaaaaagaaaaaaggtcataagttagggaccatacctatcttcttcactattgtgtctccagcacttggcacgtacatggaagctgttt

SEQ ID NO: 134234 - DNA, 1047 bp, Homo sapiens
aattggttgggggtggaacaatgagtcctgagaagataaatcaagtaattgataaataaggaagtcttgtcctaaatggtgcccaggggtgggggtgaggatgttgaaggagagtcagcagatgtgtgctaaaattattaaaaagcaaaacaaaacaaaacaaaacttctcaaacaggttttctcttcatgcttctcctcctgcctgtgggcagccaaacttccagaatggtgtttctagaaaagtaatttttagaccacctgtgtcagtcacttgggggtgttggttaacagtaggtttctgagctcacctctagacctccacccccaaccccataatctctggagaagggtcttggcaatccgcactctgatgagttctctactagatgactcttatctacattgacatttgagaactgacccatattcctttcccttgctgcctaaacttgatatgctgagaaagtgacacctaagcagaggggaggttacttgtatcagtctttggggggcattagatgaggctggaggatcattagagggaccaaaaccagttcatagctcctcagagatgagtgggtgtgaggatgggggattgacttgattttctatacagatatgcaaagtgcagggcagattcctgaatggtcgaagcttatagtgttcccgggctggaggttttgggatttctatgctaagcgatgggtgactgctgatctgaaaatggcctagtgtgtggtgtgtagaacatttcacccacagtgtcacatattccattataggcaataagggatattccaggtccaacctaaggccacaaccttgctttgcctttttctctcttttcctttataaaaggcacacaccatagtggagatgcttagttacattagaagtagtcttattcattttttagccaaattgcctttctggcccagagcttttgttctgaaagcatggtatgcatttttaatgcctctgctgcctgtcttctgtttccgcttaccacatcccctccccttttcacagtagggtgtaagcatgc

SEQ ID NO: 134235 - DNA, 1114 bp, Homo sapiens
gtacaaaagaatcagtagggttgccttaggcagcaggcagcagagactagccaggaaccagacccaagtgcttctgacatctttagtcaccatgaaatagggaacagtcatccacagcctggtgtggtgagagtgaagagcttcgattttcagatgtcattaatgcatttaatgtttgttatttcctattaataagatgctctttgctagggagtttgtagaaaagtgccaggaaatgaattaggcatgacatgtctgtttcatatttccaatactctgttcctaggaatgctagaaaggagtagggagtggaaatatgccaaaaagacagtaaaacatggaattaattgcctgcggtattcattaattcttacatgtattttgtacataataatagctaatatttattaggcatttcctttcattcagagatgtacatgtatgatcttatttaatctttacaacaactctaggaaataggtactgtttttatctctactttacaaatgaggaacttgaggtgcagagagattaaataagtgacttacacaaagtaacacatatcataagtcttggagacaggatttggatccagagggttgatcctagagtccatgactacacttctaaccatgacagtatattgtgtacactgcattttagtgtccatatacattttttattttatgttttatttccctctatttatactgattcttttgataaattgccctgatttgatctgaataattatacagttagatctctaaagattattttacaaatataaagacagttgccattggccccttcttacctcttttccacacgtttggtcttgaaatgctgctgcttttcctctataaatgatgtatttattgctctgtgtaatctctgatggagaaaacagattcacaggtagaaattatgagaaacacataggtcagggaacaaagaaccacttgagatgtaacagtatatgtagtcgttacaaaccttggcctctttaaacaaattccagaaatgcctaaaaatagatcaacattcagcctcaaatctcaacagaacaaaaattctaattagaggttattattccacctggagaaacaaaaaa

SEQ ID NO: 134236 - DNA, 1050 bp, Homo sapiens
gacaattatgtacttagaataatggaactaacttgtaataattaaaacattgaagttattatctatgctttctggtgtttgatagatatgttgtccagaaaaagaagtaaatttgcattgttttcttgagaaaacactagtttctgaccctgtgtgatccactgttggctccaaatatagtaataggactcatctctttaagagtattctagatcagtttgaaatacagtagacactcaaaaaacaaatgttaaattactgaatgtttcaaattataatgtatattaattttatttagaatgtggcaaatatatacattaattacttacattttcttttacattttgttttctgtattcaaaaaggaaatagatatcttgtgcagtatcgcatatgcatcttttggtatgacccacactataaaaccactgggaaatagctttaaaggagttttagtagcagaacttggcatttggggatcatattttgtgtttaataagatgaacacaagccaagatttcaggcaaacaatgagtaagaaatttcccttcattttggaagtttattacaaatccattgagcagtctagagtgtgtggaatcggagggcaaggatcaagaaaaatggttgaacagcaaaacttacgaatctggctactgatccaagtttacccttaagggaaatgccacagtatcaagcaagagtaaaattacaaagttgactacaatgggttttgaaatatttaaggcaaaatgtaaattttaattcagaggtctaattttttggattgtgaatacattgactgcatgtatgtttattatgttgtaactgaagttttgtttatactgtcaaaaataaagaggttctaaaaaaacaaacaaaggaaatataaaatattatattactcagtttaaaagttctagaataggctccattttagaataaaccagaatcaacaggatttcagaaagattattaagtatatttttgtttctagagacttagagattgctgatcaatagaatttctgttgctatcctttccctagac

SEQ ID NO: 134237 - DNA, 1044 bp, Homo sapiens
aatcattccctcctcacttccttctctctctgactttaatacagtggacaaatacgggcacatgtaatgcttagggatggttgaacaaattcctatgcaaaagtcattcacagaagacaagttttcctatgaatttcaacacaaaagcatacaaaatatactaattttactaaatactttgtcatacactggcaacctctttaacatctagagactagactagatgctgcaaaattaggactcacctgtccattatatacactatatacagagcaaaacaaaatgcacaaaagatacagaaaaatggtgtctgaaaaagtccaactatgaacatactagcgtattaccttttgcaatttcttccctcctacctcttctaaaccattgaacaagtatagacagcactatacttctcacaaaggtggcttcacaattcaatttccaaaagacagtatttcctatgaatttcagcaaaaagatatttacaaaatggtattttactacctctacatttaacattcatcaggcacttctaaacatctagatagactagatgtttcaagtaaggagttaatttgtccactttgtacaaagcagtcttgaataaaccgcaaacatgtaacaacagttataatttgaaagaatcttccaaatatgaacgttctggcctagaacccttcctatctccaacaacccagtgggcaagaatgctcaaattttcagaggacaatctttcctaggacttgtaaaacaaaatgtacaaaatatattagtttactaactttacttttgtcagacactggcaacctccttagcatctagaaagactagatgttgtaaattagggctcatttgtcctttatgtacactacatacacagataagtaaaacaaaatgcacagaaatagatgattcatcttgccccgctgtaggcagggtggcatagagctctctgcactttcccctcttccctcctcccctgaaccagcgcacaaacacaatgagtattactcaacaggtgatttggccattccccaccaaagc

SEQ ID NO: 134238 - DNA, 1048 bp, Homo sapiens
gccaacctaacgaacaagtcctgacatatactgctcagaggtggttaaacaattccatgtccaagacgcatcttttctatcaattataacaaaggtatttacaaattggctaattcactagctctagtttttatcatatattgtcactccagacatccataaagtttagatattgcaaaataatgaatttgtccacaataaacacagggaatttactaaaaatgctcatatagacctgtggttaacatctaaaaccatcttctagatatggagatactagcaaagagcccttcccttcacccttcctcttctcccttttccaccatccccagtggctaagtataggacgtctagctcctagggacctaataaaggtcactcccagaagacggaccttcctaaaaactaacaaaaggacatttataaagggattgttttactacatctagttttaacatactttgagcattaggagttgtttatcctttaatatacaatattaattaaaatacacatatagaacaatggtcagaccatctgaactaatctaactcatgggctcagaacccttctccctgcatacttcctcctccctaacccatcgccacccaatgaatagtcagcatatgctcctaagcatcaagtttaaaaattccattcccaaatgcaaccactcctaggaagtaatgaaaacaaatactgagaggggtgttactttagccctttacttttaatctatgttgtgcactttcaaacacctaaaaagactagatgtttcaaattggactaaagttttcctttatatacacaatagcactgaataaatggtgcatatacataacacagactctaatttgagtgtcttctaaataggaacattctggcccagaacccttccctttccgacctctaccaaccccagagacagctttaagccatctgtaatgcttaagggggattttaacaatttcacttctgtgtttttaagacgtcttccctatgaattttaacacaaagtgtactcaatgtattagtttactaactctac

SEQ ID NO: 134239 - DNA, 2724 bp, Homo sapiens
gctaccattatcgagactctcattctattgccctgcggctttaatccttcgagtgtaggggaaaaattgaaccctaaagacaggcagctcctaggcaccagcacaggaaataagcaatggaggtggggtcctttgctcgcgccgaaattcaaaggaataaatagttccggcgcgggtgttgagagcggtgtggcaggtgttgtagccgctatggtgaagttcgctttgtagcggccccggctagagagttgttctgttccctgcctttgtgacccggaggagcttttggggtgcgtcaagcccctggcctgaggcagcggtgaggcgtgtgcgtgagcacggccggttgggccgggccagacttcctggcgggaggcgggaggcgggaggcggggcgcggggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaagtaatgaccgtctaatatcagctttaagtaccatgaaggaaaaagaaagccgagtgaaggattgtggagaggtgacatagggaggtcagggaggactccagtaaggtgacatttgagcaaagacgtgagtgcagtagagagtaagctatgtcagtatcagagaaaagcacattataggcaaagataatgggatatgtaataatccatagtctttgtttaggtagagtatgataaaagtagaaggcaagcctggaaaaacgggtagaagaaatagttaagacttcccagttgaatggtttaatttccagatagtggctaactctggtatatttttgagtagatgaacgatgtctttacatcagacaagatagtttgtcaagtggctgttttatttctatcaccctatcgttgctgtttttgcctcgtgttcattatgattccaggtttacattccacttaggtggtggtatttctgtttcgtacagaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggtaaagtgtaaactttctgatttatttgaatttaagttggcaggagaatcctcactgaactttggagacgtcccgatattctcttcatttgtgtttttatactttttgtaaattacacctcactgcaaccttttaaggaaagtaatattactcctttagatgagaaaatagaaacttagagatgtttagaagtaacagtgcctcaaaactcaggcattctgactgtaaagcagtctcattccagagtattttcaaccctgtgtaatgatgccttttcaaatcctattaatggattgaatgactagtgaaaatctttgggacagtatttccttatatcttgcaaagtaactttttattaaaaaatgaataggaaacaattcaattcagggttgaaaaggttctgtagagaaaagtgtccattgcaggttgttgcctattttccttgtttttcttgccagaggatgcagctgcctaaccttgtctacttaatggacactacgttggtgggttttccaacagcaagggacccatttttagtgctgctttgtacggtagggagttttgtaattgttacacttttcatattttattttaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtgagtggcaattaaacctttgggtatcttaagaccttttatgtctgatgtggtttttggccctatgcctttgcaaaacgtgctagagaaagttcatgagcaaaattggtgccttaaattctgactagattccttaatgtcttccttatattaaaatcttgatcatgcacattctatcactaagaggattgaaagacagctgaaaagttgttcatccagtataagcactcagctatgctgaaatcttaaaccatatttgaatcttctttggttgttcttgaacacctgtgtacttgagatctttcaatcttctgagataacccattctgtttttggacaggtcttattagaaagttaacagctataagttttgtcagagtctgctgtcttcaaattttattcattaatcctagtcctcttgagagcaccaagagcaaatctaacttattccctacttcagtgtttaagtgatgtgcaagtatatgtgttttagttctaagtgaaatcttgccaggtctttcacttgatgtttgttcctagttccttcacttgcctgattataccaagtatgctccagtttccctc

SEQ ID NO: 134240 - DNA, 1050 bp, Homo sapiens
tttattttcagggccgaattacaaaagtattgaatatgaaacctccagaggtaagagtactatttatggacattaaaaatagttggtatagatattactttaatctttcagacaatttttaaatattctattaaaatttttggagacattatttgggaatgattagtaaagacagttgtatatttgtgtaatatttggcactatgcccaaatattaaaattgattttgattgtataaaggagtcttgcttagctggtgtttcatgtcagaattcattcctacagaaaaagcctacaggaaaaggtttgtgtgaaattactatatttaacctatatggttcatttgggccaacttttggtaagatgtttagtgaggtcaaggcaaaaatgatatatttaatgtaaattccagttggacacattgtcttggatactaaacattaataaaattgtcattccagattttatccatgatagaagaagcagctggaaccaggatgtatgaatacaaaaaaatagctgcacagaaaactatagaaaaaaaggaggctaagctgaaagaaattaagacggtaatttaattcatataaaatattttcggagaagaatgtaattttgcatgtagagtttttgctgtaaagagggaaaaatttttttccttggttcagttttccatagtcatccctgctacttctctttcaaataaattttaatgatactttacatgcgaaaatactgatttttctttattttccagatacttgaagaagagattactccaaccattcaaaaattaaaagaggtatattctgtatatgtgaggataatctattagaatgtctttcaaagtcagcaatgtatccaaaatcatacacatagtgatactatttcttgggggtttttttcctgcgatgagataaggaattagagttggcactccataactcagcgttctgcttacagaggatatgcacttatctgctaagtcataggatattggagagtaatttttatagtttcagaaaatggtatgccgaattttaatacttta

SEQ ID NO: 134241 - DNA, 1021 bp, Homo sapiens
ctgtatttttgcctggattcaatattcatatagttaagtacctaatcaacatcactactcaagatgtctaacaggctcctcaagcctattatattcatactgtatttcttaagcttatcaaacccgttcttcctattctccacttacttcagtggctatccaacttaaaatcccaaattgtactctttttcccctacactcctaatccccttccctgctttttctccacatcagttatcactctataacatgttacatgttttatttattttctttattatcatttcccccaatggaatgaaggtccacaaggcaaggatttttgaccatttggtccagttgtaaccacagcccaaacaactgtacttagcttatagaagacactcactaaatattcatggaatagataaatgtacactaatgagactatatacttgtctacaagtggcactagtggcacattaagctcacttacctcaaccatatttttttccagctctttgcgtttgctttcctcacatgccagatttttcttcttgagatcaaatgcgctttgagatttagtattaactcgctgagcctctgcaagagcatcttctaaagatcgaagtatacctccagtttcctataacaaaatgcagtcaattcaatcacttatgtaaaatttgttcacgctgtcattttattgtatgagttctgtatcaaacacttttttataagttatttcattatcttactataagattaacaaatcaatacggaagacaatgcccaatgaatcctaaatagttactatatataatttagtacgtttttcacagagtatattatcgattcttatacatatgttcagaccttatcttttcttttttccaattcttctatttcatgattaagtgcttttatttttttatcattctcagacaattcttcctgaagctttataactttatcttgcatttcttttaattcctcagctgagcgtactttggtatcttcagccagcaaaaactgataagca

SEQ ID NO: 134242 - DNA, 1001 bp, Homo sapiens
tactttttctgaaactatttaatgctcaaattttatggctcttgacagtttataaaatattttcatatacatgctcttaattctaaaatctctacttttaagctagtgtaggatgtctgttatttcagttttacagctttagaaattcatttttagtcccttcaagtgatttgtttaaatctgcaattattatttagcccaatgtctcatggatttaatttataacatggaatgaaccagtagtataagagttatatttattctaaaaactgagagtgaatttcaaaatgataattcagtatttataaagttatgatggttaaattattttattatgctcactccaaattgctatggaattttattacataagggtatgcgtataagaaagtgggtgtttttcctgaaatataatatttttccatttgaaactcttcctaaaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggtaaatagagacattagcactatgtgattgcttttttttccaagaagtttcttttcatgttatgctttggcaattgttacataatgttgaaaataatcagtctcaaggaacttgtttgtttactttattctgcaactctaatgcctaatgcagcgaaattcaaatatgttgattgctaaatattggtgatgttaatttgtgaagatgctgtactacataaattatcttaattcggtatgtaagtgcaataaatgctttgttctgtttgcagcattgtgtggaattttcgagattaatgcatttattcttgtctctttttggcta

SEQ ID NO: 134243 - DNA, 2393 bp, Homo sapiens
taatcttacgtcttattgctcaattcagtttctttactgttattagatagcactcacaaatatatacacatacaaatatgaacaactaagcggaaaggaaaagaacgagagttgtgatttctagcgttctttttttaattaccagctactgacagttattcgatataatccttcaatttgaatatgtcatattttattaaaaatacggacttaaatttcaaattcttttacatattaatcatatattagtttatactttgagtagttttttgaggagaaaatactgggaaatgactaatttgttgaaatactaatccaagagaccaaacaattaaactttgaaggttaaggtctcttagtaaaaccaatctgaatcttcggccatttaattactagcactgtctgcctcatacatcctatggtctgttgcatttttctgccacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaaggtttgcctttaaaaacatgataatcagatcatgaggaggtagtgatttttgataaaaagctaatttaaataaagaacgcaagcaagtaggaaacatttcttagcctattaacaagcattagtataagaagtgttgtaaatatcgtcaaaaaatacctaattataaaacaactcttgaatttttgagaactcagtattgagaatttcctgcttcaatcatttgaaagctcaaaaatgtcatttgtgtatttctacattaggcattcagtttgtatgttattttttggaatgaaaattgtgttatttgccgttggaaataatgtctgtttgacagtggatagaaataggaaggttcagcatgcttttttaatacttacagaaatttgtattttttgcatgctttggaaatagtggttgctaatattttccttaaaacagtagagtgagcttttaaaacttggttttaatttattatgatttatccttcagaaaataaagaggaaagccttttggaaaagcgcaggcagctgtctcgtgatattggtagattgaaagaaacatatgaagctctattagccagatttcccaatcttcgatttgcatacaagtaagagacttaagccttgaattttaacatagtaataatcaagacatttttatttaagctggaagcagtgtgaaaattttgtcgaaaccaagatttttgtatgaaacttgttgtaagctgcttttctttcattggtatttttcctttaaacatttgttgaaatgttttaaatgttggcagggaaattcttgtgaaatttaatggctaatgatgccactaatcttaaaatgagggaaatttaatctcagttcaaaatgtcttcagagttactgtatcattaatgttaaatatccacatttacatcttataatttgttttgctatgtgggttttttatggaatatttacagtaatcatatgtattatagggattagaacatcagagttgttcttactacattgaaacatactgaaagatctattgtgatttaaaaacaacagctggctagtcatttgggacattttaaaatttttggtttgttaaaaccattttgctgattctactttcatttcactttaatgtgttgtccaaaagagctcctgatgagtaaagtataactttttctactttattatctaagattaatttttgtcaacttttgtatttcagggatccagagaagaactggaatagaaattgtgtgaaaggacttgtggcttctctgattagtgtgaaagacacttctgcaaccacagctttagaattagtggctggagaacgactctacaatgttgtagtagacacagaagtaagttgattttaattttaaaaaatttaaaatttggttagcttgaaaagtcatgtgctgctaaaagaattaaatactttgatgttttaaggctctcccctaaggtgacttatttatagggtaaaactatttggttcataactttttgataactattccaaaggaggtctcatgcttactcagaaactcagaatgcatattaccaatcttaaacttttgggatctctttgctgtataagttgaatttaatttgtaaaataatctgggaataaatgacctgtttttgatgtcagtcttcccatcaaggtaacattgaatttatttacatttcttcagttctcacttattatccttctgtagaatgctcatattctttcctgtaaatgctacgtagtcattgtcaaatttacttccttgttttttttttaatttat

SEQ ID NO: 134244 - DNA, 3042 bp, Homo sapiens
caaatatgtaccctttgacctatgacctacttctacccattttctttcactcctcatccctgataaccactatcctactctttttatttgttcagcttttttttttaaaagattccatgtacaagtgaggtcatacagttttttattttttcttcgtctgattatgtcacttagcatcatgtcctctgggtttattcatgttgtcccaaatggcagcatctcctttttcaagttcaaatgatgttccattgcatatgtaattataacttgattgggataaatggcactaaacattcatttattatagactactaaacttgcattctctcaattttctgtcatttttaacatgcgttttttaaattcaaatgtgtgttgtaggttactggtaaaaagctactagaaaggggggaactgaaacgtcgatacactataattccactcaataaaatttcagccagatgtattgcaccagaaactctgagagttgctcagaatcttgtaagtctcattttgtcttatttatatgtttaatcgtcatctgtggtttttttaagttagaagacattaattttgagggacataatcatatgcagaaccacaaaattaaaatacaaaaaaattgggttggcttgtgcaattagatgataagagaatagagatgttggaagacttgaactccttttgatgcttcactttgtggtattagaatgtcctttttaaccttaagtcacatgactatcaatcaggtgatggtgaaaattacactcttgattcctgaatggttagaactgagcttctagatacgtaccccaaattcttcaagtttttgtttttgtttctttttatgtcaggcatactaaaactgcccacagtcacagccattatggaaggccttcattagtattgcagtgatgcttctttattagagttcttctagattgctattcagcctgtgcaggtacatagcaggtgaccaggatcccattcaactgctgacgttgatctaaagtgacatgcttgctagtaagaaaatagattagtacaaggaaatacatttaaaagttattgtagttgtgtaatactgtaaaaacatgaagtcagtcataacattcagctgtaatatcagtttttttattgatcagacattccaagtacatcagttgaaaagacatttctatgaaacttaaaaatatacttgtaactaagtggatgttgttgtatccttagttacattcagaagatttcaatgcaaatgatttcaaaatacagttgtgttgatatgtatactatcaggagagggaggatgagtgctgagtaattgaaaggtgatgtttttggttggtactttctttacttgaaaactcaccattaagtcaagaaggctcaggaagttaattcagccatacatcgagtcccagcattagaaggaaattgggatttcaagtaacagcaaaaatactttgcctcaaatcctttagccaaacctatttgatggtagctgccacatcaaagaacaatactgaacatgtgttacatagagcttccttcattgtgactgccactgctgatactaagctctaaaagagatgcttagtttttcttaaatgatgggcagaggtagcctctataaacaaaggctgagaagaagcattgtgatcaaaatagaggactggggattttttaaattacttttactctcagttattgtgttttcatttctgtaactggcagacgactgctctagcatgtttcatttgtatgagaaaatatttgttgtgaaatcaaattcctgattattgaaacaacattttcatatagttgtgttgatctggaaattataggttaagcactccaagtccaacaactgaaattttccaaaattcaaaactatgacacccaaaaaatgctcattggagtattttggatttagaaagttcaaccactgtaatacaaatataccaaaatctgaaaacaaacacttctgttctaagcatttaggataaaggatactcaatctgtactataattaaagttgtgtccagtcaacgttggtgaaggacacttagaaacatggtaatggctccttattgatagaaactttcataatgctccatactagctattaataaatattttacttagcaataaatctttcagtatttaaacctgcagtttttttttcctgaaactttgagttttacatagctttttagaaaattcagaaagagttttaatgctaggtaagtattatttaagtttctattacagcagtttttactggtttataaaatcatatctgaaaggaaaagtagtagtatgtactgtggcatatctgttgttgtcccacaggttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtaagttttatatccttttctcctcacaattctttgtggtaaataggaagatgccttttttaagtacatttttagcccaactacccacttcttcaggaaacatgttaacttctcatttgtgtgtttgccagtgccacctacctcctgtcaaaagtaaaacaaaaaattaaacctgcccttgaaatggtaccttaatgccttaaaggaattcttagacagtgatcatattcttcttggtctagtatttgccacactgagtttgcagatctttgtcaagacaatagaataacaaacactgaataatatttactgtataccagacagtgttctacactatgctgtccaatacagtagccactagccatatgtgactttttacatttaattaagttaaaagtaatttccttggttgcattagtcacatttcaagagcccataatcacaaatggttaatggataattcgacaatgcagatatagaacatg

SEQ ID NO: 134245 - DNA, 2908 bp, Homo sapiens
taaatacctttcaaaagaaatgactaagcagccagaacagggatagaattacaaagttttcaagaaagtgcattttaaacaactaagttcaaaactatttttcttacactaaaagtagggaacattattattatttttaacatttgaaaatgaggttaataaatagataactacatttttgaaattttatgtaattgttataattaatcatttttcgtggtgagtagttggtttgatttttttttctttttagttagcaagagggattatttttaaggaaacctagctgttaaatatttctaatgtaaatagttgttacagattttagtcatttagagttgttcaccttcaatgaccagatctaaatttgaattaattggtgcctcagaaacttgaaagccgtcaaaattattcctgtaaccagtagcatcttatattgtttataacgtatgtgagtttatttaaggtaagaatctgaagtttgaatgtatttctcaaataccagaaaaatgacagtcatttcttacatgtttctgtttttgtaaggtatcgccaactaaaacagcagtgggagatgaaaactgaagaggcagatttattacaaaccaagctccagcaaagctcatatcacaagcaacaagaagaattagatgcccttaaaaaaaccattggtaagatgaaaacagtccatgcttaatctctggttttattcatatccgttaccttactttaggtatcttctctacctgtgctatgtttaagatatatatgataaagtttatttagggaaaatccaagtatgggatttctaggtcttagggtatggtcattttcatctttattgtatatcgtcaaaggtctgttcgtttttaccaatactcatttccaccagcagcatatgaacatttctccaagttcttttttctccagacttttaaaattttccaaatctgttggttgtgaaaagatagcatgcattagcatttaatttgcatttccctaattgctgatgaaatttgggatctttttttgtatgttcattggacctttgggtttatacttgtgtgaattttctgtttatttcttttgcccatgggttgctcatggtttttttcccactgttctcatgcttaagagtcctaatttcctgtaggttatgtgcattgcaaatatccttttaccatcttttttggctatgtactggtcttttaattttgtgttcatagtatttttgttttacaaaagtttttaatatttagtgtaattcactttatagccatttccctaattttaagatagcttatatgttttccttagaatttaattgtatatggtagtttaaatttttgtcattcattaggacaatatccacacatgtgcttctccactaatattttaatagtattttctgcagtgaaaagtagtgtaagaaattgtgcggtaatgacttccaaggttatgtttgcacctgggtcctaacactcacaatatacatcagttgttacagcaacacgtgttcattcagtattgcccttttatttatttttttgagacggagtctctctctgtccccaggctggagtgcagtggcgcaatctcagctcactgcaacctccacctcctgggttcaggtgccttcctcagcctcccgagtagctgggactacaggcgtgcatcaccacacccagctaatttttgtatttttagtagagatgaggttttatcatgttggtcaggatggtcttgatctcttgacctcatgatctgcctgccttggcttcccaaagtgctgggattacacaggcatgaactaccacgcctgaccttatttttttctttcacagatttggggatgtttttcctttgctgtatcccaggcatactgtcatattatttgtcgactttaatgagaagttccctgaatatgtataaaataggcaaagaacataaagtaagcttgtttatgaaattacacactttctagcaactatagaaaaaataccatagttatactgttctggttttaggaagcatacaattgcattaaaaatatgatctgtgatttttttttttttaataggttgcttcaatacctttgtaaaaggatagttgtaggtaaagttcaatttcatagcaaaagaaattattttgttacagatctttagataattcaagtatggcttttgggtaggatctgtgtttcattataccatttctagaatatcattgggatagttaattttcttaaattgtaccctgtaattttccaaaccatttcttctattaaaagttgaatttgtcaacctttaccattgttaacttagccacatttgcttactttgtgatgcagaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggtaataacttctttttgaaattgaaccaaccttttaaagtcaacatagagctgaaggtggtagagcatcattggttgaccttattcatcagaattgatctcagaatctaaaagggagcagtgttctttggaaacaaattatgcttcttacaagtcaaaggagtatccaggatgagcatctcaaatccaaaatacaaattagaaactttttgagtgttgatctgaggctcaaaggaaatgttcattggagcagattggatttgggatactcagttactctgtataatgcaaatattccaaaatccaaaaaaaaaatctgaagtctggaagacttctggtcctacacactttggataagggatatt

SEQ ID NO: 134246 - DNA, 1009 bp, Homo sapiens
gaatattgagaaactttttacacattgaacaattttgtttttaaaaaagctttacttccagtaattcatctgttacgtagaatgttatattattttccctataggaataaaggataaagaaaataatttatgcagagttctttgaacctataaaaattacacatacttttttttttgatataggaaaataaacttccttttctggggaagcagcttaacctgtactttcggtagctgagtggtaacaaagctgtgggtcttacttgcatgagattattatttatttaattgttctgtacatatttgtttttcagtagttaataacctatatgaatacctgaatactgtattttttataggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggtaggatttatttatcaaattcgagaaattgaaaatgcgaatctttttatgaaacattagcttaagatgtttgactttagtgttctcagtcttttcactcgtcatcatgagagaatgaggcacaaatagcttttactcatccagaattgccagttttgggatcacataggtcagtcagcttctagcagtccctcttcttcctcacttagttgattccatctacattacatctaacaaaaaacgctctcatttgcagcatgagcgtgcagcatgagcattgtacctcccaccccttttaccagggatgatccaagttttcttctgtgtataaattgattagtccttttaatggtgatataaaatatagagggttaggtgatcatctctctgcctgtaatcacattgccctcttgcccagggatctgtcagataattgtttagtaaattaaaattatttacatgttacctcaccacatattttctttaatttttttgttttaggagtc

SEQ ID NO: 134247 - DNA, 1057 bp, Homo sapiens
gttggcagatcacctgaggtcgggagttccagatcagcctgaccaacatggagaaaccccgtctctactaaaaatacaaaattagctgggcgtggtggtacatacctgtgatcccagttactcaggaggctgaggcagcagaatcacttgaacctgggaggtgtaagttgcggtcagccaagatcgcgccattgcactccagcttgggcaacaagagtgaaactccatctcaaaaaaaaaaaaaaaattagtcattgaaggttttttcctcttcagtatttgattcaaaagtattaaatagttaagaaactggcttatacatattggtttgtaaacattcatagatctcccatctatttttatatgtggctaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgagtaagtcaatttcttatgaatatctggccgcattagaacatgactagcattgacagctctgtatgacctctgatgcaattattagagttaaccttttgcagatgtccttgatacttttctttctgctttcctttttctcttttcgtcatttttttcttattactcttatgcatcattagttgtttttacattctattacacctggaatgactttttcactggcttttgttctttgtcaaacataattcctcacatttctatcatttcatttctttcacttgcattgaaaagccttgaataggatatacttctgtcatcctcttgactctactgtatactgaaactatataagtaatgactaaagccattatacacataaatactgtttcactgatctgtaaattctgcagcctcttctcagttttaatgctctcaattactcaataatgttattcttccctaacctgacaaaactttgagtct

SEQ ID NO: 134248 - DNA, 1050 bp, Homo sapiens
tatcatggtgaaggatcaaaattttgttcatgtcactgctaaggctgaccttaagaggagagctttcagggctccttttacttaagtttatatgtaacactttttttttttttttttgccttggctgctaaggagataagggaatattagtggagtcaaaatattttaaggactttgtcttataaattcttagttctagtaatttagttatatacatatggatgattttattcctaattttgttaagagtgtgtatatgagtgtgtatatacacacacatcatacagtatatgtatagtatatgagtatatataattcttagtgcattatatctttttggtaaatagcaatgtatgtattgtatataaaaataatgaaaactgtttatttctgaccaaattccagaatatagaagagattttatattttcccagttaaccatgttttttatctcatagtacaatgacttgatgaagaagaagagaattgtagaaaatgacaaatccaaaattcttacaactatagaagaccttgaccagaagaaaaaccaagccctaaatattgcatggcaaaaggtactttttatgtttgttttatatgaggttgcaaggatgaaaaaatatcatcagtggagttatactctataagaaatttgaaatagctgatctatgtttgaatgaggcacatattcacaccttaattaaaacctctgacttttaaatgcatttttttctttttgaacttgactactaccagatcctggcattcttgtacttctgtaagaattggatagtaaacaagccaagtttagtattctcttttacaggatgcttattcaacaaaatcccaattccattttgttttatgacaactttggcagatcttaggcttctttactgttacttctacttccctgacttcatgtatctgtctcctataggataattccttagcctctcatgtggaagtttttccatttttactatagcggaagattcttacttcagagattccaaacatagagttactgtgctgtttggtagtttagca

SEQ ID NO: 134249 - DNA, 1168 bp, Homo sapiens
cctcacattgatctacttaggcctttggacaacaggaaaaagaaaagttttagaggataacattttattccaaaaatacttgtgtttttttgtttgcttctctattttgtgttttttttcctcatgtgatacaattgtgtgtatcttgaggattcctgcagtgtgttctacaaaagtgtcaaaactttggactagagttagaggtgtgccttctagttcccctggaaattagagcaggattcagtaattcatttttgtaaagggccatatagtaaatattttttgcttgggagcccatccagtctctgttgcaactacctgattttgtcttatcactagcaccgatagacgctttgtaaatgaatgagcatatccagatttttcacatgggccatagtttgtcagcccctgagttagagtaatagacaaagtagacctgctgtgttgcatatacatatatcaacaattgattcttcttggaaagcatcctgatgttttaacttttttattttttaaatccaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtgaggaatcactttgctatattataattttcattcctctttattataattcatctccttaccttaaaactgtatttgtgttttaactacctttgcatgtagaatttaaggagtctaatatataagactaaacaatttggttaaaacatttgattaaaataggtgacaaaggaggaataagcaaatagaaaattagacaaaacatgtttttaaaaaatctattttcaaatattagaaaatgaatagtccaggacaagatgaaacagaaatgctgagccctatgttcaccctggctttctctctagaggcagtttttggacttcagttgcctaaacagaggtcagtagtatcactaagttaaaaagacagattagaattttgcaaagccctagagtgctgcaccttggcattaggtctctactgtccctgaagtgaagcctaatgtagacacatcctaagaaactgaacaaattttttgaaggaac

SEQ ID NO: 134250 - DNA, 1380 bp, Homo sapiens
ttaagtaattatacatattttatattaaaataaggctttttatgaattatatatttgtaaagaaaaaatataataataattatgattcttcataccagattagaatgagctgcagtaagctaaaagagaactgaaaatagtgctgtggaacctgagattaggtgtaactatgaattttacataagattgtttgaacttttgacagtgatgtacttagagtaatggccatagtctatacaacttattcacaaatggtaccaaaaaatatatagattgtgtgtgtgtctgtctgtgtgtatatgcatgtttatgtaagtgtttacattatgaaagtttgaaaaatgacatctaactcagttactgttaccaagatcatagttattgtcttaaataatgaccatagctcttaacctgctacctaggctctaatgagccaactggggaagggaaacaaaaagaaattttaaaactaacatgatcttaagaataggtgccaaacgtaatatggcaatattaaaattgtctatgaaaatagcatgcttccgaaaagaggagaaatggaaagctaaaataaaagaaataatattttaatacaacaaaagtgttaaagtttgaaactcaagattcttttttttatatgactacctttcagataaatctgctctattcacaataataggatcacatatttgcttcagtgttttgataagtgataaaatcaaatttttatggcttttcttctgaccttttcttaggtctttagtggccttgtcattaatactgtccatgcttctcttcaaacctgctccaatttatatccttgatgaggtagatgcagccttggatctttctcatacccaaaacattggacagatgctgcgtactcatttcacacattctcaggtaagaaccaggaaaaaaagtctcagtaatagtttaattagactatttttctaaaaccattctttagttagtagtcaatgttaataagatatttagggttgataaatactaaagcattgtatatctatttaaatagacttatgtttaaataggtatagaaggaaaaaagtttcactctcctttttaagaaagagctaggcattaaaaatgttggttgtagcatgagggagattccaatttagtcataatacagaattgatttagggttaatataattgttttctctagttaactaccataaagatgtacaatcaaaacaaaactgtctccgggatatttaactgaggtatcagaaaatcatgtgacacttgatggggaaatttaatttctcatggctaaaaagtagaacaaagaaagcctcttgaagctaagaacagtttgtttttaatgcactattgctgtaggagctggggctgc

SEQ ID NO: 134251 - DNA, 2128 bp, Homo sapiens
atgaagtacccaaagtaaaattaagagacttctaaaacaatatggacagctagcattcatttaggtgcctcatataactatttaaagaaataaaattatctccaaaccattcttatcaccagtataaaggagtaaacttcaagtatatcacaaaaagtttttttatacttttttcttttttccttaagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaa

SEQ ID NO: 134252 - DNA, 1035 bp, Homo sapiens
tttcacttgcacaatgggactatttagactagtggcagttctgaagactcttaataaaatatattagcagcctatgtcacagattgtctctacatagggttcatgtctagtccatggggctaaggaaagttggggagaatttagaaacagacactattctatggcctccagttttctctctcttctatatgagcgcaatacaaaaatcttgttctaaccaaaaatagactgataaaaattacctcttgtaaattaactacctctctaatcttccctgctaattcattcacctcttttattaccaatggtctgaattagctattattattcctaagttacatgtaaggaaactgaggctcagagatattggggaacttgcttaaggtcacacagcttgtaagtgattagatatgatttgaatccaggtctgtgtgactccaaagccattgctgtttttgttatacgacactgcctattaagttacaagcactagtacctcatgataaaaaatgggctacttgtaatatgaacatttttaatagagaagttccaagaaacaggacatcaccagggccatgatgtcattgtggtttacacttcccatgaactctttccaataaacatttcatttaaatttagtaaagcagttaataaagccataaaggttaattactagttaagggaaaaatatgacttcactttggtgaacatgtgaaaaatgaatcaacttctttctcagttaacccaggattatacaggcaataaagcatgattatggatttaacatgttaattcccagtagatttaatagcagtgctgtgaaatacatgaccaatcgctaacccatctgacaagccttcagacagcactaatcaagattaaatcacttggcccatatgtggatgcaatatatctttcgagacaaaatgaccataatttttcatcatagaggtagtatacatccctggtgataggatgagaagcagagaagaaaaaagtgaggaacgcaatttgtgatctcaatctgacacctca

SEQ ID NO: 134253 - DNA, 1310 bp, Homo sapiens
caatgtgtggaactaatacatatggtattgagtaagatggaatattggctaaacaggggaaaaccctttgtaaattaaagagactaagtcttaaatgtagttcttcggtaaaggagtatcattatgatcccacagccttcttgtgagcaaattctcgtgaaaaaatggctagaggtagacccctgctaggaaacagttgctatatattcatcagaattaagagtagttatctttattgacatctctatgtaaacaagtgtatatggagaattgacaacaaaagtaaacaatggataatgagtctatgtgtgttccttgtaccagactcagatttggttgtaaccaaatctgtaattgtaccttcccaagatatttacatttgtcttacctccttcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatggtaaagagtcatccagttttagtattcagtatagattttcattctgttaaatgtaacataagacttagttcttggatctatattaccatagatacatacaggttaagtaagactttttaaaagcaataccaaaaaaataaatttagcagatcttcttcccagtggtacacctctaaccaccccttgcttgaactcttatgttatcataaatgagaaaacatgcagtctcatatatcaaaccataaaattgtgaattagactttaatcctcagaaaaatgttagaatcgtttgctataaagatagctcatgaaaaatttaaagcagtaattgtaaatgttcaagtgggttaagatcaccgttgggcctgccaaaagacatgtatatttaataaaaatgttttaaatgtgtaactaatgtatatggtattgacgaagatggaatactggctaaataagggagaaagctttgtaaatttatgagactcctaattgcagttcttgggtaaaggagtgtcattaggataagataattttttttttcttattattgttacagctagggctggatatcagcatttttgcagaaataattcacccatttgggagctttataaaaatggaggtttttaaaggatgatagttaacttttaagcgtcacccaactctgagatttaataattctgttatgtttagagaccactt

SEQ ID NO: 134254 - DNA, 1031 bp, Homo sapiens
tataactaacatatttagttttaccttttgattttgatttaaagaataagacaacatttctgattcactttttcaatatttcttatttgctattgccatatatttcagaaactacttgtggtttatttctgcagttcatgttctttggtggaatgagagtgcagatagtcgtgcagctgggagacataagtcccatgaggatcccagagttgtggcggctggtaagctgtttcactaagcacgaattatttttagaacaaatgtgattcaaccaataactgtatgccttcttatgaaatgtttttccagttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtacaatgtcatctgtattaattattgcttttacattcattgattattagtcattctaacttggaaaataatgcaattgggtcacagtgttaaaaatctagaaaagacttgttggtttatatgctgaaattgttcattt

SEQ ID NO: 134255 - DNA, 1822 bp, Homo sapiens
tctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatattttt

SEQ ID NO: 134256 - DNA, 1530 bp, Homo sapiens
gtactcacttcatttctctgtgtctcaggtttcccatttttaggtgagaattaaggggctctgataaaacagaccctaggattgtggacagcagtgatagtcctagagtccacaagtctgcttttgagtgatgggcccatgtatctggcacatctgcaggcagagcgtggttctggctcttcagatgatgccggtggagcactttgaggagtcctcaccccaccgtgataaccagacattaaaatcttggggctttgcatcccaggatttctctgtgattccttctagacttgtggcatcatggcagcatcactgctgtagatttctagtcacttggttctcaggagccgtttatttaatggcttcacatttaatttcagtgaacaaggtagtggcattgctcttcacagggccgtcctgttgtccacaggttccagattgactgttgccccttatctatgtgaacagtcacaactgaggcaggtttctgttgtttacaggacagttctgcagatcgatttctcaacagcttgggaagatttatgacaggactggacaccaaaaataatgtcaaggtaaaccgctgtctttgttctagtagctttttgatgaacaataatccttatgtttcctggagtactttcaactcatggtaaagttggcaggggcattcacaacagaaaagagcaaactattaactttaccagtgaggcagtacggtgtagtgtagtgattcagagaatttgctttgccaccagacataccaggtaaccttgactaagttacttaacctatctaaacctcagttccctcatctgtgaaatggagacagtaatcatagctatttccaaactgttgtgagaattcaatgagttaaaggtataaggtcctcaccacagcgcctgcccacatagtcagtgatcactatgtcctgaacactgtaattacttcgccatattctctgatcatagtgttttgccttggtatgtgactagaatttctttctgaggtttatgggcatggttggtgggtatgcacctgcctgcaggagcccggtttgggggcattaccttgtacctggtatgttttctttcaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgtaagtgtggctgtgtctgtatagatggagtggggcaagggagagggttatggagaaggggagaaaaatgtgaatctcattgtaggggaacagctgcagagaccgttatattatgataaatctggattgatccaggctctgggcagaagtgataagtttacgaattggctggttgggcttcttgaactgcagaagagaaaatgacactgatatgtaaaaatcgtaacatttagtgaattcatataaagtgagttcaaaaattgt

SEQ ID NO: 134257 - DNA, 1023 bp, Homo sapiens
tcatgctagaaaggagccggagcctgtgtataaggccagcgcagcctactctggacagtgcagggttcccactctcccaactccccatctgcttgcctccagacccacattcacacacgagccactgggttggaggagcatctgtgagatgaaacaccattctttcctcaatgtctcagctatctaactgtgtgtgtaatcaggccaggtcctccctgctgggcagaaaccatgggagttaagagattgccaacatttattagaggaagctgacgtgtaacttctctgaggcaaaatttagccctcctttgaacaggaatttgactcagtgaaccttgtacacactcgcactgagtctgctgctgatgatactgtgcaccccactgtctgggttttaatgtcaggctgttcttttaggtatggcggcttttccctgggtgtcagtaatactcaagcacttcctccgagtcaagaagttaatgatgccatcaaacaaatgaagaaacacctaaagctggccaaggtaaaatatctatcgtaagatgtatcagaaaaatgggcatgtagctgctgggatataggagtagttggcaggttaaacggatcacctggcagctcattgttctgaatatgttggcatacagagccgtctttggcatttagcgatttgagccagacaaaactgaattacttagttgtacgtttaaaagtgtaggtcaaaaacaaatccagaggccaggagctgtggctcatgcctgtaatcctagcactttgggaggccgaagcgggtggatcacttgaggtcaggagttcgagaccagcctggcctacatgacaaaaccccgtatctactaaaaatacaaaaaaattagctgggcttggtggcacacacctgtaatcccagctacttgggaggctgaggcaggagaattgcttgaaccctgtaggaagaggttgtagtgagccaagatcgcaccgttgcactccagcctgggcaacaagagcaaaactccatctcaaaaa

SEQ ID NO: 134258 - DNA, 1051 bp, Homo sapiens
ggaaggagtcctgagccattttttttttcttgagaatttcaggaagaggagtgcttatgatagctctctgctgcttttatcagcaaccaaattgcaggatgaggacaagcaattctaaatgagtacaggaactaaaagaaggcttggttaccactcttgaaaataatagctagtccaggtgcggggtggctcacacctgtaatctcagtattttgggatgccgaggtggactgatcacctaaggtcaggagttcgaaaccagcttggccaatgtggcgaaaccctgtctctactaaaaattcaaaaattagccaggcatggtggcacatgcctgtaatcccagttacttgggaggctgaagcaggagaattgcttgaacctgggaggtggaggtcgcagggagccaaaattgcgccactgtactccagcctgagcaacacagcaaaactccatatcaaaaaataaaatgaataaaataacagctaatctagtcatcagtataactccagtgaacagaagatttattaggcatagtgaatgatggtgcttcctaaaaatctcttgactacaaagaatctcatttcaatgtttattgtttagatgttcagaataaattcttgggaaagaccttggcttggtgtaagtgaattaccagtgccgagggcagggtgaaccaagtctcagtgctggttgactgagggcagtgtctgggacctgtagtcaggtttccggtcacactgtggacatggtcactgttgtccttgatttgttttctgtttcaattcttgtctataaagacccgtatgcttggttttcatgtgatgacagagaaaacaaaacactgcagatatccttcaggacctgacaggaagaaacatttcggattatctggtgaagacgtatgtgcagatcatagccaaaaggtgactttttactaaacttggcccctgccgtattattactaattagaggaattaaagacctacaaataacagactgaaacagtgggggaaatgccagattatggcctgattctgtctattggaagttt

SEQ ID NO: 134259 - DNA, 1032 bp, Homo sapiens
tgctttattttgggccatctaaggttatcttattagtgtatttgttgttcgtctcctccatgggcatacacctccatgaaggcaggtattttcaccttaggccctcgaatatactggacagcatctggcacgtagtagatgctcaacgaatgtttgttgtgtgagcaaatggttggttgattggattgaactgagttcagtatgtaaatatttagggcctctttgcattctattttacttatgtataaaatgatacataatgatgatataaatgatgtcacagtgtacaaggctgttgtgggatcaagcaatcaaatgagatcatgcttgtcttttccaaatggtgagggaatagatgcatgtttgtggttgttacggaatgatcctgtgctcctgaggcaacagaaaggccaggccatctctggtaatcctactcttgctgtcttccctttgcagagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaagtgagtcactttcagggggtgattgggcagaaggggtgcaggatgggctggtagcttccgcttggaagcaggaatgagtgagatatcatgttgggagggtctgtttcagtcttttttgttttttgtttttttttctgaggcggagtcttgctctgtcgcccaggctggagtgctgtggcatgatcttgcctcactgcaacctccacctcccaggttcaagcgattctcctgcctcagcctcctgagtagctgggattacaggcacgcaccaccatgtctggctaatttttgtgtttttagtagagatagggtttcgccgtgttggctaggctggtctggaattcctgacctcaggtgatccacccgcctcggcctcccaaagtgct

SEQ ID NO: 134260 - DNA, 1023 bp, Homo sapiens
gttgtggaacatagcatgtgtttgtgacctgtgcctgttatttttgtgctttctagttgtgcatgcaaagagtacaaagttttcttgccctttcttggaaaatcctgcttgtctgtgccaaagggataattgtgaaagcacttttgaaatacttaatgagttgattttcttcaaattaaaaaaaatatataaatgtatatgtgtatgtacatgtgtgtacacatacacacctttatacatacagcccatttaaaacaagctccactttggagtgctctacgtcaccctgatgccgaatacagggccagagtctgagatccttctgggtggtttctgtgttttgttcatttctgttttaagagcctgtcacagagaaatgcttcctaaaatgtttaatttataaaaacatttttatctctcgattactggttttaatgaattactaagctggctgcctctcatgtacccacagcaatgatgctcctgaggacacgggaaccctggaactcttaaacgccctcaccaaagaccctggcttcgggacccgctgtatggaaggaaacccaatcccgtgagtgccactttagccataagcaggcttcttgtgcttgttgcctggtttgatttctaatatgctgcatttatcaactgcatgccacattgtgaccgccagcatttgccctttgaattattattatgttttatttacaaaaagcgaaggtagtaaccgaactaaattatctaggaacaaacgtttggagagtcttctaacaccgtgcaaagcacgtcattacagacatttgtttactgatttagaaccttaatatttaatttaaatagcactttacacttactgatgaaatgcttttcctttctttctctcccagcccctgtacttaagtgcttcaataggctctcattatatatgatttttaggttttgcttatcagcttcttcgcttttataatctgaaaagatggcatatgaatttttataaaaagggacactttcttcttctcaaat

SEQ ID NO: 134261 - DNA, 1030 bp, Homo sapiens
agaagctgagatgctaattgccattgtgtattctcaaatatgtcaagctacgtacatggcctgtttcatagagtagtctataagaaattgatgacttgattcatccgaatggctggctgtaacacctggttacgcatgaacacctcttttcagttgtctcaagacacctttcttttctgtacttatcagacaaggactgaaaggcagagactgctactgttagacattttgagtcaagcttttccttggacatagctttgtcatgaaagccctttacttctgagaaacttctagcttcagacacatgccttcaagatagttgttgaagacaccagaagaaggagcatggcaatgccgaaaacacctaagataataggtgaccttcagtgttggcttcttgcagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcaggtgagacgtgctgttttcgccagagactctggcttcatgggtgggctgcaggctctgtgaccagtgaaggcaggatagcatcctggtcaagatatggatgccggagccagatttatctgtatttcaatcccagttctattccttgccagttgtgtatccgctggcaagttacttctctatgcctcaatctcctcatctgtaaaatggggataataatattacctgcaatacagggttgttacgaaaataaaaatgaataggtgcttagaatggggcctgacattagtaagtgcttagttttgtgtgtgtatatgttatttttattttggaggagaacataaaaaggacaaagtgtagaaaaactggttgggtgtattcagctgtcataacatgagagttgttatgcccagatgcacttgacatgtgaatttattagaaacatgatttttctctgagttgatgtttaactcaaactgat

SEQ ID NO: 134262 - DNA, 1031 bp, Homo sapiens
gagacactctgggcatgaaagaaagtaatgataatagttaattttatatagcgttgttaccatttacaaccttttttttttttttaacctctatcatctcaattaaagtgcagagagaccctgggaagaaggtaactatatttattatcccagatgagggaagtgaggcttgtagggaattggtagctgattcaaggtcacccagcaggtaaataacagtggtgggaccagacccaattaccaggtatgttttcctctgtaccgcagtacatgcctgagatttatttgtgtgttgaagccagtggtacctaatgtatttacatcccaacctgaaactcctatccacttatttaccttttaatgagcctcttaactcaagtgcagtctgaggaccagcagcatcaggatcacttgggaacttgttagaaattcagcaacctgggcccagctcagacctaccgaatcagaatctgtgcattttaacaaggttcttgagtggttgaacacacattaaagcatgagaagcattgaactagacatgtagccaggtaaaggccttgcctgagatggttggcaaaggcctcattgcagcattcattggcaggccacagttcttttggcagctctgcttcctgacctttcaccctcaggaagcgaggctgttcacacggcacacacatgccagacagggtcctctgaagccacggctgccagtgcatgtgtcccagggaaagctttttcctttagttctcacacaacagagcttcttggaagccctccccggcgaaggtgctggtggctctgccttgctccgtccctgacccgttctcacctccttctttgccatcaggaggacagtgtttctcagagcagttctgatgctggcctgggcagcgaccatgagagtgacacgctgaccatcggtaaggactctggggtttcttattcaggtggtgcctgagcttcccccagctgggcagagtggaggcagaggaggagaggtgcagaggctggtggcgctgactcaaggt

SEQ ID NO: 134263 - DNA, 1029 bp, Homo sapiens
cctatctcagtgactaatggtagcaaagcattcccttaaaaaggcattatttgtgaaacttatctaaaatcgaattcgggtccaattaaatttttgaaattttatattaaaaattatattagtagggatgggtaagaggtgttttggtctggttggttggttagttgctatgactcagaattgctaagaaaacagaaaagtaagataagatcattgttttaacctcttttcctccacaaaatcaataaataacatatccctaaattactcttagaatttctcttaaattgcagtgaaaaaccaaaatccttcattcttggttgaaggttggaaaactacgttagagaggattagagagagaggatgagcaatcgtgtagtcagcccttgcctcctagtgtaggatttgtctcagccactgcttgttgtcctggctgccaacgttctcatgaaggctgttcttctatcagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtaagtggaatcccatcacaccagcctggtcttggggaggtccagagcacctattatattaggacaagaggtactttattttaactaaaaatttggtagaaatttcaacaacaacaaaaaaactcaacttggtgtcatgattttggtgaaattggtacatgacttgctggaaggtttttcataggtcataaaataacagtatcttttgatttagcatttctactcaagggaattaattccaggaattttggtggcaggcacctgtaatcccagctactcgggaggctgaggcaggagaattgcttgaacccaggaggcagaggttgcagtgagctaagatcgcatcattgcact

SEQ ID NO: 134264 - DNA, 1076 bp, Homo sapiens
aaatttgccagtcatggtgatgcatacctgtaatcccagctactcgggaggctgaggcaggagaatctcttgaacccgggaggcgggggttgcagtgagctgagattccaccattgcactccaacctaggtgacagggtgagactccgtctcaaaataaaaaaaaaaaaagaaaaggaaaggctgtgtgtgtgtgtatgtgtgtgtgtgtgtgtgtgtgtgtgtaacagcaccatcacactgtttgagttgaggagcacatgctgagtgtggctcaacatgttaccagaaagcaatattttcatgcctctcctgatatggcgatgctcccctatctcattcctgtgtgtgtttagccaggcaactgttgatcatcaatattatgataacgtttctccactgtcccattgtgcccactttttttttttttttgagttacttactaaataaaaataaaacactatttctcaatagacttgaagcttcaagatttcctggtggacaatgaaaccttctctgggttcctgtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattcaggcaggaattgccaaaccatccaggagtggaatatgcaacctggcgtcatgggccagctggttaaaataaaattgatttctggcttatcacttggcatttgtgatgatttcctcctacaagggatacattttaagttgagttaaacttaaaaaatattcacagttctgaggcaataaccgtggttaagggttattgatctggaggagctctgtctaaaaaattgaggacaggagactttagacaagggtgtatttggagacttttaagaattttataaaataagggctggacgcagtggcactgagttgagaactgttgcttgcttt

SEQ ID NO: 134265 - DNA, 1028 bp, Homo sapiens
tgctgagaatcatgactgggtgggagaaggaggtgaccctttgctgtcttatttttactgtgtatttccttttcagctacttaaaatgtattgcttagtgatacctaatgggttcattagcctgcttcctactgaacatttccgctcaggcatccacttggtcccaaggcctgctcctctcccatattctgaaatctggactacagactctcattcaactccaggttgcactgtggacacagtcccctcttgagcaggtacctccttgcagtggttgggacgtcctacttggctcatagttgggaagtgcatatgctggagctgaagcctcttgccttcccgggatagggcgtcctcacatcccctctgagaagttccccagcttccctctgttccccgtttccacacttagcgaggctcttgtccactgctacatcccccatagccagtccctcagccttgccattgcttatgctggtctggaaacaattcctagacttgtggggcatctggggaagttctccatctttttttagctggcatgacccaagtggtgtgggcagggctgtggattctatggtgtggctggaagccaggtagcctctctctactgtacatggaactcagcaacttctgagtcaagcaagatcttagctctgcaggtgtcttgccctgtccaaagttatggccacaccagtaccttttaactctagaagcccagtaagtgttttgtgggaccgcaaagatcattttctagacctgctgaatatgcctagaacgggtagggatggctttcacgctgttcctagggctgacaagtcacacgtttctgggggtacatacacaccgcggtccctgtgaatggcactctccatgagaactgtgatgatttgagttgaatagtgcacagcctacatggttctctgccatggcctggagttccttatcttgccttctccagtgaggactagggctgcaactggcctactttggctcctgacttgggggattctgaaataccttttttt

SEQ ID NO: 134266 - DNA, 1059 bp, Homo sapiens
tctaagtgccgagacacagaggtgtccaaaacaaatatggcccctctccatatggaatttctattctagagaagaatctgacccagaagggggaagtgactgtcccaagtctacacaaccacagaagggatattctgggaataaatcacggctaaacccccctgctgctccaggcagttctccttctacagtgctctattgtgctgttttaataatctttcaactgggaagaactcccatttcaggaattaagccgtggacaaatcttttaattatccttgaaatcatcctaataagaaatccaaggaggaagtcttacagggtgcctcacccacttttctcatcactggaactttttagacattttattattttcttcctaaaccagagtacaggcacacaagttgagtggtgtggtggctaaattaattaatgtttgcaaggcagtgtgagaagcattcattcatcttaaatacctatggtgactgcaactcagatgtaaaaattggataaatcctcagaaaccctagggaaagtgacatgtctgtattttgtctctgtgagatacagactggcagagataagtgtttctctgggtgagttttgtgtggtatctgggatgattttaggcagtacgtggatgagaacttttaattttaacccacatccaattgcaatttcatggaaattattgcttaggaggatgttcaacaggaaaaatataattaaagttaattcaaaagaaacattttctgtgaatatggtaaaacttgtgagagtagtttgtaaatgattgaagattggaaaacattggtataagagtgagtgtggggttttgtattaagattcattttgggaagaaatccatgctgcatccctcatgaagtgtgaactttgggcatgtgttgattctttctggcccagagtttacctgaagattagctgccctgagggtcactgagcattaaattagatgatgtctgtggatgactgatagtgaagctcatagcccacagttgacacataataaattcgagttgctttgcttccccttctgtt

SEQ ID NO: 134267 - DNA, 1083 bp, Homo sapiens
tcctctcaacatagtcaccacatacctggcactatgctaaggctgggaatgcagacagatgggtgcctgctttcagagtgctcaatgtgctgaggaagccagcaacagaaacagatgatttcaggagctccaggaaaatgctacaggaggagtgtgcctgggttactggagtagcacaggaggagggcttctagctcaggctgagattttagtaaaggaaattatgccacgatgaatcctgaagaatgaatagaagtgaaccagataaagcacgataggaagcatcttcccttacctaagggaagacacagaggtatatggaatggtatgttaaaaggttgggactccaaacagttctgttaaagcttagagagtggtgggagagactggagaagttgattaattagtaaatgaagttgtctgtggatttcccagatcccagtggcattggatatccatattatttttaaatttacagtgttctatcttatttcccactcagtgtcagctgctgctggaagtggcctggcctctatttatcttcctgatcctgatctctgttcggctgagctacccaccctatgaacaacatgaatgtaagtaactgtggatgttgcctgagactcaccaatggcagggaaaatccaggcaattaacgtgggctaaattggacttttccaaagatgctgtctttgggaaacatcacacatgctttggatcagaaaacctaggcttctaatttgttgataaggcatgaactcaggagactgttttcagtcctagtgaatggtgataattgtaattataacagtagacaacatctcttttacacattttaaatcatgaaaatagaataaccttactgataattttagaaagtggtgattaaaagcacatttaagataatgccttaacacctagtcttttccatatgcatgatgtcttaatcacacattgcaaatcatggaacacagaattttaagcagcatttgtgtagaacttctcagttttactaatattattttattttattctcataacaaccttgaatagaactcagatcatctgtcaatcatgtatttt

SEQ ID NO: 134268 - DNA, 1046 bp, Homo sapiens
tggctcaggcatgagggctgactgtcacccttcgataggagcccagcactaaagctcatgtgttggcagtgttcttgcgggaaggaaaaagaccagccagcccatttgttactgcacaagcaaacagcttctggtagctgtacagatacatgcactttctttcctcactgtgtttccatagacagatttagtgctgtagaagagtagagggcagtcacgggaaggagttcctgtttttcttttggctatgccaaatggggaaaaatcctcctatcttgtctttttagtgtcatcctctctccccttttcttcttctttataattctcatctctcatctctcctggaaatgtgcatgtcaagttcaaaagggcacaatgttttggtgaggaagaggtgggagaacacgtgccaggtgctaactagggtcatcatttcccccttcacagccagcttcctgtgaatgtgtgtgtgtgtgtgtgtgtgtgtgtgtgtgtgtgtgtgtgtgtgtatttcttttgccagcatcactgaatctgtctgctgtctggtattccaggttttggtttagggaaaagtaaaagtaattttataatcccagctgtcatttaagccacccctttgtgggtagcatatggtccactctctcagttcattgtcctaaagatgcttcatcagaaaggaataacttccaccccgttactctctgtccccttactctgctttatttttcttcgtcaatcctaccaccaccacccactgtttgaacaacccactattatttgtctgtttcccatccctggtagaataggagccccatgaatgaaggaactttgcttctgttgttcaccactgaatctctaaggtatggaacacacctggcatgtgataggcactcgataaatatttgttgtggctcatgggcaccttgcagagttaaggctgcagttgtttgtggaatttataagtggtaatgaatatttatctactattcctcttccaaggcgatcacacaataatcaggctttacactatccagttcttaggt

SEQ ID NO: 134269 - DNA, 1051 bp, Homo sapiens
aagcgattctcctgctttagcctcccgagtagctgggactacaggggtgcgccaccacgcccagctaatttttgtatttttagtagagacggggtttcaccatgttggccaggatggtctccatctcttgacctcgtgatccacccccctcagcctccaaaagtgctgggattacaggcgtgagctgccgcaccccgccgctttatgtgaaatctttaaaacacgtgtctgaagtaagtattctcccccatcattaaagtgtagatagagaatctaagactcagagaaggtaactgaattgcctagggtcacataaccattgagcagctctgagttcctcacggtgccttctgtgtcctcttctctctgctcaactgcatccatctctggctgcagtgccagctgcttcaatctgttctctctgtgggaggccgcaagccaccaggcatcagccaggagcagaagtgttcaaaaattgtccagctgcagctgggcagaactcaaggagttgtggtcccccactgcagctgacaaggatagcgagaagcaaataccctgaaggttaggagcccatcaggggaggactagagggaatcaattcatcagctgtgtccaaatgccccacctcccagcagaaggccacaccatctaccagtgaaacctgctgcaatcttgacccttgaatcctcaccatgatccggtatcctcttggctcaccaccgcaccccttccaatgaatcactaggtggtttccagtctacctctgatatagctccctaatttttcccctcctctacatctccagcctgcactctagagctgcaacccccttccccagtccaccgcactctgcctccgggatctctcccctcctgcaacctcaagggaattcttgcagtgatttttagaaagaaaaaagtgtaggctggacatgatggctcacacctgtaatctcagcactttgggaggctgaggcggatgggtcacttgaggtcaggagttcgagaccagtctggccaacgtggtgaaaccctctctataataaaaatac

SEQ ID NO: 134270 - DNA, 1042 bp, Homo sapiens
tcccagagggagaatggtgaagtcaccaacaccaccaggtcaccagcaaccttaagctctggatggaatgatgctagggaaaaatgtgagttagaaaaggagcctgacactatttcttttaaaggaaggccattagctcatcttgggaaagtcagctggctggcggggaagaggaggtaggaggaacgttagcagaaaatacctaactcttgctgtacacggtggctcacgcctgtaatcccagcactttgggaagctgaggcaggcagatcacctgaggtcaggagtttgagactggcctggccaacatggaccctgtgtctactaaaaataaaaaaaactagccagcatggtggcggcacctgtagtcccacctccttgggaggctgaggcaggagaatcacttgaatctgggaggtggaggttgcagtaagctgagatcatgccactacactccagcctgggtgacagagcaagattctctcgaaaaaaaaaagcctaactctggatggatcttccccagttctagaaggcaccagtgttaataagttcctgatgcacaaggctggcagagagtcagctgtgggagataaatcaagaataaagctgtgaggtagggaaggcggtgtagcataaagacccagacaaacatgtctgggtcactctgttccatttctgcttgcttggctctggcctctgctactgatctggccttcccagatgcccgccatgccattgctaacacctgcttggccttttatctggctttagacttagcatttactttgggatttatactgttgcttctctcttctgcatattgatgtttattgggctctccagtggtcccttgacttgtctatggagccctttctttttgtcacctattctgaagggaatttcatccaagtgatgctgatcaggccatgctccacatccctccctggcacctggcttcgagcttataggtgcagctcccttgggattggagctgctttctccacggagcccccatgggtgctgtgtgggtcttaatccagac

SEQ ID NO: 134271 - DNA, 1013 bp, Homo sapiens
tcaggcctactcccatactgtggagtgtactttcgttctcaataaatccctgcatttgctttcctgtctttgtgagttttgtccagttatttgtttgagaccccaagaacctggacaccttctatcagaacaccagcactttgacaggccgagggtgtggatcacctgaggccaggagttcgagaccagcctggccaacatggcgaaaccctgtttctactaaaaaaaaatttaaaaattagctgggcgtggtggcgtgtgcctgtaattgcagctactcaggaggctgaggcaggagaatagtttgaaccctggaggcagaggttgcagtgagctaagatcaagcctctgcattctagcctgggtgacagatgggggagtctcaccacattacccacgctggtcttgaactcctgggctcaagcaatcctcgtgccacagtctcccaaaatgttggaattacaggcatgagctactctgtctagctacaaatatcttaatgcttactttgtatgtaaaattttggggaaacttttattttttaattttgtttggctgcattttaaaaatttctatattgggccaggcacagtggctcatgcctgtaagctactcgggaggccaaggcaggagaatcacttgaacccaggaggtggaggttgcagtgagctgagatcgtgccactgcacttcagcctggcgacagtgcgagactccgtctcaaaaaaaaaaaaaataaattctaaattgaacacaactaagttttaaaaaagcagccccaacagcaaaaagactcgagacaagaaatgacagatcctataggaaactgaagaatgtgtttggtagagagaataagcattatttcttcttttatctcttgtttgtttgtttatttgttttttgagacagagtctcgctctgtcgcccaggctggagtgcagtggcccgatcttggctcactgcaagctccacctcccaggttcacaccattctcctgcctcagcctcccgagta
